United States Patent 10,724,096 (METHODS AND COMPOSITIONS FOR INHIBITING AND TREATING NEUROLOGICAL CONDITIONS) - sequence listing, part 26

SEQ ID NO: 268 - DNA, 387862 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaactgcagggaagccgggaagagtgacaagaagcccctcccataaaaccccaactctgcaccaattgcattccagctcttagcctataaggcgagggggtgtggcctcggtgcaggctgctttgggattggttggcaagggccagcctctggggaggctttctcctcacccgacaaacgccattgaataatggtatccctgcagctctgaggccaccctgagaaaagatgaacggggcttccctcttgcagtgatgaataatgaccataaaactcctcaaaattcgtagttcattcttaagaattgcccatccttttggagggcattttctatgaattttaatgtcctctggcttcccttccttccaaataaaaactgctccaaaaatggcaatcgagcattttaattgcttccctctctcaaatccaaaacaagtggctccctggtgatgtagaaatgactgtagttctcccctcatccaacataaaagcatagggattaaacaatacgactaatgtccagaattcacagatggcacagatggcaatgacacattccctcacctgtgtgccatggctgctctcagctccttttgtttctattgttatgtatgacagagttctaaaaccttcaaaatctaggggtgggaccacttgcaattctggggggagggaaatgtgaaagctagggcactgtgtatgcataaggaatgcagtgttttgtatatagaactcaggatctgtattttgatcagaagagaatattttatttatttatttagagacagagtctcgctgtcgcccaggctagagtgcagtagtgcgatcttggctcactgtcacctctgcctcccgggttcaagcgattctcctgcctcagcctcccgagaagctgggattacaggcgcccaccaccacgcctggctaatttttgtatttttagcagagacgggatttcaccatgttggccaggctggtctcaaactcctgacctcaggggatctgcccacctcagcctcccaaagtgctgggattacaggtgtgagccaacgtgcccagccagaacagaacattttaataactgtacacaaagttaagaaaggaatgagtggctcttaggaatccagaattgagctcaagagtaatcagacattttacgaggagggttaaatgagaaatcaaagttctttctagaaaaacagcattttctatttggtttggtgtagtattaccctgtaactttaatactaaagaggtcttgtgggtgagaaacaaggaaaaactaggttttagttgattttagcatataattctgtgcattttacctcctctccatctcaaagcctgtgcttactactctgtgctttaacttgctggtatggctactctgcagtcttcctgacatttaactatttccacatgtggcatgtctgtcttagagagcatgctctctgataagcactcctgtaacactgtgtctctctgagtttctattggcctttagctgctacagtcctctgcttttgttaacatctgttgtattcatttccatcactcttactcctctacaaaaggaagaaattaaagctccaacattccactaaagctacccccagaggaatactaaggtcctccttttctctggtctccctacttctctgaagtgttccacatgtttgatcattcctactactctccctcaactcccaggatcctgaacttctttaattttccctaggcccacaatcttcaatgaccacttctaacttgaacttcagtgccatatttctgaatacaagattctcctctcgaatgccctgctagtcacgacaaactttttcaaaactgtgagacatttttctatttaaagtagttcttagtataattacttccatttcagtcagtgagcctatatttcttccagtatctcagatggaatctatgactctttcctaccattcaacaggtgtttcatgtgcgtcagacactgtcaggtgtttaatataaaccatctagctgaatccttgagtaacccggcatgttcccctatacggcatcaccttccctccttcattcaactttgttagcaagccctatcttttatccagagctgtttctttcagtttattccttaccattacccctcccgtaatctgaatccaaatatttaaaagactgagagaaatagaaagtaactttaatatcaccccctctaactccctcatttccacataaagttgagacctagagagaaaaaatgattttcccaggttcactctggtactgagaacaagaattgcaagtttaaatcttttgtgcacaatcactgacaaataatctttttagtgtgtcagcttcctcatctgtaaagtggattactgtggcagctagtctccaaagatactcttaatgagccacactgtcctacactgaatctgagttggcttgtgtaaccaacaagtgatggtgcatgactgctgaggctaagtcataagaaatcttgcagctctcatcctgctttctttgaatgtgctattgggacccctaagccattaggttgaaaaaaaaaaaggtctgactactctgagaggctatgctacaagaagtccatgttaacttcacagacagtgaagagagaaagcgcaagagagcacttgcacaagaaagagcacacatgcctggccagtcttcagcaatgccagccaccccagcccagagccagacctgaggggcaagaagccatcctagccatccagccagttcagctttcagatagctacccactgggctgcaaccatatgaggaatgccaagcaagaatgtctagccaagaccagttaacccacaaagccatgaaaactaataaaaatacattcatatttcaaagtattaggtttgaagtgatttcttacatagcaataaataaccagaacagatacatatgaggattaaatgagaccatatatgcaaagcacttaaaacaacaaatggtacaaagttgaagataagtaggtatcagacagtaaagatgacagtgacaatgatcattatgataatcattctattatactaatatttaaaaaaattctctggtttgtcatttgtttttaaaatatatatgttatatttcctttcaattgcatcacagcactccatgtctcagggccaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggttgctataaggtgatcatggaaagcccctctgatgagatgacgtataccaggagatctgaagaaaggaaacaagccatgtggattgcggggtgagaggtagggtagagaagggaaaaccaagtgaggaatggcaaaagcaaaggcctcgaggcaaaacatacttggtgaggctccctgaagaacaggtggaagtgtcataccacttgtcatttaaatgcaaattacactctgcagtcaggctcactgccttccccctcctttaaaaaaaaaaaaatccatccatccatcaattttattctttgacaaacttaagactcagttactttttactttttataacaagtattcatcctgaaatgaaattcctaaatacacttccttcataatactgtactgaatacatataggctaaatactccctacatagatttaaaaaaaaaatcagtataatggcttatcagtgaaataaaggagaaatgagtaatttctatcaaatactacaaaatataaatacttgtacacaactacattttaaaaagtagtcaaaaactactataactgattagctgtgtgaccttggggaagctatttaaatttcccatacttcagtttactcacatggaaaatgagaataatagtttctaccttacagggttgttgtgaggattaaattagtgcatatacataaggctcttagaacagtaagtgctatctaagggtttgctatgatttctcttatggggagaattaccacaaaagtaacagtagcatgaaaatgaatacaggggtgttatgttagaaaaattttcctttttcctgatatgatgaatgattctttgaaaggtttcaaatgtaacaaagtgccatcttcacaatatacactattgctgcattactagaaaatttggtgtggattaaaaccatgtaaaaatatttaatacttatacgtaaaaagtagttgggttctaggctcagagaattataaatgcattttgttttttcacctatgtgaatagctgctgggactttttggaagttgtgtgggacacacagcaaacctccctggtgaaaggctgtcccatgtatcccaggacatctagcctccctggcctctgcccaccaagcaccaggagtactccccagtcactgtcccctgaaatttcctgaatgttccccagtgttaagaatcactgttctatttttttcaactgtcttcaactttgactcctcatccagggtggaggatctttgaggccagaaaagtatcttattatgtccctgtatttctcaaggtagtgtactattgccacaaaaagattgttggctgatgcagatgcaaaacatcaatatttttatactgattataggtgacaggaaaggacaagggttttcaccctcagcaaaatcatcaaaaacatttaaaacagattacatatagtagataatactccttgtcttaaaacattatgcagaaacacacatacagtttcccttccctctaaaatctgcagcctcttctccctgctgaatgtgagtgatggtcccttcattcaacagacttctatttggcaactattatgtgccaggcattctaataggtgctggatgtgaaaggatttaacttattcaaataagtccctaatttgctgcaataagggagattatttaatcatattgagtaaaaagtaccaaggaaagtttccatatttctagggaataagaaatcttttcaaaaatctctgagccaaattaaaattcatttcattttccctaatctccatttctaggagactagaatctccttcctattgccacggtagctgctatctgcagagagaatctagataatttagaagagaaatttgaatagagccagagagatacaattcttatagtcagacttggcttcaccaaatttaatgaagaaactttaataagttacaacatttactaggcacctactatgcacaaagaactttacatacctcatttctaatcttggcaacattctgataagataaatattatccctattttaacatgaaaagatggaccttcttacatattcaataacttgctccataggtgacaggattgaaatgcaaacccagtccttgctcttaatggtgtatgacagctcatcatataattaggctgatgcaaactctatgataaacagtatgaatctaggagtggatttgtttatcctcaatctttttgctaactttacagtgccttgaattaaagaatcatggttactatcaccatggtcagatctctggacagggtgaggaagcaggtgcccacaggcagacagccctgccatatagtgagacacgcttatgtttgggagcgctatgtgaacaacacacagctgccctcatatgcagatgtaatgatgacgacacattcagacaaggaactgaggtccagaaaagttctgacaacacaacttgagggacagcgttacagctagagctcaggtttcttatctgtaatccactgctctcaaatgcccaaatgattttatatacatatatgcaagtgtgtttgttgaaatagaaaaaatagtttcttggcctggtgaagtgcctcatgcctgtaatcccaacattttgggaggccaatgcgggaggattgcttgaggccaggaggtcgagaccagcctgggcaacatagagaaaccaccgtctctacaaaaaatttaaaaattagccaggtgtggtggcatgtgcttgtagttccagatactactgaggtgggaggtgggaggtgctgaggtgggaggatggcttgaggccaggagtttaaggctgcagtgagctatgattgcaccactgtactccagcctggatgacagagcaagaccttgtctcaaaaaagaaaaaaaaaattcccataatgttcagttagttctctttttcagacttttcctagaaatacccctcagaatttctagaggccacttccctgctattccttgttttctcagtccttaccagatacccaagcaattaacaatctttttgaactatttcagtacatttcaggatatttgaaattctgctgatggagctgaactgctgatacattaacacatgctgtcattattgactttgtaacagaggtcaagagagaaaagatgcatttttgaatagggaaaaacaaaactaaattatggggaaactaaggctcagagaggtcaagttgtcttgctcaaggtcacaaagccagtagtaagtaacagggccaggatttgaacccagactgtctggtttcagagtactctaaattgccaaaaaaagaaaactatttcaggcattattttatatttagcctagagcctacataatagatccgttaatataatcaattctaagctgtatattatattactgtgtttgaaatatttaagaaatattgtttaaaataagtgtattagctcttggacctctccaacataaggagttttccaggcagtagcactgtttgcagtaggacttacattattggaaaatattttatcctataatcaatctacatttattttacacctttcaccttaaaattaaaagtcgtggtagttattaatcaagaagcaaatctatataacgtggtctctcatatatccagtactgttcagcttgaacaaatgcaaatctaatttttaaatgtcccttgaagaattctgaggcaaagttaaacttcaagtattaaacagaatagccacagaaaactagtgtttctcagcctccctttgctttcaaatgccttaaaaatattttagaggcagacaataatctagaattgattcataaccaatattttacataacagaatgttacatgtattttcatattataaaaactatactttctttgattaatgctagtattctgaaaacatcgttagtgccagtaaatccactaaatctgtttgtatttactgccctctagtgataatggctctacatttgattaagaaaaaactattcctttcagtaaatgaaaacatctcttgtaagttttatggagatttgagattaagaggaactccaggctgcttttttaaaaccaaataatcatctgaacaagctgagaatcgttctctaaatgatcttattttaatttttttttaacaaaaaagtctcatttaaaatagtaaacacctgcaacatgtatggagaaaggaaaccatttttgctaagaggctccttgaagctgaaataacatgagactgatctgatagctgtatttatatttctcttctacatgggctaactctcttattagatgttagcatagtattctgtaattgttgatacagtttgaattcatatatggtagagacagagttttgtataactatttagtcaatttacctaaaaccagcagcagcagcatatctactacagacttttgtttcactgaagaataatcatgacaataaatgggtgcaaaaacttcacataaatgaagcctccacaaaaataatcttgtatgaaaaagtattgtctccttatagagaaaattaggatctccaattcacttaaattggcctaaatgaataccataatcatcataaaatagttactaatgtcccctctgtacttcgtggtatgctttgtggaaacaatttaaacaaagagaatatctgtctcctaaagtaataataactagtgtaaataggcatgcttccagaaatatataatcttttacacatatcactttaatatgtgcatcttaaaataattttaagtaataaaatttgagctataaaagagaaatgatattcttttcaacaaagaatgcttgaacaattgagcatccactcataaaacaagaaacttcaacctttatcctgcaccacactaacatctacttgaaatgaatcatagaactaaatgtaaaatctaaaactaaagaacttctagaagaaaacacagtagaaagtagttgtgatcttgcgttaggcaaagatttcttaaaccacaaaagcatgaagcataaaataaaaaatggtatactggactttaccaaatttctctttgaaaaaaactgttaagaaaacagaacaacaagccacagacttgagaagggaatatgtacaaaatgcatatcaaataaaggacttgtatccagaaattattttttaaaaaatctttacaacacaataagaggacaatccagtgaaaagatggtcaaaagatttgaacaaacaaacacttcataagaatcaaaaagatcaataagcatgtgaaaagatccatgaccatcattagacattagggaaacaaaaagtaaaaccacagtgagatgccacactacatacttactagaatgtataaaatacaaaatacaaacaatacaaaatgctggcctggatgcagagcaaattaaattctcatacattgctagtgagaatgcaaaatggtatagaaactttggaaaaaggtttgacagtttcttataaagttaaaaagtagagtgaccatatgacccagcaatcctacttctaagtatctacccatgagaaatgaaaacatatgtctatataaagacctatatgaaaatgtttatagcaactctctatagcagaaacccagaaacagttcagatatcagtcaactggtgaatgggtaaacaaattgtgtccataaaatgacatactggaaaaaaatgaaatactaaaaagcaataaaatgaaacaaattaccaatagatgcaataacacaaaatgtattataagtgaaacttataattcaactcaaaactcaaaagtattgtaagtgaaagaagccattcacaaaaggctatatctttaatgtattattcattctggcaaggcaaaaccatagggacaatcagcactggacgtggggtttggggaatgactataaaaagcaagagaaaactttttgggtggtataaatatcctatattatatagtacatatatattataattacacattacctatatatctagattatggtggtggttatccaattgtacacatttgtgaaaatgcattcaactatacctctagaaagagtaactcttatgtaaattatacctcaaaaatctaactttgaaaaatattagctgatgttatcaaattatttcaattccagatttgcttaactttacaactttgcccaaagataaatgcaaaacaaaaacctcaggcatagttatgtatgataaaacaccatttttaccctttcaaagagctccaccattatttcccagaaaacaggcatacagttatccaaggtccacattagctttaatgatacaacattcagtgaattcccagttgtgaaaagcctttaggttggcagggcgctgtggctcatgcctgtaatcctagcactttaggaggccgaggcaggcagattgcctgagctcaggagtttgagatcagcctcggcaatatggtgaaaccctgtctctactaaaaatacaaaaaattagcagggtgtggtggtgcactcatgtaatcccagctactcgggaggctgaggcaggagaattgcttgagcccgggaggcagaagttgcagtgagctgagatcgcgccactgcactccagccggggtgacagagattctgtctccaaaaataaaataataagagaagcctttaggtgataaaataatagtcaaagtattcttttaagtattattattttatttttttttaattctttgtaataaaaagttccataaagtaaaatattgtccttttttgttttatttttatttgtatcaattcaaggggacaggtgcagtttgttacctggacctgatttttaaataaatcaaactcagtttagttatttcatggtgatcctgggagactgtttgtcagtcatcatcgaatagcgaatgagtatcctttgtatgctcattctaggctgtaagtaccatgtcagctgatggagacacaaaaatccaataaagtaggtatagctgggggaggttccaagatggccaaataggaacagctccagtctactgctcccagcatgagtgatgcagaagacgggtgatttctgcatttccaactgagctttgaaaagagtagtggatctcccagcatgaagtttgagatctgagaatggacacactgcttcctcaagcgggtccctgacccccgagtagcctaactgggaggcacctcccagtaggggccaactgacacctcatacagccagatgcccctctgagatgaagcttccagaggaaggatcaggtagctacatttgccgttctgcaatatttgcggttcggcagcctctgctggtgatacccaggcaaacagggtctggagtggacctccagcaaactcgaacagacccacagctgagggtcctgactgttagaaggaaaactaacaaacagaaagggcatccacaccaaaaccccatatgtacgtcaccatcatcaaagaccaaaggtagataaaaccacaaagatggggagaaaccagagcagaaaagctgaaagttctaaaaatcagagctcctcttctcctccaaaggaatgcagctcctcaccagcaacggaacaaagctggacagagaatgactttgacaagctgagagaagaaggcttcagacgatgggtaataaacttttccgagctaaaggaggatgttcaaacccatcgcaaagaagctaaaaaccttgaaaaaagattagacaaatggctaactagaataaccagcatagagaagaccttaaatgacctgatggagctgaaaaccatggcatgagaactacatgatgcattcacaagtttcagtagccaattccatcaactggaagaaagggtatcagtgattgaagatgaaatgaatgaaatgaatgaaatgaagcaagaagagaagtttagagaaaaaagagtaaaaataaatgaacaaagcctccaagaaatatgggactatgtgaaaagaccaaatctacatctgattggtgtacctgaaagtgatgggagaatggaaccaagttggaaaacactctgcaggatattatccaggagaaattccccaacctagcaaggcaggccaacattcaaattccagaaatacagagaatgccacgaagatactcctcaagaagagcaactccaagacacataattgtcagattcaccaaagttgaaatgaaggaaaaaatgttaagggcagccagagagaaaggtcgggttacccacaaagggaagcccatcagacttacagctgatctctcagcagaaactctataagccagaagagagtgggggccaatattcaacattcttaaaggaaagaattttcaactcagaatttcatacccagccaaactaagcttcacaggtgaaggagaaataaaatcctttacagacaagcaaatgctgagattttgtcaccaccaggcctgccttacaagagctcctgaaggaagcactaaacatggaaaggaacaaccagtaccagctactgcaaaaacatgccaaattgtaaagaccatcaaggctaggaagaaactgcatcaactaatgggcaaaataaccagctaacatcataaagacaggatcaaattcccacataacaatattaaccttatatgtaaatgggctaaatgttccaattaaaaaacacagactagcaaattggataaagagtcaagacccatcagtgcgctgtattcaggagacccatctcacatgcagagagacacataggctcaaaataaagggatggaggaagatctaccaagcaaatagaaaacaaaaaaaagcaggggttgcaatcctagtctctgataaaacagactttaaaccaacaaagatcagaagagacaaagaaggccattacaaaatggtaaagggatcaattcaacaagaagagctaactatcctaaatatatatgcacccaatacaggagcacccagattcataaagcaagtccttagagacctactaagagacttagacttctacacaataataatgggagactttaacaccccactgtcaacattagacagatcaacgagacagaaaattaacaaggatatccaggaattgaactcagctctgcaacaagcggacctaatagacatctacagaactctccaccccaaatcaacagaacatacattcttctcagcaccacatcacagttattccaaaactgaccacatagttggaagtaaagcactcctcagcaaatgtaatagaacagaaattataacaaattttctctcagaccacagtgcaaagtagaagttgggattaagaaactcattcaaaaccactcaactacatggaaactgaacaacctgctcctgaatgactactgggtacataatgcgatgaaggcagaaataaagatgttctttgaaaccaatgagaacaaagacacaacatactagaatctctgtgacacatttaaagcagtgtgtagagggaaatttatagcactaagtgcccacaagagaaagcaggaaagatctaaaattgacaccctaacatcacaattaaacgaactagaaaagcaagagcaaatacattcaaaagctagcagaaggcaagaaataactaagatcagagcagaactgaaggagatagagacacaaaaaaaccttcaaaaaaatcaatgagtccaggagctggttttttgaaaagatcaacaaaattgatagaccactagcaagactaataaagaagaaatgagagaagaatcaaatagatgcaataaaaaatgataaaggggataccaccaccaatcccccagagatacaaactaccatcagagaataacacctctacacaaataaactagaaaatctagaagaaatggataaattcctggacacatgcaccctcccaagactaaatcaggaagaagttgaatccctgaatagaccaataacaggttctgaaattaaggcaataattaagagcctaccaaccaaaaaaagtccaggaccagacagattcacagctgaattctaccagaggtacaaagaggagttggtaacattccttctgaaactattccaatcaatagaaaaagagggaatcctccctaactcatttgatgaggccagcatcatcctgataccaatgcctggcggagacacaacaaaaaaaagagaattttagaccaacatccatgatgaacatcgatgcaaaaatccttaataaaatactggcaaaccaaatccagcagcacatcaaaaagcttgtccaccctaatcaagtgggcttcatccctgggatgcaaggctgcttcaacatatgcaaatcaataaacgtaatccatcatataaacagaaccaaagacaaaaaccacatgattatctcaatagatgcagaaaaggcctttgacaaaattcaacaggacttcatgctaaaaactctcaataaattcggtattgatgggatgtatctcaaaatagtaagagctatttatgacaaacccacagccaatatcatactgaatgggcaaaaactggaagcattccctttgaacactggcacaagacagggatgccttctctcaccgctcctattcaacatagtgttgaaagttctggccagggcaatcaggcaggagaaagaaacaaagggtattcaattaggaaaagaggaagtcaaattgtccctgtttgcagatgacatgattatatatttagaaaaccccatcatctcagcccaaaatctccttaagctgataaacaacttcagcaaagtctcaagatacaaaaccaatgtgcaaaaatcacaagcattcctatacaccaataacagacaaacagccaaatcatgagtgaacacccattcacaattacttcaaagagaataaaataccaaggaatccaacttacaagggatgtgaaggaccttttcagggagaattacaaaccactgctcaacaaaataaaagaggacacaaagcttatagataggaagaatcaatatcatgaaaatggccatactgcccaaggtaatttatagattcaatgccatccccatcaatctaccaatgactttcttcacagaattggaaaaactactttaaagttcatatggaaccaaaaaagagcccgcattgccaagacaatcctaagcaaaaagaacaaagctggaggcatcatgctacctgacttcaaactatactacaaggctacagtaaccaaaatagcatggtactggtacaagaacagagatataggccaatggaacagaatagagccctcagaaataataccacatgtctacaaccatctgatctttgacaaacctgacaaaaacaagaaatggggaaaggattccctatttaataaatggtgctgggaaaactggctagccatatgtagaaagctgaaactggatcccttccttacactttatacaaaaattaattcaagacggattaaagacttacatgttagtcctaaaaccataaaaaccctagaagaaaacctaagcaataccattcaggacataggcatgggcaaggacttcatgtctgaaacaccaaaagcaatggcaacaagagccaaaattgacaaatgggatctaattaaactaaagagcttctgcacagcaaaagaaactaccatcagagtgaacaggcaacctacagaatgggagaaaatttttgctatctatccatctgacaaagggctaatatccagaatctacaaagaacttaaacaaatttacaagaaaaaatcaaacaaccccatcaaaaagtgggtgaagtatatgaacagacacttctcaaaagaagacatttatgcagccaacagacacgtgaaaaaatgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaagtagttcaaccattgtggaagacagtgtggcaattcctcaaaggtctagaactagaaataccatttgacccagccatcccattactggatatatatccaaaggattataaatcatgctgctataaagacacattcacatgtatgtttactgcagcactattcaggatagcaaagacttggaaccaacccaaatgtccaccaatgatagactggattaagaaaatgtggcacatacacaccatggaatactatgcagccataaaaaaggatgagttcatcatgtcctttgtagggacatggatgaaactggaagccatcattctgagcaaactgttgcaaggacagaaaaccaaacaccgcatgttctcactcataggtgggaattgaacaatgagaacacttggacacaggatgggggaacatcacacactggggcctgttgtggggtgaggggagtgggagggatagcattaggagatatacctaatgtaaatgacgagttaatgggtgcagcacaccaacatggcacatgtatacatatgtaacaaacctgcacattgtgcacatgtaccctagaacttaaagtgtaataaaaaaattaaaaaagtagatagtcccaaccgctgtattctttttgaatccttttgccactgtttcatatcacagtttttttttttttctgagccctagattatcagtctgttctttttttttttttttttttttaatgtagtccataggaatctgctgcctcacggtcagtatcgtgccccttaccccaattctaatatgacaggtttttgtctaagacagcatttcctagaatgtgttgtaatgtacagcagcttcatgtgataattctcaaagactcccactgtcaaatgttagcatattcaaggctctgccaggacctgtaatacatattctttctttattctgtttaacttagcatttctgaaacctatcttactactgaactcttgacatttattaacaaacaaatacaaacgaaaataccagggttccaagtaaaattcttatataaagcaaagggctttaaacatcagagttttttagaatggttattcactcatgcactcaacaaacacttattacatagtatgtgccagcataggggatacagtaataaacaaaacagacaagttccctgttcatgtaaaccttggacttatggggcaaaaagacaataaacaagcagacaaaaaaaaattacaaacactctcaatgaaggaaaagagggtaacatcgtacattgatgggggactataaaattaagtagtaaggaaaagctgcacttgagaaggtggtatttgggaagagactcgaatgcctagaataagccaaccagatttggggcacagcactctcaacaaaggctgagtaacacagccagtctgagggaggacaggtctacggaatgagagccgaggcaagtcaaggcaacatcacgtgggtcctgagggtatgagccttccagagggtgtgaggataccattagaaggttctgagcagggaatgataggatgtgatttacattttgtaaagctgtctctgtagaggatagtttgtaaaagtgcttgaggcaaaactgacaagacttgaagacttgcacaacagaactgaagaaatgagaagaatcaactcctagacttctgggatgatcaatgtctaggatggacattggtgccatttgcaagatggagaagaccgggggaggtacggatttaaaggagggtatgtaaggagaaagaagaatcctatgagacaagaccagaacatgtaaatacatgaagttttggatttcttactcttcaaagacattttacctcctgtccccgaagttcttcacagagttcaggataagaaaagctgccagacagttgagttttgaataagtagtaactttcaaacacttgaaagacattatattagaatagactacatccatcaaaatacttaaaaatgtttttagaatagtccaataatttggaatatgaaagcctaagaaacttccttatccaaggccgcataatataaccaaaattagaatttagtactcctagttggcaatatttttatgaaattactgttttactaagacattttagaaatgaagactttactgaaggcaataataagtgcaattaaaagtggtacaataataagacttctttttcatttgcaacaggttagtagtgtatgagaattatgagatgtaaaatagtgtagagcataggcttctctagttggcttcatgtgagttcgaatcttggccctgcctctcttaccagcaatgaaatatgcagcattttacttaaggatactgggttgtatggagagaatcagagttaaggttggtgatccagcagtgtcatgtgtcaggagctaataaattgtattgtgaccagaaacactgaaacttgttataaggaaagcaatctaattaaaacagctgcattaaaatttctacaatatcttcctaacagcttatgctatcaacagtttgtaaactatcagaatcacggatactggctgagaatgcttttggagatttcaaattggcataattttctcagaatgcactgatctgacaaatgtacagacaggcagacaggaatactaccactcttcatgaataactgtctgcctctcctggatttcttccatgttgtgtaagtctattacactttgggtgaatgtagctttagtacattgagttaatatcattcttgcaaagaagctctttataaattccttaaacttaatttgactctggacacaaacaaatgagaacaaaatacagctcaaggattaagatccttaaccaaatatgtaaaaaacacgaaaagccttacaaacagtgatcaacagttaaacatgcgctatcaccttcccctaacagctagggaagcatgtatatgaatggaacatatgaacttccatttggtgtactaagaaaacacatcacgcagatggcttttatagcttcccaaataaggttctaataattcacaaaagtgttgttccctaaaacccataataaacaataataaaacctaatgtttattgagggtctactatgtgtcaaggagagtcctatgtactctcctggaattacttcatttatttctaataataacctttaatgagcactgtcactcccgtttcacagatgagccttaaggtcttagctatcaactttgcagacaacacccaagtaaaatcctgccccctctttttttttttttttttaaccagaaatccagtcctgacaactgaaagcttatagggcatttccgcttagatacatagccttacctaaattatatgtctaaaaacttaactgtcatattgtccagccctcccccaatacccaactggcttctcttcatgattttccaactataattctgtccattattcaggtttagaatttcatgctttcttctggctgtggtcctgccaagtcttatgtatgctgtcacccttctctgtgcaatctttctcctactcattcctctcttttcatcactatcctatttcaggcccttatcactcttacacctaattccctaacggtttcttcttgctttcagtacaatttccccttgatataatctatcctgcacactaccaccagatataaccttctaaagtcaccttattttagtttcttcataatattttccttatagtcaaatgtaagggttcttcatgaattataggacaatgtgcaaatggcttgacctggcatttaagacagtctgcagtatggcctcaatctacatttctcacacctgccactggtcctataatcacatcctctgttccagagaggctcactcctccagaatgcccactaccctcctctccagcaaacatacaataaagcgaatccacatgaataccccatcctaccctgccttatccagcccctggaataccacctcttccctattagatgcctatataaatcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtggttgtttgcagccaaaacgtacaaaatgaaaacctcctaacgatttattttccacatgaaattagtaccagatctagagaaaaatggacaaggatcaaatacaaataataaagtcatcaccaaactaaaaatttcattcaaaagtgatgatgttggccgggtgtggtgactcacacctgtaatcccagcactttggaaagctgaggtgggcagatcacttgaggccaggagtttgagaccagcctggccaacatggtgaaaccccatctctactaaaaacacaaaaaacagctgggcgtggtcatgcacctgttatacccactactcaggaggctgaggcaggagaatcacttgaatccaggaggtggaggtggcagtgagccgagattgtgctactgcactccagcttgggcaacagagcaagactccgtctcagaaaattaaaaaaaaaaaagtgatgatgtcagtaaagacccaaatcagggtcatatgtttaacaccagaaagtttgtatttgctacaagacagaaaccttgacaaaataacttttctgtgctttgttacttcatctgaatgaagaaggtaaaccagttgatctcacaaatctctttctaagggcttctggaatttttttttttttttaaacaataaaaggaaagagacttctcttaagcagaacaaagtccgactcctctgtaaagtggctgacagcaagtggaaaatggaagaagaacaattacctgcaaaatgactcattcccttgtaacaactacactactagggaattccttctcttaccggctgtggctagcgtcagactcatgacaaagacctcatcctggggctagaactaggtttagggttttctcattcattcctctgtttctcagctgcattttcatttttaatctgtgcaatgattacagaggcctatgtttggttttcatttctagtttccccaggaagagacaactactatcttgatattgattaacacttgaaacttctgttaatcacaatttcagtatttcagggaatcagagaaatcatttggaagagccttgaaggtcatccagggtgagagaaaagcaaagcacaagcaacagaccaatgtttagacacagtgaagtgaagacctacaggagaccctctcaacttcaataagagtcttttttatggctgtcttcatattctttcaaagaaatcataataaaggagttagtgagagtgtaaataaaaaataggctatcatagagtgctgggtaactgagctaaaactaaagtaaacaaactcagtgggccatcacatatgcaagctggtaaggtctcataaatcaccatgactgggtattgggatttcaaaggcacactctgtaagctttctcccagccctgttgattcaagctccaattgcactgggttacttatatggcagcatataaagttgaccttttatgtttaaaaatagttccattcctcatccctcctaaggataggccacagtacctatcatatgtccccaccacactacataatttatgtaagttttcacttaattttcaacacaatcctttgaggtagattatgttagtcctgatttacagggaaaacagaggctcagggaggccaaatttatttatttatccaaggttgcaactctactgtagggcagatttatatccagaagaggaattgcaaagctcctcagaatttaggagatttaaaatggaatcaagataaaggttcacatttttcatcttctattccattttactcttccagcatctaataataacctatgatatattagaacaaatcagcccatacttattttgacagtctcttttcaccccatttcagtttgtaccttgctgtctcagagcccatcaaccacctttcctcactcccaggcagccggtccttcaggggatggcttggcagttggcccaccatcctctgctaccagggcatgactcatggaggcaacaggtgaagctgacgccaactattagtgctaaaaaagactcaagcctcatgaaatataccatccataaatcgctctccagtcagctctacccctccctccatttctacagctgactgtctgttcttccttaaacatttacatccgccactgacctgtctgggatttcttttttacttcaaggttctcctaaaggttcagtccaaccaggtttcaccaaatgaaccctgcggtggaaaggggcagcaacgggcattggtcagtttgcctccagccaaggaaagtctgactcccctccttctcccactcttctctttctctgcctcacactgcctaatacgtctttcctctttctctctttctttccttatatcttcattttccaccctattcagaagtgaaacttcccttgccactttgcccccactaagaaaacagacctccaacacaacctcttaacaggctaattttaaaatcatgaacctgcttacaccttccgtgagtttatcctatatcttctctatctgctgtctgcttcccactaaggttttatccctccatcccacctccaaatcctttacagctcagattctcagatctgctttagtcacttggtctcctcatcccactgaccctattatccttctgtgcacatgttagagggcacatgctcctcctaggaactagggccaggtcagttatgctcccatcctgacatgacctagagaacaaaaaaggcaaaacgaggtactgtaggattcctctctaggaattatactttgctgaaattgctcttgctattttggaatctagtgctcactaaatacatttttaaaatattatttggatatattttgaaaatacaaccagaggtcgggcacagtggcttacgcctgtaatcccaacactttggcgggccaaggtgggcagattacgaggtcaggagttcgagaccagcctggccaacatagtgaaaccctgtctctactaaaaatacaaaaaattagccaggcgtggtggcaggcgcctgtaatcccagctgcttgggaagctgaggcaggagaattgcttgaacctgggaggagaaggttgcagtgagcctagatcacgccattgcactccagtccaggcaacagtgcaagactctaactcaaggaaaaaaaaaaaagagagagagagagaaaatacaaccagagaataaacacttgttcttctatctctccatcttccccaccaatacaacatccagaaaatagtcatctttacacttatttagaagcacatagatcttataaaagtttaactgagcattaggttttcatctttaaaaatattctgaggctgggtgcactggctcatgcactttgggaggccaaggcaggaggatcacttgagcccaggagtttgagaccagcctgggtaacatagtgagaccctgtctctacaaaaaaaaaaaaaaaaagttaaattaaattaaaaaacagaaaagccggtctggtggcacatgcctgtggctccatccactcaggaggctgaggtgggaggatggcttgagccagggagatcaaggctgcagtaagccatgatggcgccactgcactccagcctggttgacaaggtgagaacttgtctccaaaaacaaaacaaaacaaaaaacgttttgacatgtagaatactgtttctgggactaaattagagatttaaggtttgaggtatgagaaaatacctggaatcatgccttacattagaaggtaaggtaaatactggtgtttcccaatgagttgtagtcagattgttcatatgtatcaaacagacaatatactgaaatatttaaaaataaggctaaatagcaacaaataatttttcccatgaattctactttttttttttttttttttgagatggagtctcactcagtcgcccagactggagtgcagtggcgccatctccattcactgcaacctctacctcctgggttcaagtgattctcctgctcagcctcccgagtagctgagataacagacatgcaccaccacacctggctaatttttgtatttttagtacaggccaggttttgccatgttggccaggctggtctcaaacttctggcctcatgtgatcgacctcccaaagtgctgggattacaggtgtgagccaccatgcccagctgaattctacttttttttttttttttttgagacagagtcttgctctgtcacccaggctggagtgcagtggcacgatcttggctcactgcaacctctgcctcctgggttcaagtgattctcctgctcagcctcccgagtagctgagattacagacatgcaccatcacacctggctaatttttgtatttttaggagagacgggatttcaccatgttggccagctagtctctaactcctgaccgcgtgatctgctctcctctgcctcccaaagtgctgggattacaggcttgaggcaccacgcccggctgctgaaattctacttttgaaagaacaaattccccttctgtagggactgatgattcagtctgtaatgatgcattctcttcatcttctttttttgtcttttcttctatatatcctttaggcattctactgtattaacactagatagaaaaattaagatttaggcccaaacattatcttctggcataaagtaaactaatcgtttcctgatgtacaataaataaacagacatatttctagtagaagattccttatgatttatcaaaacccaattatcacttacccttatggagatcttagatcttagaaaccatactgacaatataagattaagaaaacaacagaaaatcaaaatatataccaaggataatgttaataggtttcatccttatcacagcatactgttgaaacttacttgaaatatttttttaaaaaagatacaagaggacaagtgtttagtttttaacaagggaggggactagtcaacaaatattgattacctaatttatgaacagctctggccaaagtggtcaaaaaaaaaaaattaggactttagttttcctaaacctatcttaatttttaacaggattatagctttgttcaatctttacagtctttagcctcttttgtgaaatgggtttccttgtaaataataaaatgacacctatatatatttaaagcactcatgaaataattttatctctttattaaaaactgtgataacccttccaattttgaaatttattgtcttcctaaattcttgctacaaagcctatcattaatattgcagttcattttttccctaaagattgaaaaaaacactaacaaatataaagtctttatggtcaaagaatgtactccttttataaaacttggagttgatgtaaaggcacagacaacacaagttaccttaataataaatgcacttttctttgtaattttgggtaattcagtgtgatttgtaattcttttaaaagacacacaatcacttgtatttttgcatggttctttttttcctaatttcccactatagtgaaatatctgtttttccttctctattgggtttggattggaatgatcaggtagaattaaatgtaaaataacaaaaggaaaatactttatagatcttctcaaaatactttgaagggtataatctctttaagatggctttattcatatttaagccaaaaacaaaaagcaaccaaaacactactgtttatacaaaaagcagcttcaaaatcagccagttattttctgaaatggagatggcagacattagcctgcacttactccaatatggcagccgcatctttgcctctttgctatggacacatccccagcaggcctgtactttctactctccagacctgtttatgacaggccaaggtgtttcctattatggtgcctatggctgcacagtgcactgcttgtcagtaataaaagccagaggctgtccctatagggattacagtgcagcagaccagagatgctgatgggaatgcaagcatgccctaggcaaacattgcagaatactctctgacaggcaaaagccaacaaacacatcctttcttcccagactagcagggaaagtattcagttatgtcattttcacttggaacaaactaataagaagaatgttattgctaaaataggtagagatgagaaagagcagtttatgaccatgaatatggcctctatggtttttgcctgtgcactacaaacttttaatttaaacgagatgagattgatctagcatatactatgataaaatttctgagacatgagtatctaaaagcagaactgagattaagtgagaaatgctcaggattcctgtcactgaaagaaaaagaaaaaaacctttcttgaaaggcacaaagtagaatgctcagactctccatctaccaatacaaggtaaaaaacagcatttgcattaaccaacatcatgcattcttgtactaatttatgtgactaactacaaaatgttatattgacactcactgtgtagggtgtcaggatggccaagtggtctaaggcaccagacactcactgggttgggctaaaaacaccgtagaagacctcatcagaacaataaaacagagacacaaaatattgtactaagagttaagagaattacaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttggctgtaggtatctcaggttttccttgtttttgataaccttgacagttttgaggagtactggtcaaatactggtcaagtttcgagggtagaatatccctcaactgagatctgtctggtatttgcctcatgattacactggggttatatgttttcagtagggaaaccacagattaaaagtgccattttcatcagatcatatcgagggtacatgttatcacttatcactgtcaatgttgaccttgataacctggctgaagtagtgataggtttctccactacagtttcttttttttccctttctacactgtactgtttagaaggaagtcaatatgcacagctcacacttacggtgtagggggttatgttctccctccttgagagtagagtatctatagaagttattgggaattccgcacaggaggagatttgtctattttcccccacttaggtatttatttaataaattgtatcaatatgggtttatggatatttattttaccctttgggatataatccaatactatattattttcttgctcaaattgttctagctttggccattgggagctctttcagtttgctcttgcaactcttcagtatattcccacgggtgtagggttccatttgtttgagcaggtccttactttttggcactacaagatgctccaggctcatcttacatatttccttcctgagtccctagaaatcagctattttttttcaaagagtcttggttccttttaccagagaatggtattagaaaccaaaatgagggtgctaagtgtgctcattgctactggggtatggtagcttctagaccctctcggctgatagagcaaggaaatatttgtgtgtatactagatggtaagatgttgagaggtagaatggagagttaccttcttaatatacttttcttaatattaaatattaataagatattgtgtgcctgggttactttcagtcttatgcagaggaagaacgtatgtacattcatttatgaaaaacactggctagactattcttctgcactgcattatgcatttctgctagaaaaagctcagagattttcagatattctgacaaaaatctcaggcttgcttgatgagctatactgtaaaattacagaaggaaacaaagggcaaactccttgaaggatgaaaataaaggaataaaacatataaaacaccaccaaaaaaagtgattaatgggggagaagagtaaataaaacattataatagtcctctttggttagtatcaatattattaggtcactttatcaaaaggatagaaatcaggatggcagacacccttctctaaccctcaccccccaaaataataaaataaaaactaatgttattccttcacatatggaaatgaatgagttctactgagtatctagtatgattcctgactcagtcgagacaattcccatcttttaattcattaaatcaccacagcaactatttaacagatgagaaaactgaagcacagaaggcaacgtggcccaatttacgtttggtaaaaggcagagaatgaatccaattcaggcaggctgtctatagtagggtgctctaaatccacggaccattctgcctaaggaatgaatattttatgaattggaatatttctgctgaacgaatttgccattttctcctctagtggagaaatccaactgagggtaaagaaggaaaaatgttgattgtttaaaacaataaattagtctctaaattgttcttgcagctgatttagactagtgtgtccaaaagtatgcccagtgttagtaaatggtaggcaaaatgctttaaggtggtgcaagatgaatgttttctcattttgttattcattaattttagaaaaaatacagaaaaaatataacttgaacatcaaacctatgatttcatgtataccattacttaagatgaggcacttgggtgagtatttagatttaacaataagttgctcttagcatttctatactttgacaataaattatccaaaaaagaaattaagaaaataatcccatttgcaatagcatcaaaaaaatacttaggagcagccaggcgtggtggctcactcctgtaatcccagcactttgggaggccgaggcgggcagatcatgaggtcaggagatcgagaccatcctggctaacacagtgaaaccccatctctacttaaaaatacaaaaaaaaaaaaaggcaggtgtggtggcaggcgcctgtagtcccagctaattgggaggctgaggcaggagaacggcgtgaacctgggaggtggagcttgcagtaagccgagatcgcgccactgcactctagcctgggcaacagagcgagactccatcacaaaaaaaaaaaaaaaaaaaaacttaggagcaaatctaaccaacaaggtgaaagatctatacactggaaactacaagacattgatttaaacaactgaagaagacagaaataaatgaaaagatatcccatgttcatgcactgaaagaattagtaatgttaaaatgtccacactatccaaagccatctatagattcaatgcagttcctctattgattcaatgcaattcctttcaaaattccaatgtctttttttttcacagaaatagagaaaaaaatcttaaaatttatatgaaccaaaaaaagacctaatagccaaagcaatcttgaacaaaaagaacaaagctgcaggcatcatattccctcatttcaaaatatattataaagctactgtaatcaaaacagcatgttattgacataaaaacaaacatcaaccaatggaacaggatagaaagcccagaagtaaatccaagtatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatggtctgggcaatgatttcttggataggactccaaaagcacaggcaactaaaacaaaaatagacaaataggactacattaaactaaaaagtacctgcacaagcaaccaaataatagagtgaaaagacaacccatggatcaggagaaaatatctgcaaaccatacatctgataagaggctaatattcaaaatatataaaaaattcaaacaaccaaatagtaagaaaacaaatcgattaaaattagacaaaggatctgaatagacacactttcctcaaaaaagaaatatgaatggccaacagagatacaaaaaaaaaaaaaaaaaaaaaaaacaatgttccccagccctgcacagtggctcatgcctgtaatcccagtgctttgggaggctgaggcaggagatcacttgaggccaggaattctagacaagcctgggcaaaatagcaagaccctctctatacgaaaaaataaaaagccaggtatggtggcacacacctgtagtcctggctacttgggaggctgaggcaggatcattgagcccgagaatttgaggttacagtgagacatgatcacgccactgcactccagcctgaacaaaagagcaagaccctgtctcaaaaacaaacgaaaactcaacaatatctctaattctcagggaaatgcaattaaaaccacaatgagctatcacctcatgcctgttagaatgactattttccttttttttctcttcaacttttaagttcaggggtacatgtgcaggatgtgcaggatgtgcaggtttgttacataggtaaacatgtgccatgtttgcttcacgtatcatcccatcacctaggcactaagcccagcatccactagccattcttcctgatgctctccctgcacccatcccacccgccaacagaccccagtatgtgttgctctccaccatgtacaatggctatgttcaaacagatgaatgataacaagtgttggcaaggatgtggagaaaagggagcccttctacactgttggtgggaatgtaaattagaaccaccattattgaaaatagtatgaaggttcctcaaaaatctaaaaatagaactaccataaaatccaacaatcctacttctaggtatacacccaaaggaactgaaattggtacatcaaaaagatatttgcactcccatattcatttcagctttatttacaacagccaagatatggaagcaatctaagtgttcatcaagtgtgcataaagaaaatgtgatatatatatatatatatatatatatatattatatatatatatatatatatatagattatacaggccgggcgcagtggctcagatctgtaatcccagcactttgggaggccgaggcgggccgatcacaaggtcaggagatcgagaccatcctggctaacatagtaaaaccccatctctacttaaaaatacaaaaaattagtggggcgtggtagcgggcgcctgtagtcccagctactcaggaggctgaggcaggagaatggcatgaacctgggaggcggagcttgcagtgagccgagatcacaccactgcactccagcctgggctacaaagcgagactccacctcaaaaaaaaaaaaaaaaaaaaaaaaaaaagattacacagccttataaaagaaagaaattctgtcattcacaacatcatggaatggaactacaggacattatgctaagtgagataagtcaggcacagaaagacaaatattgtctttaataaatgatctcactttatggggaatctagaaaagtcgatctcagaaacagagagtagaaaggtgggttaccagaggctgtagaggaggagggagagagaaatggaagatgtcgatcaaacagtacaaaatttcagttagattggaggaataagttttagtgatctattgcactgcatggagaccccagtaattaataacgtattatatgttttacaatttctaaaatagatttttgacattctcatcacaaaaagataaattggtgaggtaatatagatatgttaattagctttactaaatctttctatgatgtacacattttaaaaatcacattatacccaagaaatagatacaattaatatttgtcaattaagaataattgacaaataaattttaaagattaataaaaaatacattaagttaaaacattcaacatataatagcagatatgaatgtacacagaaatgacaaaatcccagcactgtgggaggccgaggagggaggatcacgaggtcaagagatcgagaccatcctggccaacatggtgaaaccccatctctactcaaaatacaaaaattagctgggcatggtggcatgcgcctgtagtccagctactcgggaggctgaggcaggagaattgcttgaacttgggaggcggaggttgcagtgagctgagatcgtatcactgtactccagcctggcgacagagcgagactctgtctcaaaaatgacaaagtttgagcaacattaatttggactgtaaattcttaaagaatagaaaagtcatgtttttcttctaagaaatattatgtttttacattgcaagaaatatgtgacacagagtttttcttaatctctcttttttagtatattctagacaggcaagcacatgcaatttattgagcacccagtgtgtgctaatgcaccaaacggagctttacatacattatagctaatggtctcaataactttttcattttattttcccctttcattatcgccacttataaatgaaaaaactgagctccagagcggtaaggcctattgcccaaaatattagataggaaacaacagagctggaatttgaaaccaagtttgcctaatgaaaaacatttatgttcttttcactgtacaaagctgctgtaagtatcactggtgcctactccaggccagggagtaaatatcattcatccttatcacatacaaagtataacaaaacaaaaacaagaagctctgaatactaaataataataataaatactttataaaagataaactattctctaagagtaaaagataataaacctattgtcattgtagttggtcactgaacttaactaatttcctaatggacgcagcagaattgtttgttgtttaagcaaatatcaaggcataccccccaatccctgttacagggaataaaaaaagtcttcttcaaatgcctttcaaaactaatgtgaatattaaaataaagtgctactgatctctctacattctagaaagatctcagactaacagtgtcaattaaactattacaacaaatagccatgtaaaaactgctcccctactagagctacgctatcacaaaattaaccccagcaatctacagttctagaaaaagagttggtccctcctgctgaaaaagagaaaaccaaaccctacatattttgtgaatccactgaaaataatgacataaacagcactgcacatccatcatgtatttatatcttaagtgatagctacagtctatgtaactatcgcagaaatcttcttaaactgaacaaaagcattatctatcatcctttctctctagaaaaataccagtttgtttaatctacccataacattagaaaaaatacttcttttatcatgggcaatccttatgtttcggaatttttttcgaaaacgtagacagttcataatgctctcagacagaagttaccactactaccccaaatattaagtcaaaatgtaactgaaaaaaagaaatttatctagtaatgattaatttattgaataattaaaaattaggagtttttgataattaaatgttgggaataattaaactttcactaaatactggcacaggaactgaacggatgacaacagagacaagttaagatttgttttaatcctaagttttatgctaaggtaacatcaagggctctacttttcagtgaaagaaaaatttcctttaaaattgtttccctcttccattattacttaaaagcaaagaaagtattttttctaacagtgattataggattctcaatctttcatattaactttaaggtactacatgtaagctacataaatctttcccaaatctacctttattgagtagatgaaaaagcagatatcgaactcaaaacatctaaatgttgattttctataattatagaagatattttcttttgaaatttaaagtttgtatttaggcatattaacacttttttaatctaagatttaatatgttaatgtagaaaacaactgaggctgttttctctctataaaactaacatgccttttccaattaacttagtttccttcttagcaaaagtttaacatttatatctgttgagttacactgtagttgcataatgtggaaatatcttaagatttagccacttctatgaagatcctatatttgttataacacccctcttgcccagaagaaaatacatcaacaaaaagtcctactatatgttctgcattgactattacaaagcagtagggggagcagccagagaaagctctgagacaaagcacccagcaaagcaatttaatttataggcaacagaaacatgctagagaggtttgccaaaagccaaatacacaaaataaattccataaagaagtcatgaccacatttgtaaagctggcctaagtatatttggaatgaagtatagaaaaatctgaagtctcttagaaagggtctggattctaacttcaagacagactttcagcttgaaacacagtcatttccagccatgccaaacctcaaactgcccccaaaattagagcagaaacaaaatacatttttatagtgatatgtcttgggaataactcaaaatgatttcgttttctcctttgaacctcactgaacttacagggaaggcctggtgaaatgtgcattattaggtcacaagaggataacgttacagggttccatagcataatccttgaaagccctgaggcccaggccgctgtcctgctctcctctctactgactcccatcctcaatatactttccatgagagaaaggtaaccaaaaacatggtgaaactattctgcttaaaaggtgttttactgaaaaggcacattgaccactaacccttattacatttcacatgttctaaaaattagtaaggtctgcattttcagttttagagtaaaacaggaaaagtacttagttagctcttctgtctggcattctgtaactggaatttaagaaaagcctaaacttctaattagaacttcagaatgttcatgtctgtattataccacaaaaactgtaaatataatttaagcatttttatgatacagaaatgtgcgctatagacagttatctaagaattataaaaatccatcaaacttgaagtgtctggtataaattacaaccgaatggtaaaaagacattttagccacgtaggcaaccaatgaagtttgacctaaaacccaaataatagcaataacaacagatacagtgcctactattgtcagatactatattagctagctcttttgtatatattctttggaactcttacactgacttttcaagatagttattatggtgcccattgtatgctaaggaaactgaagctaaaaaaaattgaagtcatttctctaatgtaactccattagcaagaaacaaaaccataattcaacttccaggtttgcctgcctccaaagctttgagacctcactaaaattaccctcaattgtagcaatgaggttccaaaggaaatctgtacaaatctcaggcagattaatgtgcttataagggtaaatgccatagatttaatcactcaaattaaatgccatctggaatctcttaccctacttggtacaagcatcctacatgtgttacagccaaccctagccttggccaagaattcaataattttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaaagcaatgtttctgactcattcattcatactcaagaaatatcaaataactgagtggagatgatgcaagctgtacacatttccagttcagactgaaggtgtggcaacactcacaggggccttccgatcagctgctccaactcagtttacagcttttgtggatgtggcttattcatgcccttgttatgaagaagaagggtaactttacaacctttagcaagagcttttttttctttctgtgctaacccttttttgtctataacagtcatgtaagcttagcactgatttagaaataaataagttaaagaagacacgaatggcttggacattaaaagtttaagcaacagcttaagctgagctaagtttaatgttaaaaattagtgtgacagcaataatttttcaattcagctctgtcgtgggctaggaaaaaatatcctaatttttcagccacaagacataaacattgctagaatgactacattttgaaaaaattatcttctcactttacctagatttcattttaaccaaacagaccaacctctcctattaaacctgtaaattaactcaaagtctaatctggggccttcataataaagattttttttttaaatccctgtcttatctggtgcctttaaaagaaaggaatcattttaggcaattattatgacctaaaaaatttttaaatcttaacgtatagattaattccttgacagctgaagtcatttacaatacattattaaatttcacattcagttttaaatccaaacatagatctcaacattaagaatatggattttagggaaagtaactagctgctcaaattcatttagctgaaaaactactgtcgaatcaccttgaaaatatacactaatgcttgcacattgctaagtggcttttgattctgctcttcattttcttacacagaatcaaccacacaatagaattaagaactcaggcccatggcaaagtgctcccatttagcagttaggacactggacatattcagcatatgtctactgctattgagaatcaaattatgaaaacaaactatattttataaaactaagaatttgttactcagatgagaataaaggtgcctaatgctacagcagggggtaaaagtcccagtaagagagcaataattggtcattctgatgaggagctgtgccaaatttagaaatgaggcacaaatgacaaaaaaattgatcatcagtgtggacatgggtaggtcagtgtgcatatgggtaggttagtatctgctggccgtgtctacagagccccttttatttatttgaagccaacttttcacttgacaatgctacctacaaaagcactgttaatagataagacaatcaagtggctgttatgccgtggcctttttgtaaaaactgcatgagaacaggtgggataaaaaccatagaaaggtagaaaaaaaaaagcatcactcatttaaagatatgtgcacatagatgaactgtaagataatataaccttcttgaccttgtaaataggtggccaaaaatacttaaatatcttgacgaggcaactattactaattgtctcacaacattaccagtccttactggctgaatccttcagccatctgcatacgacatgcacaggcaaatagccactaaaaacatacacaattccaattatctccttgcataactaaagacaaaaagaacaggaaatccaaaaaatacagcaaaactgaaaacactataccttgccttccgtgctattttaaggctgtcccaggctgaaggttacttctcagccctcaaaactccattaactgccaagaccagcaccttagcacatatggcacagatgcctagttgaagcctccttgtactaaatgacctcaaaaaactgggctttctttccaagattaatggaaacaaaagtaatgatcataaggaaccttctaactctgttaatgtttcctgcggatatgtatggccaactgaatatataaaggctcagttcttgcggggtaccctgacaactagatgaattagggtgaaggttccaagttcgatgaactcttctgagtttgagtgccctaggtggtgacattcaagtgatttcacagacatccaccaattcttattttcaaccgggaatcccaagaacacctttaaacatgcaatgcccatggaccctactgggtttctgctgcaagggctcagtgttacttaggaaccctgtgtcttgggagatacttaaatttagcacgtcaaattgcttttggaaaatgtttatctggcgtgactaggggaggcaaagcaaggaaacaggaacctccctctaaggagcagaatagccaacatgcagtaagcctaaaaaacctctcaatttatttcccggggctatgggtaccagtggctcgccggcatgggaatcagcagcctgggggcaccagtgacagcagaaccggggcttaccttgttggaggccatctcactgacggagtgcctggtctgtagggtctctagctggtccagacaccagtccagctcctccagggtctcgctggccagtttctggtaggcctcctctgcgaagagacagggaaagggggactcagttctcaagcgcttcacgggtccgctagcgagttcaaagggggccatcctgccataccccgccatgctcggatgcccggtgccggcacatgagggctgctccttcatattgcccagcccggcagtgcaacgggggcggaggctgtgctcgcggggcggccggcctcggggaggcacggtctctccagcttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttctttctcaactcctcgggcggcaggcgcagcgcggctccaacgccgcagctttccgggaacactccccctcacgcccctctcggccctcggcgctgcctggctcctcctcaacccccttacgaaaagattccgaattgcaaaagcctgtccctgtccgtgccacccgccgcgtccttcccctcgagctctgccccgggggccccgccacctcgcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaaggttatttaggaccctcaaggtttctgagggtttaagttttagggtttctgggggttcgtttctaaaggcttaggattcacctacttcaaggaggcagggttgtgggaattaagaccgcattctttttctacccagcccagtccctactaagtaccagacttctaaatgttggggcggacagaaacaagcaaacaaaatatacaatgttgtggggtcggaacgctttataattcacaaatttgacaataggctgcattttcatatgccgaattgcctaagagttctcttaaaggaacagcaatgtgaaagaaccacatggtaaggagaatttacgcatgtcctgcatactactcctttcccctgtgaattgcataagacctagatgatcttgggccaaggaagaaaatctggaagggtgtttctacccaccatgtgcagagtacactacaattttgagaaaacggaaagaccatattcaaaggcatacagaaaagcctgttctgtttacaaaggctgacccagggcaccagggacactgtccctaagcagatcagttgtgggagaacttttctacattagcatgcaataagcaaaccattcatagtgaggagaagtcaaactcccaagggtccatttgataaaactttgtcattgtcgagtggaaagaagatactgagaaacttacactaagtggtgggatcccttgtctttgtctttgaatctacaggtattggagaagaaattctgcccttgaaatttagactccataaattaacatggcacaacaaataaagttcatggactgaatttaggctcctgggatttttgagatagctttttatgtgaactttgtaaaagttagagtaacttttaaagtagttgttacatgtgccacgtggcttattgttatcaagaatacttgaactatttactgttcactttgagtactctaggttaaaatttgcctcttttttgttctacttcctccaccccgcagtctatgtaaatatatactttagatggacaaacaactgcctaaaccttgccaggtgaattaaagtttcagattgaagcttttttttcccccttaacaagcttaaagatattaataattttaaatggtaaatataaaatacctgctctgtatagcttccccaattctaagaatgtaaaaaatattacatgcttgttataaaaattgaagcattacacacaaatataggaagtccattgtaaccccacaccctaaagatcacaaacaatactttcgcctatggctctaacacaatcattttcattttactgaataacttccatatgcaagtatagcatcacctagttgccatggtagtgcatctactatatggtttggttttgatattttcctctctctctcattcccataatataggaatgtaggaaattttaagaggacattgacttgttttatgatcatttgagctgtccatagttagcctatccagtggattaaagatgcataaccattgtgtctgggatttgttcagtgccatcttttcaatcattggttacaatgaagctgggagtcccctctgaggttcggctttctgtggctcctctcccctgcactccaactttctcaaagcctgagcctcaagtgatttcccagtagctaagtaaactgcccccttcctccatcttcaccaagttcccaaagctgttcagactcaggcttcaaatctaacaggatgtggctccacacattatatttcagttgttattttttaatgtggaaaataattcaggaaagttttggctaatgcttcaagacatcatgcactttatacacaggatttgttcttaagaaggtagtatagtgacaggaggaacaatttacttcagaatatccattttatgtccaagccatgcaccagccacttttgacagacaggatttgagtatgatgataaaatggggtaagcatatattttaagttctaacatctgtataaataagaaaaatgaaaaatcactggaacacatctacatgctagtgagaaaataattactaacagagtaaagtttgctctgtgaaactgttgctcaaataaagaattattcttgatattagcatagagctgagaatattgcttttttccaaattcctaggtgagtaggcaatatagctagccacgatttttcaggatcatttgtaaagcttcacttttaggaattttaaccccaagtgttctaagacatcaagtaactgaccttttcatcccgccgaacaaacctcaaagtggagttgccaactatcccacaggaaattgagtcaccacaccaagcaacacacctaaatgtcgacagctagcaggacaaaaacagtgagccagtttaattttggcttttaccaagaacacatactgcattcattaataaaatacttcccctcaacccctgccagagtagtatacactgtggctctccttaaaaatacatgaaaactctttaactgcaccaaatcttgctaagtcaaggaactaaacagagaaaaacacccaagcaaaaactattggctaaactccctaaaggctgggagagggctatggaacagcaactgagaaataaattgagccttgaaggcccctgctacaacagcatcagttttcttcaaggcacctttgaactatgtaacacccgcattctgctgaggctcttctgtgaacaaacagtcctcaattcttgcgggccagcacttggcttctgtcacagtgatatgcttagaggttcccctgacacatggcctgaaactgtgccaggggctccaggagaagatgctgaagaagcagcttccttttgaaaaaggaaaaaagtaatcacctcagagccacagcagttagctagaggttgaggtcattttttgtgaaatgttcagtccattactcttacccacaactcacagtgatgttgaccattgaggtaaaaggatccactgtacgggatgtgtaactatgtggacattagtttctttgccaacacttgaaggtctgctaaaggactgtatcggcttgtcataattcctagatagacctattggtatacatgaagagaacaagtccaaaaaataccacttattttggacactatttgtatgcccttaatttaaaaaaaaaatacaaattataacagctgaggtcgggcacagtggctcacgcctgtaatcccagcactttgggaggccaaggcgggcagatcatgaagtcaagagatcaagaccatcctggctaacacagtgaaaccttggctctactaaaaatacaaaatactagccgtgcatggtggcgggcgcctgtagtcccagctactcgggaggctgaggcaggagaatggcgtgaacccggcaggcagaggttgcagtaagctgagattgggccactgcactccaacctggacaacagcagaagactccgactcaaaaaaacaaaaaaaattataacaactgatccagattttttttattattacactttaagttctagggtacatgtgcacaatgtgcaggttagtttcatatgtatacatgtgccatgttggtgtgctgcacccattaactcctcatttacattaggtatatctcctaatgctatccctcccccttccccccaccccacagcaggccccggtgtgtgatgttccccttcctatgtccatgtgttcgcattgttcaattcccacctatgagtgagaacatgcggtatttggttttttgtccttgtgatagtttgctgagaatgatggtttccaatttcatccatgttcctacaaaggacatgaactcatcctttttcatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcactgatccagattttttaaaaataaaagaactacaacaaaaagctcctaagagcaaatacttaaatctccctaaccagttccagcttctcttctcttaattcttacaaaatttcccctttgttctacggaaggaattgatactgtctacagtagatagaactggaaaaaatgatttctgtttcaccgtgtattgctttgagctagtcattcctttagtttgctacagtaaaagatttgtgtaggttaggtctaacttttgctgacttaattttttttcctctatacattttatctgatgggaaatacatgaaggctttggattctctttcaatgtgtacatgtaataggtttaagcagagtttgctagtggcaagctgctctcatctccaagtgtatttctggcatcaaattattgttttgaagtattttaaaattgtataaaatatataaaactttatttagtacttcataaagcttccaaaggaaagatgtgtgcaattttgtgacggttttctttttcttttatcttctcactaactacaattgtttttccgaatgttgcctatgcctctagtagaatttttatatgaaataaacatgaggttggctttcattgacttttagtcccaccagtaactcaacatttatttagcactgactatgtgccatgcactttattagaggctgcagaaacaagatgatgaaaagagtgtgtcccttacccagagtccagcagaggaggtaatttcagcaaacaactgtagagtgcactctcacagaaggaagcatgtgggctatgggacagtaaaagaggactatttaaatcagacagggacagaggtggagtgggaaaaggctgagtcctcaagaatgaaataaaagagagtgggaaggatttttaagagaaaagatgagcaagcacacagacctatgatgaacaagatgtctgtgtcggccaggcgtggtggctcacgcctgtaatcccagcactttgggaggccgaggtgggtggatcacctgaggtcgggagttcaagaccagcctgatccacatggagaaaccctgtctctactaaaaatacaaaattagtcgggcttggtggcacatgcctatattcccagctacttgggaggctgaggcaggagaatcgcttgaacctgggagatagaggttgcagtgagcagaggttgcgccattgcactccagcctgggcaacaagagcataaaaactctgtctcaaaaaaaaaaaaaaaaaaaaaaaagatgtgtgtgtcaaaaaagaaataaccatgagtagggccttgcttaggggaacagattctggagaaatctgagaaatcctcagccactggccatctcaaagactggccatgtcaggcatctgcaggtaggactatatcttcaagagtaggagtcacagagtgactcagagtactgtgtgacatgggatctgattttattttatatggaaaattctagtgctatgcaattaatggaatttaagaaagtaaagttgaagtcagtgcaaccattatctttgaccatattaagaataaaattaaataacttatagaccatttgcttctctgacgattattcttatctaagacaatctctgtattaaaatcctacgcagacatatgttcccacaatatgtcaggtatgaacagaaggactgcccaatgtgacttgaaagggagtggacttcttgctcttaaaaactacaaccttgtagtcactaacttattaatcatactgtaataagatggagaaaaaaacaatggaattcaccagaatttctttcacgagagtctgcctgcattaaaatgttcgataaagctatttatgacagaaggtgagactttgaagagctttggtttgggtggaactaatctgtgcctcatctacacaggaaaggggaggaatatgccagttgctagagagggaatatgtatgtgtgtgcatgtgtgtaagcgcatgagagagcgagagaatgtgtgtttgtgcacatgcatgtgtgtgtgtgtaagagaaaggagtcagcttggtctctgtgtgtgcatgtatgtaagggcatgaaagagtgagagagagagagagaatgtgtgtgtgtgtgtgtgtgtgtatgtgtgtgtaagagaaaggagtcagcttggtctaaagggtaactccaatttgtacatttttcctttctcccaatcatcaataaggttattgaagatgtgtgtgtgtgtgtgtgtgtgtgtgcatataagagaaaggagtcagcttggtctaaagggtaactccaacccgtgcattttccctttctcccaatcgtcaataaggttactgaaggtacaaaatcccgacttgttttgttttgttttattcattgaagggactgagcttgaaggccagattggcccaagcagaaatgtctctctgagctgacataagagaagagtcaaagaaagaggagaaagcttttataagaataaggaggccttttgtccaaaaaattggagtttgagctaagtttaattaggcatctaggttgggggcttcatgtgacatgtgtgcaactgtgagtgatattattctttgaaagaaactggaagagtggagaaagattccaatctctattccacttcatacaagcaattccaggcaattcagctactaatctttctagggccttatttcacctatagattggagataataacaagagccttgtaagttattttagttcaagtgagaggttgtgagttaaataatcttgcattgattgcctaatagattcttttcccttcctcctccattgtatcttcactttctcctggactcaagtctctaacttaaatgcaaacattctattaattttagtgagcctatcaactaatacctaggtataacctcggggtccagaaacttaatagttacctggaacagtttttagggtagttagaaagaaaaaagaatttcaaggaatgaacagggattcattctgaagaagttcacttagagaacacaggccattcaggaagctacaaacaggtagggatataaagtttagatcagacagtggacaaagataaagatggagaactagtcttggaggacttgtatactattctaagacaatattttcttctaaagaggccattaaaaatcttctaagtgaggaagtcacatggtcagatttgcttttcaaaaagattactctgggaatagtataaaggcagatcagaaaagtaaagaccagttaagaggttggtgaccagataaggagaaaatcctaagcagtccctgaaggggaaggagaagctgcagaaagttaggaggaaaaactctcaggagcaaagaaaaaggaaatgtcaaaggaaaatattgttatggactgaatgtttgtgtctctccaatattcatatgctgaaatctaatccccggtgtcacggtatttggagggaaagcccttcggaagtaattaggtcatgagaatggagccctcatgaattagattcgtgccattataagaagaggccagaggttgctctctttctaccatgtggatacatgctatgtgggcagtctgcaaccctgaagatgccctcaccagaacctgactatgctgacaccctgatctcagacttccagctcccagaactgtgagaaataaaagtttgttgtttaagccatcagtttatggtattttgttatagcagcttgagctaagacaaatatcaaggctttgccattgatattcagtacagaccgtatatacccacaggtttgcgctaagataattttcattccaaacacatatttcagcaacacaagactaaagagggtgttaaagaatgctactgaggaagcttttgtctgggaagttgtttgaacaaagttacaggacaatttttgcaaacaggtttaaaaaaagttacaattatgtatgctatttacgtattcttgttgtaattttaggaatcaattttatttccctggggggactgtaggagagcatctgtgtttccatcatatactatcaatcttaggatataacagtcttttgttcttcacctttgtcaattactgcatacagtattccttagagaaaacaaggagtttgaacagattatctttagcacctacccagctctaacattcatttattatctgatttctgaaattgtactatctgggttaggtgttggttttaaggttgttcattatagttagcctggatggggtcagctatgtttgtagagggaattcctaaactgaccagttacttgtcaaggatcccatccaataccatgatcctggaattctgtgagtttagctcaactgttcttcaggggtacatgttttctatttgaaattgaggtattctcagaaataaagctattaataaatagaaagttctggagtatatttacactcactctgcttatctccactcctacccctaccatattcccatccaatactttgccagttgacttaccaatttcttcttaatttctgtaactgtcaccttcagtcaaattctcatctgtgtatttctagattcatataatggtctactactggatctccttggattcactttttctcaacacagtcctatttataaagtcagaataatcttccttaaaccctggttttattgtttcattcttttaagaacctgctgcacaactctctcctacttattgtattaatgtcacacttctgttcacataggcctttttcggctgcttttcaatacctttcccttttatttacatctaagactatcccatccaagactgcccatcttagccaatctttccacctggaaataatttgctggcttctgcctgtatgacttttctaatgtcatttttatatttgtgtctaggcctttctataactgtctagaaaattcctgacatttacaggcactcagcaaatatttgtgagtgaataatcagtaagtatgcttgttttctatcagataagaatatttatttccaaacgagattcaaacagtaatactggcctgggtgtggcttcctacatgtaatcaccctcgtctatctcttgttctcagtcttttgctttcaaactctttctctttttttaaaagagtattaggaactaacattgccaaaatttggtaatggtcaagcagatcatggtgtcttactgaagtgaaatattaacattaaaataaaaatgacaagtattatggtatatcattcatatgtaatgatccttacaaaatagagtaaaattttaaaagaattcaccaatacaccagtatgatgtttgggagaaacagatgaatgcacaaaggtgcatctgatgcaaacacccccagaaaaatgagcataagttcatattatcaatatttttcactctaaaagtgttcactgacttccctgaagtcaccaaggactccaagttaagaatactttcctgagtgaagaaaagaaagcaattattttaatcaacactgccccagaatcttttattcggaatcgctatctctgctttcttcttcttcttttttttaactttctcataaatctctgtttagcatttatatctctctcactatgagatacctaagggttaagaagtaatgccaaagagacatttgtccagttgaagactgggattaagaaaaaacacacagccgggcatggtggctcatgtctgtaatcccagccttttgggaacccaaggcaggtggatcacctgaggtcaagagtttgagaccagcctggccaacatgatgaaccccatctctactaaagaaaatacaaaacattagccacgcatggtggcgggtgcctgtaatcccagctacttgggaggctgaggcaggagaatcacttgaacccgggaggcggaggttacagtgagccgagattgtgccactgcactccagcctgggcaataagagcgaaactctgtcccaaaaaaagagaaaaagaaaagaaaaaacacacaaaagatttcccgaaaagactaggcccttttaaacaggctatgaacagagtctcagaaaggtaatttcttatgtacaatttttaatctcattacttgcattacaagcaacacatatgagtgataaactattttggcctactggtaaacctacatttgttaactgtgtgtgcattatagagaacaaatttcagaactcaagagtatatcggttatatttggcttatccagttgtatatgaactggctccatacacgaataagataaattagttttataattttacaagaatatctatggagatttagatttggctaagaaagttattatacacacagaagaatccacaacctataagagctcttcatgggaaatagtgtgatagatcagaaagagcatggacttttgagtcactcagaacttgaattccagccttgccattgttctagttgtattatctgaaataagccatttaaaagacctgagcacattgtatacattgagaattacagggttattatgagaaatgcataagaaatgtaaagtaccaagggctgtatctgacatatagaaggtattcaatcaatagtaggtatactgaaccactttgcagagttgtttaaataagttaattttaaataaggtagttaatatttgagagtttccttccttttccacagattctcaatcctaaaacagttactatttttccatcatcaccatcaaccctcaaatattaaccagttctgagccaaatgtgagtgaacaacctatgatttagaatagcttttagaccaggcacagtggcttacgcctgtaatcccagcactctgggaggctgatgcgagcagatcacttgaggccaggagttcaagaccagcctagacaacatggcaaaaccgcatctctactaaaaatacaaaaagtagccaggtgtgtgtggcacatgtctgtagttccagcttcttgggaggctgaggcaggagaatcaattgaaccctggaggtggaggagatggtgccactgcactccagcctgggcaacagagtgagactctgtctcaaaaacaaacaaacaacaaaatagaatagcttttacaagaccacaccaaatcatgaaaagtcaactatgtaggaagaatatgtatttgtcattggttaatgacagagcatcacttacactgaggttactgggaagatcatttcaaacatttcccaaagaatgttccaatcaatattgtccttataagattctccttactaatgacgttttgtggtcaaacaagcttgggaaatattgtatatgtaggctttttacagtgatttctaatggacacgaacctaccaaaagctagaaggtccacagcaaaatgagatatttaattttattaacaagcattatctaaacctgtttgattttagaatgcatttttcacacaacaactatcacctcttgaagaatacctggaataggttttcctatacctatacctatatgtcaggtaactccaaaacattaacaaatacatgtgtttagtaggttcccatatggttgaaatctccactaacgacattttatttctcttcctcctgactttgtatgctatcgagaaatggtcagagagtaatcttcctccctccctttcttcttttctttctctctttttccccctgaaagagaatagtcaaaaaatccatacatatttattgagcctctctgatgtgatagttgctgtgaaatacaagaacatgaaagattcagcagcctgggcccaggaaggaaccataataacctgctgagaaaatcagacacatgatcggctgctgcctagagacagtgtaaggtagcatataaatcattcagcctgggagtgctactgtagttcgagcagggagagggaggtatggactatagctcagtgtgctgggtttcaggaagaaggtgaacttggatgtaggtcttcaaggaagactgtggttttaatggctgtgggaggagggagtccgctggcattgttttcaggtgtaggaaatgtctgcagcctgaataaaggttgtatgtgtggacagtaaatgggctgggtggagtagacacattccagggaggagaagggatatagagttgaacacttaaatgtgtggccttgagctagtggatattgtgggaattggataagtgcactggtagcctaagaggatagaatggagaagagagaaggatggagactaaggagctattgtggtagtccagatgcagtggaaagcaaagagttgtggaggtatccactttagtggtctacgatgacagttacaagcaatagaaagagtatgacttgggaacagtggttcaaatgctggctctgcaacttagcaaccatggggcaaatttgggcaaattaacttctctgtacctcagttttcttttttgtaaaatagggctaaaaatacattccctagaaggtggcctccaggccattttcccacactttatttgaatgttaaaactaactttaatctaaaaatcatatattcatatctctatcttttttggcggttcagttcaacttaaatgtgttatttgttaaaaacttgtaattatcatctattacatgtaaaatataagagctgcttttaatagtaattcatctcctccctatctttttttaaaacatggtcaaaattaacaaaacaatcttgtatttttgatactagtagtggtatcactactactagaggtacaaggactcttgtacctctctgaaaagtagcataattagcaacagtattgatggtatctgctattttagattatttaaactgtagtcactaaggtaagcaaggggaagaaggcatgtcatttatgtgtttttcatccttaagattagcgtttggaagcatatattattccacagcaatctggataggtcttgccatgccctgatcttgtaagcccaaattttattttgaatactccagctttgcacttaaatgacagctccttgataaaagaaaaacaattgcctaacaattttcttccaattgtctgaaaacataatgggtgtacatacacacacacacacacacacacacacacacacacacacacacacaatctctagggcatatttactagatagtattatgtaatgtgtagacatttttaattatgataattaagacaaaaatatgtgtagcaagtttttgatttgagacaaatttgagatttactaaaattattatatgtgtgtccttctgaagacttcatattttcattatatatcttcattcttgaagtataactcttaaattgttgaattaagttttatgaattaagttgttttgttttttgtttttttttgttgttgttttttttttttggccaggcacggtcgctcatgcctgtaatcccagcactttgggaagtcgaggtgggcagatgacttgaggccaggaatttgagaccagcctggccatcaaagcaaaaccccatctctactaaatctaatcttgtgcctcaagcgaggcacaagactcacttgaacctgggaggcagaggttgcagtgagctcagatcgtgccactgcactccagcctcagggacagagtgagattctgtctcaaaagaaaaaaatttttttccatttttaccaataccactattctcaattcatccactatttcactaggaattactaattcagtttacataatttattcaatgaataaattattcaatgaagaagcttctgggtatttaggtgctacatgctaatttcaattggcatattttgtttttcaaatttgttcttggtgacccaataattatacctgtccaccttgaaagtgtctttcttcatcaccttcaaggccaccgctaacaagacctttgaaaagaagtaaacagtagagaatttcaacttctgtgatgaccaccgtcttcttctgaatccccagactccactcatacaaggttttggggaagtttaaatgaaatgaagcagtggcttacaaagtttattgacagtaaactacagtaaaatttatattttatactataacctggtagatttgtttaaagtaagaggtgctcacttttgaaggcatgtggatgctggctttcagtaatataaaaaaaatgtacaaaaaggttttatacctatatttatttttaaaaggtagaggagagcagtggactcctatttaaagaaactcttgtgttttataaataatagtcatggcaaaatttgtttacagtctttaacaaaccatgcatttcagtataaattaaaccaataaaaagaattatatatataaaataaaaaggaaatgtatatataggaacagtatataccatacacataagagtaaatatatattcgagccaatacagagaattgaaacataatttaacatgaaataacatttatccttactatgtatgattcactctgatgttttctattttatttaattttaaagtattaattgtgaccccttaaattgattttgaaatctaccaattggtttgaaaacactgaggtaagaaattaccttgcttaataaatgttagttttgtttccctcttccctcttcctccctttttataattaaaaaactctccctctacttctctacttcacgtgagagtagaacacataaaaagatttcagttaactactgtgcatattttttgaagtaatttctccataatgtgtgagttttctcagggtactacaagtttaccaacagaacacataaagcagcggccactcactgaaatgcctataggagacagatagaccatatgaatgaatgaatgacatggttgctgggcatcctggttgcagtggctagaactgtggagggtaggagcagaccaccatatatcctaggcatttcattggcaaatgaacaggagaaggacacctttccgtttggccctcattttcctagatctttcctcccttcctctgtcaatccctcctacatagcctatgttcccaaagcaccccttgtattataataataattattatgatatctgtccttaatcaagaacttatactggatttttaatgcctttaggtcttccccaaacttcagttcatctattcgaagtccctataaaatctacctccttagacttgtctgcccccattattcccctgtggttgacctcacctccatctctatcttttgtcagcaagtttcctcagagttccctctctgcatacttgttcatgctgggttatttgtttttgccacttgatcatctagacctttttccctctttccctccttctattcaatttctgcctttcactgctgtacaaaggaggggcagggaggccctccagggtggagggaatcagtcttgagataactgagagattcagggtgatgagtcccaaagttgaagagaatccacatacttcttctgtttttgttttacctagcaaggagccttttctatagacaaagttgggaaaccagaggttatgacgtgattcatctttgcctacttaaactttagcttgattcatcacttctcaacaaatacttgttgaaccccaccagtaatacgagaagcttggtattctatgaggtgctcaacttccaaagcttagttcagaagaattctggcctcaaggcgtctaccatctagaagcaaacaactaacaaatgaacaaatgcagtgatttcaaaagaaattaaggtgtgctgtggtagaggcatgcacaggtcagaaaagttcagaggttccagacaggcttcctggggaggatatccatgccccgcctccacctggtagttcatgatcagagtttgcaagcttggctgggatagagggaatagcgtgtgaaccacagaaggagtggatctggtggctcagacacggcaagaaccagctcatggcactaggctgcaggcacaccatgcacaaaacagtcttttctttccccagttctccaaattctctaaagtggaagcctaggggtgagggtaagaaggaggtaggaagctacaaccactggagcaaaggacgaaagaaggggcttgagtgtctaaaagtgcagaaactcaaccgactggacgctgagacaatgtttaaaaaggagtttttttgtttgtttgttttcttgtgtttttttttactttaagttctgggatacatgtgcagaacgtgcaggtttattacataggtatacatgtgctatggtggtttactgcacccatcagcccaaactaggttttaagacccgcatgcattcggtatttgtactaatgttcttcctccccttgctcccccaacccccaccaggccccagtgtgtgatgttcccctccctgtgtccatgtgttctcattgttcaactcccacttatgagtgagaacatgcagtgtttcgttttctgttcctgtgttagtttgctgagaatgatggcttccagcttcattcacgtccctgcaaaggacataaactcattcttttttatggctgcatagtactccatggtgtatatgtgccacattaaaaatgactttttaaagtggcaactgtgggaggcaaaggagaaaaaacaggagctgccagataagggagtgaagagaacccagcactttgagaattccgttacattttgcagcttgaattcttcactttttgctcccattatgtgcctctttctcctctccatgaactgggccctgtggacccaggatcctgctgtctttgcagggcaaagaatggttagaaatgaattcattaaggtgagaaaccattgctggcataattctccttcacggaaacctggcacttaaatttaacctgtttggttagatccagctctgcctcccccatttttttctgcagaaacaaggctggcagatccctgttcctcttaatccttgaatggaccaaatgctgggttatgctggggcagtgagggaccttacaaacactgaaatttaagagaacagtttttggagtaaggcagtccttgtttccaaatctgagctttgccactgattgactagcttggcaccttataaaagtgaattaacctagcttgttttctaatttataaaatggagaaagcagtacctatatcacagtatgattctgaaaattatttaaataggactatgtatgtaaagcagtgcctgaaaaatagcaagtggtcctaaagtcactatgatgatgaattttatatgcaggcacctagagcatgttaggatttttgggatctttcccagctcacactgaagcttcactcttctccaacagtctgttatccaatgctggataactgagatagtcttcccagcatttatcaatgtggttaggaacagtaatcctggaaagcattctcaaattatttatctaattaaacaagcaaacctttttagcccagacatcctaaatctctgtagcttgtcttcgctgatttggtcagaatagctcagatggtaggaagggctttctgggtagaaaaaaataaattagcagtctggaaaacaaaagatctctgcttaaaagagtctctaaaacagcctgatcagcctgtgtattttgccatattatctagcattagtaggggactgggaaaaatccagggctccttgtagagatagagactggcaaatattatgtttgatgcatgagaaccaaatcagaagttaactctttaagttattaaatcactaaacagtctatcacaattatgtgtttattactagactgaatttctctggggctggaaccataatgaattcattttttgatctctggtgctaaacactggctgtcatatactaggtatccaataaatgtttgttgaatggaactgaaaaagcatgaaacacttcccctgttaaggcttcttttctataatatttccatagtttctaatgcatctgagaatcattaactggactgttagaggaatatgaatatggttgagggagctacaaacttcatgctctgagatgtcacatgattagtgtaacttttgttccaggggagagaaatccctaagagagtgactgttctccatgcccacccacccacagtgtcctatagagcctttcattctccagatgcctataatgactatcacattgatttgtttacatatctattgccttgtcttccttataggtacagagtccatacatcctaattggcctggaacttccaaggtctatgcctgttataccagtgtaattatgaatagcattgcctttcattctaaaaagtgttctggtttgaatgctaaatcatctagacaccctacttatgagagggttcactgtacatcgtttagtcccccaactcccctccccttggaaatctgggtactaccctctaccgggggctttccactatggaggcagctctctcaatcacagcattcaggaggtgtaagtccactcccaacagaacagacacctgtctacaaagagactcttggtggaagaaaaaaaaaaatcacttccgtaagtttaagtcttccttttaaacttgggtctcttttgcacatcagaaacaaagaatctctaataattacatccctaaatgtactgaagtctagaagacatgcccatttgaaaactctaatctagtaattaaagcttctcaggttaaactgcaccttaataatgtagcttattttgtcaagatcagttaaggccctgtaatgtgatttggaataaatggacagacagaaattaaaatgtgctggacaaggtaatcagaaatctcacttcatttagtcaataacaatggcaattcagcgggttccttttactactgggatgtaattgtgcttggctttaatttcttgtaatgatggaacaaattaaattacttcatacttttaggaacatttggctacatcatgttttggtgcttccataaaccccactggaaattaaatcagctctgtggttgctcattctccctctttagtgccatgtctgccttctgtcagcaaaatggtaatattgtctaccttaatccaccagatgcagttgagttaaaagaaattacctctcccacctctttcctttcaaatctccctatttgtagctatcaaattttggcatgcctgctggaacacagtcttgttagaacaagcacggtaattctctcgtgagactttaggactctctctacgacaaggtcagaatgtacctgtgattcaaatttagatgaggatatgagttggtaagaacatgaagagcatcagacagttttcaggacacccactacttttattttgtgctatcagtttttcctttcccaaattgcaggtggagatgcaatctttaacgctggaaatctcttgctatatgccattaaaattaattagtctagcacattttatctttaggcccttacctagggcaggtaaaatattctagcacaaaataacacaactttcctgaacaccatggctactaagttcatatggtaaagattatactatacattaccttgcaaatagagtgttgcagactgatattaaatatttaaaatgtatgcaggattattaataggcaacattgtggcagagactgctaaatgtcccctaatattgatgcttttcttcatcacttgttttcaaatacctgttttcatgtaagcatgtgactgcccaaaatagagaaaattcacagcctccttggttgccaggtgttgccatataactaagttttggtgaatgagttggtagtagaagcgttatgtagatattatatgatgtgctagaaacttcccttaagagaaatttgtcatctatctttttatctgcctgtatttattgttttctctttcctactggctagaatgtgaagttgatggctggagtcggagcagccatattggatggtgagttgaatttagcaacagaggctacacctcacagtgcaataagatggaaagagcacgtgtccttgaagactgtactggatagaggtgccatattaacctcggactgccaactttcagattttacatgaaggagaaatatctgtcttccttaagccacttctattttaaatctctctatttactgctgaataaaatctcaactaacgcaaacaccaataacaaaaaattcctattcactcatgatataggattataccttagtcttttttgtgtcatatatctgttcattcaccatttttgctttgatgttcaataaacatctcaaatttaacatatctataaaaattttttaaattttacgttcaggggtatatgtgcaggttagtcatataggtaaattgcatgtcatggggtgctggtgtacagattatttcacaccgaggtaataagcatagtacccctacagcttagtcttaagaagaagtatgttcacataggccaggctgagacttggatgttggatgactttcttccagcttactctgatttgaatatattgtgtggtagtagatggctaaactgcttgctccaaaactatctgacaatgctttttagaaagtctgccaaacaaaactacaagaatcaccctggagcttcccttaggcttcagatatttgtcttccctgccctacttggaaatcattccagcctggaagtcattgtgaggaaccaaaaaatggtctccctaccatgaagaataacactgcttccattgttgggaggctctccttcctacaggcactgtccctcactcattagacacttgaataataaggatgttcatatatttattggtgttggtatcagttagacagttgaatgatacaaatgttcatatatttcttcttattcaatagtctcacaagaacactattcttgtaaagtcattaaaaactggatggtcttttcataattatttccatgatttgtcatctaaagccagtgttctctcctcctgtcaatctgatagctttaaagctaagttctgggtgggtccaagtcatgcctgaaaggtttatcaaatgacatattgcagtcatatggtcggagcacaaacacctctgaatgtacaatattttaaagcaaaacagtttatgtgtaagctctatgaggttacggaccatgactatcttatttattaccaaatccccagctcctagaacagtgcccctcaatataaatctgtcaaatgaataaacgaagagtttgcctgcagtagtaaacttgttatttgcacacactcgaggcccacctctatgtgtacattgtcagtgagtcagcctcgtggatgactctgcaggactgtctgtataacatccactacagttaccaggggacccaattttcataaattgctccagcatcacaccctcctcttacagagactcttcctgtccattctaatccctgacacgttgtcatcctcactcagattccccaatagatagaaatgctgttaaatatacttgggtagagagggataggcatgctcaaactcgttttgggaaaaaaaattgcaactgtcagaaatgtgttagctatcttcacagattatgaaacataaatatcaattatctgttcacagcagtgaaagcctgcatatttttttaagatagcaagtataaaacggctataagtaccatgttgagtagagacctaccaccgaagtagagaccttcactgaaatagtgaagggatggttgtgttgcagggtcagaatgattacccactggttgacactccctccaggactaaaggcagcatcaccagcgtccactctgcttctccactgcttactgttaaggagcaaggcaatagcattatctaagtaggaactacttcattctttcaaaacctggaatcggctgatcagaagaagaaaaacagtataaaaatacagaaagacaagattctctggctgtcctaatgaatgctagctagctataatagcatggataagacatataaccaaacatataagatctattaattaaggggaatctctatttgtattaactcatctattttctctaaaaccagtatttagttatctcccatacattggcatattgtgtatatttgcagaattcaaaatgttactgatgtgacttttttccatcagacatctgagctatccctcaactaatagttgagctgttcctctatagctcagtatctgagttagaactcgaagtaaaaaggtataaataagtcatgctataaaattcaaaggcaatcagatgtttgagactatagttatacagaaaagtgtccttgttcttgggaggaatacatcgaggagtttagggatagagggctatgatgtgtgcagttttctctcaggtggttcagagaaaaaaagacaatgtgtgtgtatgtatatttgtgtgtatgtgcacatagagtgatactgcaaatgaggtggaatgtttacaatgagtgaatgcatgtggttttttttttttttttgcactacccatgaagctttccagtgtgtctgaaataacttccagataaaactttttttaaaggcaatcagaacagtggcaatgaataattcaattatttcatatttgagctgtctttcctgccacccccaccccctataacactacatacatacataggctcacataagtgacacttactatacttttttgcctatgtaatgagtgttggcgaagtacgtgagtgggaaattcagtcttttgcattcaagctctaagtaattctaagagaccttttagataatgatttgacttttaagacaacaattttgaggttataatatgatgtcatttcatataaacagaactgcccttttgtcctttcagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaacttccttattataatgcctctggaaattttccttcaggctactaaacttcaagccaacagtctaagtgttaatcagtaatcatgctagtaactttttgagatgggtcagggccagggccagggtcagtgatccatcatgaatggcaggtttaaaaatggatatacgtgatcaaaaatacccataagttgaccaaagcattctaacctttgggttattctaacactcagtgtatcagccttctgagcaagccaattttttattgccttaaaaagtctaaaagaaagataaaaacagagataatcagttttgtttggcaatggcaggggtgtgggaaatgaaaaagaagaaagttaaagatgagtgaaaataggatagtcttggcactttggtatgaaattgaagtacttatttaaactgatgaatattgtacagaaatatacagagagcagtgaggggctaagaacctaattccaaggtaactacaaggaaaaaattattgatctggattgtgaccagaattcaagagtttgactgttgtcattgttgctgttgttattaagttaaaaaaaatgagaaaaaaatatacttttttctagtatacttaccaggaaaggaaagagagaaggagggagggaaggagggagacatggagggggcagagggagagagagacaaagacactgacaaagtctggaaaaagacacaaattcagatttaagatcccaaaatatgctacatttctgcccccttcaaaatattaaactttgctaaaatacactggaaattttttttattgtttattttttaaatcaactagcagaccaattagccaagatgatattttcatccttggtactctttcaggtgagctctgtgggctaccaccagaaagtcctagccaaccaagctctcactgggtcactctgtgctagctagactacatagcctcctaaaaaagcacgcagccctgatgctggtcctgccaaagtgtggtttgctgtcatgtcctacaggctacccgtttcccagtgatttatcataataaaccaaatgggaatgaaatacccagaaatatgccataaatctactagtggtgaattttcaatattctgcacaccatggtgatttgttaattcagttggatctctattaaacctctctaaaatgtcattaaaccatctgttttgacttgttaatcaaacaacttttaaaaatgtatttagagtatcagtaacccttgaattaatgcatccatcagtaataatcccctctccaactttagatttatttttaagctctagcttttttccccaccattccaacaaatagcctgacttccaaaagtaagaatcaatcacttcagttgtagaaatgtccagagggtgccctactttcgaaacaggaagtaacttgatccagcagtcccacttcttggtatatatccaaaagaactgaaatctggatcttaaagagatattttcactgcagcatatttgtaatagctaagatacagaggcaacctaaatgtccatcaacagatgaatggacaaaggaaatgtgatatatatatacacacacacacacacacacacacacacacacacacacacacacacacacacacacatatacaatgaaatattattcagccctaaaaaaggaaggaaatcctgtcatttacaacaagttggatggaactggaggacatcatgctaagtggaataaaccagacacagaaggacaaatactgcatgatctcacttacatgtataatccaaaatagtcaaactgatggaagcagaaagtagaatggtagttgccagaggctgggggaagatgggaattggtagatgtggtcaagggttacaaagttttagtcttgcaaaataagttctggaaagctgctgtataacataagtatacaatcaacaatactatattgtatacttagaaatttggtaaaagggtagctgttatattaagtgtccttaccatgaaaggaaaacaaaacaaaaaaacccaaaaagatgggaggaaacttttggaggcaatgaataagtttatggcattgattgtaatggtggttttagggtgtatacctgtctccaaacatcttgcagaataaacatattaaatctaaagtttccttgggaaagaagatgagaaaataattgtcaagagactgtacaccaataaaatagtcaaggagtacaatgaaaacttaggaatcccatttcttcctttgactcacactgtttgatgatatcattcacatcggcatttggaagttattgagacatttcaacataagattgtccttatgatctatgatttgggactctcttataagaaagtccattctataccaatttgttttgttccttggtaactagaccttctttaattggatctaagaattaatattcctatctcataaagaagactaaaaggatccaagtagatggagtttcaaaggtggtccccataaaagcatttttaccttaagcaaagatgtcccaatttttcctgcttgcttttcggatgctgttctaaaaaaaatgtaccttattccttctactaaaagaaaacctatcaattcattgattcattgaacaaatatttattgaacatgtagtatgtactaaacactgggtaagattccagatatgcaaagaggaataagtccctgcccttaagaaaactcacagtgtggtcaagctaacaattctagagcaactgtgtgataagggctccaaaagcacatgcaggaacacagagagaggcactcttagtcttggaggggcttcctacagtgggcaatttttgatgtgtcacaaaaggaggagctattagggcacaagaagagcaagggtgaagtgcagaaaggagtgaatagatggggaggggacccaggcaaagagaataacatcagcaaaggtgcaacttcatgggaacacagtacatttggaagcctgcccaccatttgttacagcagaatgcatgtgtgggtggagatgaggctgcagagatgggctggagaggattatgagagatggatgactagcaaaggaagttggtcatgtccttatgtggtgggggaccatggaaagatttttatttataagacgtggtttattcttcattctgtggcaaaaagcagatactatagtctgaatgtttgtgtccctccccacattcatatgcgatgaaacctcatcaccaatgtgatggtattaggaggtggggcctttgggagataattaggtcatgagagcacagcccttataaggggattagtggcttataaaggaggcccaagagagctgccttgccccttccaccatgtgaggacaaagccagaggcactatctatgacccaggaaatgagccctcacaaaataccaagtctaccgtgccttgaccttggacattctagtctccagaactgtgagaaataaatttatgttgtttataagccacccagctcgtgatttatttatttatttatttatttatttatttatttatttatttagagagagagttttgctctgtcactcgggctggatttcagtgccatgatctcagatcactgcaccctctccttcccaggtgcaagtgattctagtgccttagcctcctgagttgctgggattacaggtgcttgtgaccacatttggctgatttttttgtatttttagtagagattaggtttcatcatgttgcccaggctggtctgaaactcctgacttcaagtgatctgcccacctcggcctcccaaagtgctgggattacaggcatgagccactgtgcctggctatgatattttgttacagcagcttgaatggactaagacagaaggaaaaataggcctttctgtagcgtgagctgaaagacagaaaatagccataggtttctaaagagagaaaaagatatatgtttgacaatatgtttcaattagtactttttttgaaatgcagtaagttacctataccttattccatttctaatctatatgatggcatttaaatattgactaggtttctgatacagtttttggagtctgaatgtcactgcatggatgaataaaccaaacagatcggattcatatgggtttgccaaatgacaaatttttttccatgtaagattagaggaaaaactgatttcacccaatttcctgccttatttatattagaactgaagtcaatgctgttatccctttgcatgttcttttgtatttaaaatctgatatagaattgtgctgttacagaagaaataatttaatgcattctgccctcttatttctcatgagttttcatttaaaagaaaacaaaaaagaaaaaggacatggacttttctttatttctagactttataaactttttagttatcaaataaacacatgtattaattaagtaggtaaaatattgcatatattaaaaggtacttggagactcatatgttgtcagtttttcatgactcaaaatttatgaaaaaccatctaagactatcgtaatgaagttcaattgtagatcttgaagtgacaaaacatgaaccacattgacttgaggtccagggcttaaaactgcctatttgagctctaggttaaaagcatgtgtgaaatgcaaagtctgacatctgcacagctgactattgtgaagtctcagtatcattgttcataagtaaagcttgtccctaagccataccacaagcattcccagaggatatagatttcatttgatttaacatgattgttgatattggtagtgtatttcacgtgaacttgtgaaatcattgtctatacagacaattgagacactaaaacttttttttaagtattttttgttaggggctagatctgaggttttttattcatttgttcttttgttcactcatttgttagttcagttatttactcaaaaatgtatattgagcaattcctatatggcagacactgacagatgctggattcagtgatgagcaaagcattcgtggtttctatgcccaaggatcctatcccgtggagtgtagagtcaagcaaagaatgtcaacaacaaatgaaaattttaatcttattaatgttatatgcaaaaatgtaacacctccaaaaaagacaatttatttcctattaaggaatgaaggcagtccactgaggaagatcaacatgtaagcacatgtaaagcaaaataatcaataggtaatgtagtttttgaaaaagaaggggctttaagcaggaagtcctgggtttggacttgggtttcaaatctagctatgtactcttgggccacatacccaagtcttgtaagtctcagtttcctcctttttaaagttagcctaaaactacctcgctcatctaatggtgtgagaattaggtaaacagccaggtagctcatcaaattgtaattattataattgttattttttgagtcatgaaagttttcacactgaagggaacatttcaacttgacctggaagagtaagtagtttatcaggcagaaagaatttgttagggtattccagagagaaggaacaaaatgtgcaaattcaagtagtcagaatcaaaatggtttcttaaaggaatgacaaacagatcagtgcagttggagcctaaagttatctaaataatccgttagaccttttctttaactgataaaataaagcaagcattccaaaaatcaatttaaatccatcttcctccttatacctctccattccccataccatggaaacacagttttacctcttttacaatgagttgtcagcatgaagagacttggttcattaagattagcaaacttcacagcattgaacaaaagataaagaaaagtttatagcaaatacgttccatgtgaaagcatctccagcaggttcagaagatgcaatgaaaagactaaaacttgatatagggatatttcagtggtgctcgtaccagcgtcctaacattttgttctaccttagtaaaatctatcccttattactcatcctatctgtagactctcttatggaacaagaagcttttttttttttttccctaatcccgtggggaagccctctccttccctgggtgattcctgagcaaccaggaaaacagcagtcacagtcaacacagctagtacttgcagaaaatctctcttctgtgatgctctgaatgactcacagttccagatggccttgtcagcctttatccgcattccactcttggcaccattaacctggtctactgtggttgcaacaaataacttttcttgttatgaggaccagtgttttgaaaaatttaaaatgttataaaattaaaatgtttatatttggaaattatttccaaatataaaaggagcctgtcttcattatagattatttggaaaaaatgcagaggggtgcaaaagaaaaatggaaacaagccatcttttttttacccataattctaccactcagagacaactactgtgaacattttgatgtatttatctccagtctttctagaaggtagatcactgtaagagatttctgaagcagaagtactaagtcagaaggaataaacatttttatacctcttaatgtgtattgccagatagtttttgagaaatattacagcaatttctacttttagaagtactgcttgagagtgatgttacatggtattctcactaacacatatacaatgttataaatatgtccaaaaataaaacttagcaactatgttatctccttgtttcaatttgaacttattacaagagtgatcaatttttaaatttaaatgttatttttagcaaagttatagatgcaaatagtttagagaactaagtagtaccacaaggattaaaaaaagagatctcctgcagtgcatcccccacccacaatacatacatgtatcttccactccccagagggtacccattttcaaatattttagctgattcatttgctatactccactctatctctaaatgatataactttacagttacttcttaatagttcatttttttgggcattgcttattgatacttcatagcggaagataaggatttacctttgcaacacttcacacttctcatcacccatccttctaatatattatagtcttacttagattgatagtcattgtgtttccatgagcagaaccaaagaaaaactataagcagctaaactatgtaacataccctgattacctttttttctttgttttccttcttgaaaattcttgtcttttgttagtttctttgttcccttagatgtccatatatacttatcactaattcaatcccaaacttttcccatattacaaaaatctaagtatggctcaaacacatcaagaattttattaaattcatcttcttgaagaaatctcatccagaggcctctttgacctggattggttattctccatgtctcttgctcagctgtcactttgggatgttctttccttattatcccaagggtaatgtttttagagtttattcccttgttttggtgagcacgttttccagtagcttcctgagtcagtatgcatcagagatacattttttaaaggctcgcacctcagaaataatctttattccatgctcactcttgatcaatagtttggttgagtatagaattcttggttgagaatcactttccttcggaatttaaaaggcatcacttcattcttttctaggtttcaaaacgaatcttcagaagtctgatgcccttttgatttttgatccttctatacgatacgataatgatccttagaacaagtcacaagtctcttttttaatactttatattgtgctaaatgctccaattaatgagttctggaaatttttcttcaattttgtcctcctgcagttttctcttttttctagaatttctgattttagatgttagatttcctgaactggtcctctgatttcccactttttcttctgtattttctacctttttgtatttttgctccatttccatagagatgtcctcaatttacctttcaacccttctattgagtttttaacttattctatcatgtttttactttccaagagctcttttcctattctctgagttgttttttttttttccatagcatctgcttttgtttcgtggaagcaatgttaatatttatgaatacaatatcaagtgtatttcttctcctctctctgatgataccttcttcctgcaacatctgtacttttttatttctcttctttttttttttttttttttttgagatggagtctcactctgtcacccaggctggagtgcagtgggaccatgttggctcactgcaacctccatctcctgggttcaagcaattctcctgcctcagcctcctgagtagctgggattacagttgcctactaccacgcccagctaatttttttatatttttagtagagacggggtttcaccatattggccaggctggtctcgaactcctgacctaaggtaatccccccgccttggcctcccgaagtgttgggattacaggcgtgagccaccgcgcccggccaacatctgtactttgaagttggtctttttccatttgttttggtttctttcacttactttttctaagtatttgataaatcttatctgtctactcatatttaaggctagagtactaaaaatcagattggaagctctgtttgcataggtaagatttgtcaactacatccactttttgatgatccaactgaacagtttcattcagaaataccttgcaccattatctttgggttttttctcttgggttggtgaattctccaaaggttatatcaatctcctgtccagaaggcttaagcatagttggaagctgactaggggaagaaggttgggactttcaaccttcggaattcattcaacaaatatttgagcatctatatttggcagcctctattctagccaccggagacacagtggtaaacagaatttaaaaagccttgtgttatcatgaacacaaatatataagtgtttatttaatccctctgttttcagaatggcactcagtcttcaacctgcctaggccccccttgtctagggacggttttacattcatcaggaagtataccccttgtatacttgtttttcagcttccaaaattttgttgctgttatctcccttcccactttctttgtccttgtcatttatgcctataaacatccattgatggttttctgaaggcagaggagttaaatggatatgttaattactatagatgtaatcagaggtcttcatgttgtttttttgttttctgttttactattctaacttggcatttatagatcttctttgtgagtagtctgaatttgtctttaatgatttaacattgaaacagtattttccttacttatttgcataagctctttctttgttagtgtattagccattgacctgcaatatcttttaggatgaccgattctgaagcctgctgactgagttgcttgtggttcctgtcatttagaatgtatgcaggtcatgaatcgcttagatggaacagatggaatgaaacttgctctaaatattttaccaaaataaatacatttaaataatgtaaagaaaaatcttcaatcactaggctttgaacttataacagaaaggtatctgcttttaactatattaattcaacaaactttattgaacagttggtaagtatgaagcatcatctctctgagaacaaaataccaaggaactgagtcccatccttacaggattctcaggagtaaatgggtcaatacatagttataaaatgatgagggctgatctatagcagaagtacaaagctgagaacaactcacttgacctgctaagctggggaattcaggaagggttcagatctaaagagcagacatttgaggtggttcttgaaatatgagcacaatgatggttttaccaggctgcaaaggtgacaaagtgcattccaggctgataaaagagggcatgcaaaatatggcaggtacaaaaatgtgtatttaaggaagaatgagaagtttctggaagttgctgaagatacagaaaataaagtggggggcggggggggcgggtggttggagatgaggaggagatggtaggcttgattcaaattatggaaatgtatttataatgcaccaacttgtaaagacactgttgttccctacccagcagccactagaatttgttcaggtgtcaggcggttggtgcttcaagggagatcaggcccctcccaggaccaggatgaaccatgattacttcccagccaatttcatagcatttctcttgccaatgaatggcttagatataagcatatgatgaatttgtttctaatacagatctgagaaagaaatctgttaaggaacttctggtaaagtttttatctttcttaaaaagtgacagaagaaaaggaagttgtataaatatacttagagctgctgtagtcatcttgagaccataagaggataaaactgagatcaaaaactactgtgctgaggatgggtgactagaaagaaggaaagaatctggattcttgatgcatgtttgtactactagaatcattctatcactaccttcttattatataattcaataaatctcttattatttaagctattttaaatgaagccttctgttatatgcagcctaaacaaatatactgattcaagctcccagcaaattctgtcacacataattcaaggaacgtttgttaataacttcatactattatatggggaataaatgattagtcaagaaagactttctgttttgaaaaattctggaaagatgataatacagtatgtagatttattgtcatggctaatatacatctacatataacatgaattaccttggagtagtaataaaagggcagagtaataacttgtgcagagccctagactagaaaagttgaaaatataaaatggaggaaaaagtgagttatgagattcagtaatatgaaagtataagaaataaaagaatccaaaagccatagaaggttgaaactgaaaagaattttagaaagcgtctaggccaggtgtggtggctcacacctgtaatcctagcactttgggaggccgaggcaggcagattgcttgaggccaggagttccagaccagcctggccaacatggtgaaacctcatctctactaaaatacgaaaacataactaggcgtggtggtgcatgcctgtaatcccagctacttaggtggctgaggtggaaggattgcttcaacctagggaggcagaggttgtagtgagccaagatcgtaccacttcattccagcctgggtgacagagtgagacactgtttcaaaaaataaaaagagagtctagcctaaaccccttaattatacagattgaaaaccagtcctggagaaattggaagtcctcaaagagtttaccattaatggtggaaccaggacttccacacaatgttctgacttcctttagagcactttttattatatcatatagttccttacttctcactattaatagagattattttactaagagtaagtataataagagctgatcagaagacctgagagacataatggagtttcaattctaatttgctgttggctccttgaaatgctttgttgagaaggagtaaaaagcttacaaaacacacacacacacacacacacacacacacacacacacacacacacacaatttcttaattatgtctaccatgggcatgggatggtaggaatgccatgtaactagtttccatggatggaaaccacctaatgggaaatagagaaaaagaaaaagaaaagaaattgtgtgtaaattttcagctcattttggcttagattacatgatgaaacttatttctttgaaaaactcatttgattttgaattagattatatggaacttctcctttgtcaattttaatttcttgtcttgttttagtttgcttttctgagcagtagatatcctcccaattggagattccgcaaaattagtacttagtcatcttggttcctttcaagtagaaaagtttcttttaaatacttcaaatcattggtatgcacatttgttgcaaaaaaaaacctcattctggaaaatgttgcttattttattatccaaaaaataggtatttattaatatactgcatttcttttaaataaaataaattacagattttcttccagcatccacttatttggaattgggtacatatgaagaaaagacttcttataatatggaattatttcaaaagctattattacttcttataaatataaagcatacaagaaattctcaccattttctaagatttacattagaaagatataagtattgtcttttagaatactgtttttatttttctaaatattccttataacttacttattaattttatcctttctttgttataaatatccattttttttaaagacccatactatcttttcctatgcaatttaacctaacatattttctgtaaatgaggttatttagttatccatttttctacctcctgttgcttggcagtcctcaaaaccattgcagatctttctagagagcagtttttaagaacagtgctttacttttcaactcttgatcaacctgatgagaattctttgaataaaccagaaggaaggctaaagagacaaaagaatactatagtttccttaaagttaatgagccagaatcctttggcccactttggcattgaacaatgtgaataaaatggccactctcacatcagtaatttacattttatacagtgtgtactttacactgatatttacaaagaggaaaaacaacagttttttacatgtaagaggagctccttggcagataaaagaaaaacttactcccattagtacaacactggagtttaaatctagagaacaagtacttcagaacctagtagaaaaagtccctgatttgtactttgtatgaacaattaggtttgagaatattgctatataatcacagaaaatactggctattatactacgtgaagtcttcagtgacaaagagagaaacagaaaaaatagttaatgccataacaatgaaaatgtggaatgtgaggaacgcccagtgaccgtaaatatctaccttaataagcctgacaatttgtatacagttcatgcaattaacaagtgtgataaatatgattattactctcaagttgaaatcaattttcttggctaaaagcaaagaattgttattgagcagatgggattacttttctttgccaatttatcttcataaaactcaatcaatgccttgccttaaaaatgtcaaataactcagatttcaggataacacatacaaactaatctcttctgcctgtctctacctgatcactccctacttcaaaagctccaacaacatagtataactgacacaaatcaaagcaaaaactatttttctcactgctacatggtcttatcaataatccagtatttcaatatctaataaaagataccacaattcaaagcagtaatgtgccccaagctaccgatccacaacatatatattgatatctaaaaatatatggatataacttgttatctactaaataagtttctttgcagtgtggtgttaatagccagaattttaaatacataaaaacttgggttcaaatcctaactctgccacttaaatgctatatgacaattggtcaagttacttaacctctctctggtctcaagtttcttgtctgtaaagctgtaatagcttttagagtgctcttctgaatattaaaaaggcattatactcttagcataatgtctacatagagtaaatatttaacaacaaaataacaaatattaggtgtgttattggagaattggagttttaaataaaggagttgtccctaaggtacattcaatttaactatgatatttaaaacttcaatttttcacattatttttccaggaaaatatttcactcttatttctccataatttgttttgaattgtaaaagagatttgcaagcggctgaagcagttacactatactgtatatctgcaggatgggcaactgattttttttttcttcttttttttttttttttgagacagagtctcactctgttgcccagactggagtgcagtggtgcgatctcgctgcaacctctgcctctcaggttctagggattctctgcatcagccccctgagtagctgggactgcaggcacacgccaccacgcctggctaatttttgtattgattttcaagatttgtcaagagctcctaatattttcttttctcaaacacatcttaggactaccatgcatatcagtcagtcagctactctggaggtctgctgcaaggatacacaccttccattcccacccatcagatacttgtctcctttctcccccactccaagacagcaaccttccagctctagataaaaagagctagtctttcttgcataagaacaacaaagacaaaaaccattttggtagtgtatactgcagattttaaccaaaacttctctgaagacctctgatttcctaaaaaacctcttcatcccagtgcagttgctctttcctaaatgagcaaccgcgcatctggtcaaatttggtgaatattctgtgctccagaaacaactgattccatcccctttaatctcttcttctcttatatccatctccctccttgttgtttctctccatgtttacaactagttcattgatttaaaaaccaatgtaatacacaaggaagtatgcacgacaatgtttagtgtagtatggtttgcaatattaaaaaaggccatcagtaagaaaatagttaaaggataaacttgatatacatactatgctgcaatttaagaaaactggtatagatttatacgtactaaaataaaataatctccaaaacatagtaagtgcaaagatcaatcacagaataacatctgtagtatatcacttttgatttttaaaaattacccctaattctaaatgttcatatatataaatattcagttaaaaattctgaaaagatactgctatggtttgaatgtttgttccatccaaaactcaggctgaagtttaattgccattgtaacagtattaagaggtaggactcttttttttttttttttggtgacagggtctcacttcaacacccaggttagagtgcagtggcatgatcatagctcactgtggcctcagcttcccaagctcaggtgattctcccacctcagcttccagagtagctggaactacaggcacatgccaccatgcccagctattttgttgtatttttttgtattgatagggtttcttcatgttgctcaggcaggttggtctcgaactccttacctcaagtgatccacccacctcagcctcccaaagtgctgagattacaggtgtgagccaccacatccagcaagagttgggacttctaagaggtgttaggtcatgtgagctttgccctgatgtaagggttaatcctgttatcactggagcaggtttgttataaaagagtgagacgtttggtcccctttcctctctctctcccaatctgtctatctctctcccttttgctttctgccatgtggtgatgcaacaaaaggacccttaacagatgccagcaccttgattttagatttcccagcctccagaactgtgagccaataaatttcagctcatgataaattacctagtctcaagtattctgttagagcagcacaaaatggattaaggcagatatacaccatattgtatccatcactaagtggatactttcaagaaagacagcaagactaaggagcatgaaaaaggactttctcatattctgaattttaaaaatattttatgacatgaatatatttatctattacctatgtaataaaactagacattaagagaaaaatctcatggtagaaatcttaggaaatagagaaaaattagagaaaattaagaaaaagcatgcataatttcacaaaccaatggtagccactgtaaaaaaatgttatttcattctaatacatttctacacacatatgcacacagtgcatttttgaaaacataactgagtcttttctaattgacctcttactctacaaaatttgaaatagccaaaacaaatttttgattcctataaagagatagcactagagctggaagagatggctcatgcctgtaatccctacactttgcatgactgaggccagagaattgcttgaggccaggagtttgagaccagcctgggcaacatagcaggacccatctctacaaaattaataataataataataataataataagctgggcataatggtgtgtgcctattgtccttgctacccagaggctgaggcaggaggactggttgagccctggaagttcaaggctgcagtaagctatgattgcattacactctacccagtgtcaaggaaaggaaaggaaaggaggggagaggaggggagaggagaggagaggagaggagaggagaggagaaggggaatgggcaggggcaggggcaaggcaaggaaaggggcaggggcagaggcaagggaaggggaaagggcactaggacctatgagccaacataggctatggcttccactagtacaacttaaaactcagctgaagacatgacacatagaaaagggttgctgtgtctgtacacacacacgtttcccatgttcccaatcccagtctgtggtcagtgaaagtgaagattgcctcagagcctgcattatctcaagctactgacctaattgctaatgctttactctggtctatttcctgcatgacctcagaatgtgtcagtgtaaattccatagtaagacagtagttgcacattttggagtgtggattctgctttgaaacacaaataagtgtgatgaacgtgaccctggcactctgtagccctcagtttcctcaacgctaaattgatcactacagttccttctagtgtaaacagtcccacgaagaatcgtgctgaatggatgactacataatggcctgctcctagagttcttaaatcaatccttaaaactggctgcaaaatgacttcactcctttaacagtgtgggacttgtctctgttctccagaatgctcaccagatggtgaagaagtatctctctacctaccaacatcgtcatattgcttcttgccactcgctactcaaaaactgtgaaaaacctgtgggagcaagtatcagctgaaaagggtggctttctccttaggcaaaagctacagggcaaaacgggggccccaaacttctatcacgtcaaagacatgaaacagatgatccctagttttgatcttctttgaagtttattaaaaacaagcttgaatctgtaccaatcctgacaggtgtgaatgtaagactcacaaatgagaaatgctaagctttcctaatgttcaatttaatcttatagaccatgaaacatgttataattaaagatctgaactattaatatgaaggagatagcatatattcttaccccaaatatgactaactaggtaaaatcttcaaaatataatcatggcctgattatcagccattgtggaggagaattttaaaaagttcttcattgacatcccaagtttatgttttagacacttctaatcaaacatgaatagattaacttcaagtaaaaattaatagtcacattattgattatcatgattggaaatgtatttgaccagaacaatgaggaaagagcatagagtcctgctatcttcaagtatgaatttacacttttaactgatgtcaagtcatccatagtatgaaaactcatttatttttatttgaaaaatttaaaaccatcaaaatggatagtgtgggagccaaataatatataagcaatattttatgagaactacaaaactattaagagcagtaactagaattcggttactgccgttccttatttcagaagagaaagtcaaatgttttctgatatttaagaagtaataacttcctgttgttcagttatgctttctataattatatatgataagcaacagaaaaataggtctggttttggctgtaatgtgtatattcaattcaatattaatttggactttaaatcattttgctatcaaatattttgaacctcatgaccaggaagtaatcaggtaaaaaaaaaaaagaaaaaaagtgggtttgttacctgacctatctcttaagttcaaactttctataggtatttttctctacctttgtccatatggttatacaattatcactagatgcttgaattactaaatggttttgtatatcttttcctcaaatttatatttgtcctattattggcttagtctctcaaagtattacttttatgatattgctataatggtcctctatagtataaagttgagcccacaccatttatcctgccacttaacaatgtccttaatgtagattatatggtttggccatgccctaaccaaaatctcatcttgaattgtaatccccataatccccatgtgttgcgggagggactgggtgaagataattgaatcatagggcagtttcccccatgctgttctcatgataatgaatgagtttcacaagatctgatggttatataagcttctggaattttccctgctggtgcttactctctcctgctgccctgtaaagaggtgcattctgccatgattataagtttcctgaggtctccccagccatgcagaactgtgagtcaattaaacctcttttctttataaattacccagtctagggtatttcttcacagcagcatgagaatggcctaatacagtagtatatcacacttattaaagagttgatagtaaaatagcactctcagtacaataagaatagaatagttccttttcatggtaatgaatagcttttcttcgacatctataattaacaatgaaatcagaaacaaaaagaagctgtctccactattactgaatgttgctcagaaaattctaacgtaagcaaccaaacaagaaaaccaaatatgctgtacaaatatttttaagagagaaggaaatcattctattttaagataaaaattctgtaactcaaaattcaggagaatcaactgaaaggtataaaaaaggtagaccattatgatttataagaaaggtcaaacattataaagcatgtatccacaacaggtttttttctatataccagttagaaaatagataaatgatcctattcataatagtaataaaacatatcaaatatgtataaataaacaacgaaaaatgtaaaactcttgtataaatattattgcaaaacatcactgaaggacatttttaaaaacttgaagaatatatctagtttcctacatgggaagagtcaatattataaagatatcaagtcttagattaatctatgagttaaatgcagttacttttgccctaaaatgttaaaaggctcttaattatgcaattcgaaatgtgatgtctactttcttcttgaaagcatttttcctggaaccttctgatgactctaacttaggctgcctgctttctaggcctactactacacagttgtcatactgggatttattttcataaacatctgggttggttccaatgctctttgtatcctaggttttctgtataggattcccgttgctttgttttgcttgaatatatcttcgagtaatacttccttttaattaggaagaatctgtaggaggtaaagttgtaaacttgagtccttccatgtttaaatacatctttagtttgtcttaacacttgatagtttgactatcaattttgggttctagttcttcttcctgagaactttgaaaccttgcctagtctgcattcacttctaatcttgctgatgagaagtttgatacctttgaaagatcctttttttttgttctctggaaggattaatttcttatacttagaattccaaaattttcatcagcatgtgtatacacatctagatatgtatccttttttccttgttcggtgttggatgaaacttttcaatctgaggacttgaattactcttcaggtcaaggattttttttctgttattttcccacatcctttcccattcctccacttctaccacattcttcatatcttttttacttttccatcatattttatatccttggctttttgctctatattctaagatatttgcttaattcaatattcaagaatgaatattacttgaattgcattttatccaatctttatatatacatatatattcagtattctgctatttatggaaatcagatcatacttaatggttatattctccccctgaatatctctgaaaatttaatattgacaaatttttcccacacttttcattgtctctgtttcttctggaaagcagaagataaattgtctcaggaaaataaatttgtcctgtttatttattagttcctttttgtttaggctactggtttttttgtttggtttggttttttgtcttttttcaaatgtctggtgatcctttcttgactgggaatatttgtaatttaagaactaggagtttcttaagtagttggcagggatatcataaggagctctgtagtacttataaactgcttataagcaacttaatgcaatttcaatcaaaatcttaatgggtttttttgggggggacttgacaagtagattgtttgtataatttagcacaacgatgtgagaataacccaggaaattctaaaaaataagattaagagggaatatgttctcccagatattaaaatgtatttcttaaaatccataataattataacatggggctttttgtctagaaataggatgtaaagattaaaaaaggaactaaccataaacagtagaagtggcatttcaagccaataaggaaataatagattatgtaatacctaggattctgacaatttagaaaatctaggaaaagaacatcagagccctgaaataaagtaaaataaattccataattattagagatataaatatatgatgtaaaatgattaaatactagaagaaaatattggtgttggaaaagaattgctaaggatttataaaatatatttatatagagactatataaacaatataaacatacaggctacatagggactatttaaacttctatttattaaaatagagtatctgtaaaagtaaaaatagaaatgaataaatggcaaaaaagtgtaaaaaacaaacataaatgaaaagttaatattcttaatctctaaagaacactctaaaatcaataagaggccaggggtggtggctcacacctgtaatcccagcacttcgagaggcagaggcagtcagatcacttgagtccaggagtttgagaccagcctgggcaacaaagtgagacacctgtctcctaaaaaataaataaaaataaaatcaacaagaaaaaacaaatcagcccacgaataaataataaaataataaaaagcaaatatgtataattgccattagacacacaaaacagattttaatattcttgaagctaaattaattcttattaaaacaaaatactatgtgattcatcaaataaagagaacaattaaaatgataaaatatagcaacggaaataatgtagaaatagagactgctgatgaagtatatataaactttctgcagggcaatatgacaataatagcaaaaataaatctttaaaatattgggcaattctttagtttgacaattctaattctagaaatatatagtaagaaaacaacccagccttgctataaagactctacacaaagatattcatcacaatagtgcttataatgtgaaatctggggagagcttcaaatatttaataatagaaaattgcttaagtgtagtatattcatgtaaggaaatgccattaaaatgttatatagagaattgtatttaatggtaagaaaagtgttcatgatgcaatatactgtgaaattttaaaagcagattataaaatattaccttcagtataatctcattgttgttagtaaaactccttctctctctacatacacactctcacacacagagacagaaaaattatctctcaatggcataattattgacagttcgttttctcccccttgcttattattattttgtaatagatatgctatagccactcaataaatatttgttactaatttcaaaaagtatgtattattatatccaggttgttcatggaatttatcatgcaaacaactaccctcttgagagagtcaaaagtggacactataaattatgaattcatataaactatatcaggacaatgggcataaactgagtgtcccaggcacggcaaaatgtgcggataccctggagatgtatcttgactttaagaagtttacaatctttcttggggatagaagattaaaaaacatgaaaccattagaaataatctcccacaattagttttgtaaaagcaagtgcttaattgtacttgacaaacattagatgttactggaggtctaagaagtaagagctgaatactcgtcagaaaagctccctggaggaagtggggactgagtgatacttttagaataggtaagaaaaagaataatgagaacttttcaaatggaggttggggttgtagaaggaaaagaatcaagtattcagaggtagctgataacgatgttgtatatataaaatcaccctgacttttgcaaggggtccgtctatacagaagagtaaaaagtaaacaatctattaacaatgtactatcactgcctccactttacacaggagaaaatcgaggctttagaaggttacataacctgccaagggtcacatagctaaaagtggagagctgagatttgaacctaaggagttggtttcagagtctatgctttccaccctatgctgtactgcccactacagtcaagctctggcttcttgtataaatctgatgtcactctttgtgggactgcttataacatttcctcacccagaatccatacctcctcctttctgctctgtcagagctctttgtctattcacacacagttcaaagaataccttctccatcaaatttttctaacaattccaatcttggaattctctcctaccttggagttgagaacaccactctcctaaatttctgcctacttctcagccactacttctcaatctctttgttggattcttctttctctatatttttgtttttttagtctactcattgcctgtgtgagtaccttcacccccaaaactacaatacctacctaccattgtgctgaaaaccccagcttacattgctcttccacattccataaatttctatctggatgtgcacagacacctcaaacttcatatttccaatactggcatttaccctatctgcagtttttactatcttatggacagcagatgccagaaatctaatcactgaaaccagaaacccatgtacaattcttgagtcctccctctctcaagcctaaaatcctggaagtcaccaagttctgtctattttactctataaataactattagattcttctttcatctgaactcccttagttcaagccctctttgtttctcatatgattattgtagtaggctctgaactggttttcctggtacctgtctttcccctgcctactccaattctacctccacatcaacatttctcaaatttgaggggtcatagacttccaaggacatttccacaatccctgagaagtatacagtttccatatgagaaatcactgtagctaaaagttaaatacttttcttcagttgattatgtatagctaaggcaataattcaagcattagtaaatacaaagccaaaatgcaggcacattacgcagaaaatgcctgttcttgggtttttaaaaaatacgttaaaaaaataaggccagatgtggtgactcccacctgtcatcccagcactttgggaggctgaggtgggatgattgcttgagaccaggagttcgagaccagccaagaaaacatagggagaccttgtctctacaaaaatttttaaaaattagccaggcacagtggtgcgtgcttatagtcccagctacttgggaggctgaggcaggaggatcgtttgagcctgggaggtcaaggctgcaatgagccatgattgccactgctctccagcctgggtgacagagcaagaccctatctcaataaataaataagaccacaaaggaaaaaaattcttacagagaattattgaagtataaattgtgtcaaaattgaagaatataataaaccctaagattaatagtcctgtccttgagaaagatcatcaagtgatgcccccatgctttaaaaaatattccaagctttttagcataatatctaacatttcttagcagttcctaataggttacttctctgtagttacctctctcactccttccccatcacctatagtgccacaatctgtaacctgtttgaggctctctcacacctttcatactgcaatatttgctcgaactattgacccccaaccttactcatctttcctttctaactaactaacttctcctcatcctcaaagccccagctcaagaattttcatttctggaagaatctctgattttcttctcttctctagtcttgaaatggtatgtgtgaacccacagcttgttgtaatgtcattgtcctttctgtttaacaccctcagttgctggtccttgaagtctgggactgtcttaatctactttaaagtcttcaagccaagtacaattcctaggcatgcaatacatgtttgttaaatagatggatgacctttatttatatttatctttcccttttctgctacaattagttaactcattcatttcttcattcactaataaccacttatctgttattttctgggaatacaaaaattcataaaacatcatccttgcctccaaaaaacactttattattgtgccatccttctctctctttctctttctctccttctctaattatctagttgtgtaggtattttcttcaaaggaataacaggtactcagaggaacacttatacactgttgatgggagtgtaaattagttcaaccattgtggaagacagtgtggcaattcctcaaagacctaaaaacagaactagcattcaacccagcaatctcatttctgggtatatgcccaaaggaatataaatcattctattataaagacacatgcatgtgtatgttcattacagcagcattaacaatagcaaagacatagaatcaacctaaatgcccaacagtagtagacaggataaagcaaatgtggtacataaacaccatggaatactatgaagccataaaaaagaatgagatagtgtcctttccaggaacactgatggagctggaggccaatatccttagcaaactaacacaggaactgcatgttctcacttgtaagtgggagctaaatgatgacaactcatggacacatagagggaaacaacagacactgtgacctatcagagggtggagggtgggaggagtgagaggatcaggaaaatcaactaatgggtattaggtgtaatatgtgggtgatgaaataatctgtactacaaaccccatgacacaagtttacctatgtaacaaatctgtacatgtacccctgaacttaaaagttaaaaagaaataaaaaataaacagaatagtagggattcattacaatatcttctctcctcctcataattcttaaacctgtgtagaagttcaatacatatttgtggaatagccttattacgcctttagggaatggagcaatgccttgcctattaatctatacttctatcagagtttcctgctgtatggaaaacctgagtgttacacttcaaacaaatgaggcaatttatacatttttgttgttgttgttgttgttgtttttggcataaatgtgctaagtgagctggagtttcagaagagaaactgaatgttatatgtgaatccaggtcagtagcttggctctgactacaatactgatttcattcaagataaggaaactaattggtatcaattttagttgacattatatgttagttttataatattcaggaatttttgaaggattatttgatttttatttttatagatgttcttgctctttaacactaaataatgaggaaagataatagggctaacatttattaagcatttatgttggacaggcactgctttaagtatttttatatgtatcaactcattgaattttcacaactcttagatctatttgatagctggggaaactgaggcacagagaacctcaagtaacttgcccaaggtaagccagctagttagcatggaccagtgattcaaaaacaggcagtctgtactccttacaactgtattatgctgcctataaaaggaccactagactaataattatgaaaccagatttttaatcttaaattagccatataatagtagagtgcatttaaggatgtcatctgagtttcattgtccttgtaccccttacagcctgtgagaaggaacctttatatagtctttcataaactgtaaagtgttataaattcaaagatttcttataatatgttaaaattacttttaagagttgagaagtccaaataaaagcagagagatgagaggaaacactagcactaaatgttcagacacccactgaccacgtcaagctgcacattttgttgctaaacctaagggagagattagatatgaggagagtgggaagcaagaaggtatgaagtctgggtatttagggactaatagaaatgattttctcgattagtttaagaacattagcaattacttacgggataagcacagttaaaggaatttctggaaggaataaaactataaaaattagtcaaattgttaaaatatcagaactgtgtaaaagcatataaagtttcatcatatctttcttttgaaaaacaaacaaacacttcatgttctagccagttgctaatagtgatcagttgatgaatacacctcatgtttcacgcatataaaattttacaccatgtctagtccataggcattagtgtaggagtcagaatacaacctgaattctgttcgcagctttgtgccttgtcgataaagcagtggacatctctccacagggagatatgtttcctcccgtgatatagaggatgttgattcacttgtctcctctctatttcgaaaagatgctctgaagattagtgagacaatggctgtaaagctctttgcactgtttacaacataaatcatacacagacatactggcatgagaaacgctatcatcatctcttttatacatgagaacaaccataaggaaaacaaacctcagagacagtcctgtattataaaaatgttgggtagagatgccaaaagttgtagggtaggaaacagcaacaacaacaacaagacggaatccaaagaatatttgcattctataatatattctacagagtctcagacgggaccttcgttgagtgctcccaagtattatcagtagccatgttttttttttctttttcttttttttttttttttttttggtaaaagggataaatagtgatgtcaggagatgctgcaaaatatattccagtgataagcatatggcaagcaattaatggatgaattcgcctctcttattgccatgttgtgacaaatactctaacttatttggcctttggctccctaaagggtgctcagaaatgctgtttagaaagtacttttcatgaagagctacaacaacaacaaaaacaaatacaattcaaatatctactaaacatatgaaggagtactcactctcattagtaatcagagaaatgcaatgatcccattatagagccctgtcatttgaaaaaaaagaaagaaaatccaagtgttttttattagaacgtggagcaacaggaattctcattaccttctcaaccactttgtcaaatgctttctgcttatctgctgaagttaaagatatgcatgacccatgaatccactcctaggtatattcccccacaaaaatgtacgcttatgtgcatcaagatacacgcacataagtgttcgaaatatctttattcataatatttccaaactggatatgttcaactgcataaagaaagaagattggacagtaaattgtggttcctttatacaacagaatgctatatatcatgatatatattatgatgtgcaatcctcagctacatacaacattgatgaattttacaactataatattgcacaaaaggagcaaaacacaggagtatctacaagatgagtccatttacataaaatgcaaaacaaactaaattgaactgttgttttggcatgcatacatacgtggtaaatcataaagaaaagtaggaaaagtaaaagtaaagtcaagatagtggtgacctatctggagaggatgaaacaggaaattatagggtctttctgaggggtgatcatagtaggtatttactttagaacaatttgttaaacttaaaatttaaattttacatactttcttaaattttgttatatttcacaatttaaaaatttataaaatgataattttacaaagcctaaaagatgaattatttgggggcttttacttctctttcatctgtacaactgctgatgaaaatcaccaggtgtgtataacatgaagcatctccttaaatgacatgcatttattgggaaaaaacacaaagtccaaatggtaaaatgttagcaaggtaaaacactgaagatttttctccccaaaactgccaaacaagtctggtttaactgaaattgacagcaaagacaacagagcacacttaattgaattttaatctcagtgatctctaagccatgtttgaaacataaacagacatgtcagagttctttatgatgttggacatgaattcattttcataattcaaaggcatactttgcttatgaatctctttaacaagctttggctgaatattcttttcttccagatgtttgctgttgtatacacacagcttccatctctttgcagatgatttaaaacatagttagaaagagtacatttatttaacaaaagagtaagagtacagaattcaaatagatcgtctgtgggtgtatataatgatgagtacataagtctcatgcagtcctcataaagacagcatctattaatctgaagaagtttctcttactaatttgcaaacctaaaagcattttacattactaagatattaataaataggtcaattaatacttttgatagagtagagagactcctaaataatggacatgaaaaatgattttgtaaaagtacggtttcattttaaatccctgcttaagcaatttgtaggaggcaagatagtgtggcagttgagaggatggtctctgaaatcagatctgaatttgaataccacctctaccatttactaacctaaacaagtcatattacttctctgtgtctcaatagctacttcctgaggtgttcttacaaaaacacaaataaataatccatgtaaagaactttgcacagtgcaaatacatagtgagcacgcattgagttttatttatcatcatcatcatcttgctgtacttttgtaaactcaccttctcccgtctttttctactctaaggtgctcttccaagctactttcctcctcagctatcgttcccctggatttccagtaagagagggtgaaatcatgcctgcttatcttctttctcttttactgatacttcactgaagtgaaagtaaaggaataaaaacacaacacacccacccacaaaggcacaaataataaaggaaacaagatcagcaaaggagagatttctactgattttttgaaatcagaaaatagctgaagtgccttagcataatcgaggaaatggttacggagagtaaattccaagagaaagtggactaatgtgttctcccgaatccagaaagacttactgcttggaggcagcagaattaaggaaggcaggagtttagcgaggggctgaaagtgtattaaaattatatggagcctttggatccaaactaactacttcccttacctactggaagcggagtctttcttttttggaggaaatcggctagagagatttgaaactgatgatactaggcactgtagcaaactaggagaggctgcaggttgcgaaataggtgcttatttgaaagcctatagagtttgcaataagaaacccaacttttttatttgtcatgctccccagacattagcagtcagttatatgccccaggcgcaaatctcgcaggcagaaagtggggtaccccctaatcatgaccttggggaaacatttcaaagaacacaccggctttgattgaacaacctatgatgcaacagtgcaaccctacagttgacgagccctatccatgatcacagaacttctgacattgtttcttgccatcattgtcattgttgctttgttttgtgtgtgtgtgcatatgcacctgtatatgtcttgcttttaactaagaatgaacagcctcttaaggaaactctccataatgaagaagagaaactagaagaagcaaacatcaactgaagaaagaaatctacaggaaagagagagacagaggaaaacctcaagaggataataatctgtgaccttagataaaacacacttctgacataagaacatataccattaaaaaggagaggatgaggctgggcatgttggctcatgcctgtaatcccagcactttgggaggctgaggtgggcggatcatgaggtcaagagatcgagatcaccctggccaacatggtgaaaccccatctctactaaaaatacaaaaattagctgggtgtggtggcatgctcctgtagtcccagttactcgggaggctgaggcaggagaattgcttgaacctgggaggcagaggttgcagtgagccaagattatgccactgcactccagcctggtgacagagcaagactccgtctcaaaaaaaaaaaaaaaaaaaaaaaaaaaaaggagagaatgagagtgctaaattatttttaaatcatgaccaaaataaacattttaatagtaaggttggaaaataaaaatgtgtgtgaacaaatcttctagaagaccaaaaaacaaaaagacaaaaaaggaagaaaacaattaagaaattaaaggatatgatctaggagatccaactaagataatgagaattcaaggaagaaagaacagagaaaatagagggcataaaattatcaatgaataagagcaaacatttcagaactgaaggactcatatctctggagtgaaaaggtctattgcgtgcccagggcaatggataaaaatgcagaccaagacaattgatcatgaaatgtgggaacttcagtaaagaaaagaaggtcacaaaaatttctacacagaaaaagatcaggatttcaccaatagaaaatactggagtgatgcctacaaaatgttcaaaaaaatacatttttaacatagaatccaattgcagttaatccatgcctgagacaaaaaaaggtttaaacaaagggctgcctctgaatagtatatagaaaagatttctgaacagaaaatcttaaaaactagcttttatccccaacttggatactaaatatagagacaggcaagaattaggggtcttcttgtcattcttctgagactctggagctcctgagacttctttttcactaacaccattgaatccgggaatcaacaagctgcacaaagttataaagattgccagacttcatgtttctggaaaaaaaaaagtactattttttcatacagctgagacctctgaaaagatggctcaatgggcaagatgccatgagaaatcaaagccaaatactcattctgaagtcagttttgctcagactttgtatactgccactcaatttttcaagtcatcagaaacataactaagaatgagtgactttttgctatcaactaatgacccaccattcaacgatcttgtatgacaaagtagaggagtatcttcttatttttaggcttattaaattacaatggaaaatattcattaacaatctcataatgaggcattctagatgcttattcttacctaaagggaatggaacaaaaaataaccaaaaactaaaaagatgaagacaaaagcctttcttggtattatagtattcttttacaaaggatatggtttatcatagtaattgattccctctgttacactagagatactattatattaaatgcctaaaggttaaacttaggtaacagtggagctatagttctttcagaaataaaataattaaatagctatgtatgccaagaaaccttactttgaacatttctattgtaccatctcattattgctggctgcctgattagcaagcagtaaacttgggtaatagctttcctctgatatcacttcaagtctactcgagttctagaattacccagactaccaggactttacttgcacaatatgctgaaatgtttataacattatgctttcccctcctaattctcaagaccattttgataactggctaagactggataatatcaacaaatatgaaataattataagaatcattctttcttaaaataagaagagtttccagaaacagaaactaaaacagaattcaggctaagctgctaaataggctatctcagggattctcagctcattcttgatgaggatagattgctttttatttcccttaagtgttccgtatttatttcacaaatattacttaactgtgtaccatgtacaaagccgtgtgctagttaagctggttactgtggaagaaataaagggagtgggagcatctagcttttttcttcaaaggagatgggggaatctgtgggagttagtggtaggggcacctacagaggaaatagctgaaaaggaggagctggggaagatgaggatgaggaactaagttgtgaataaaggaagggcagagcaatggtttttttaataatattggaatgggatttgtttttagcactgctcccctttcccttaacagtccccttgagctacaaataaatgtaactggcaaagtggataataagacttcagaatcttctagctaaccatgatcaatgtgtcatggagcccagtatacaaggagaggttctatttcatcaagaaatatgactgcacttttagtgggcaattggttgttatgaaggtccagcatttatttcttcttccttttgaaaaataacaccctgatttcctttggggaacatccccatggtcagatgggaccactgtgattgactgattggttcaggagaggggctatacccttaattatgtgggagctactagaaagagatgctctctttttttgttggacataaaaaacctggaaaggtatggcactagattgcagacattggtctgtctcatgtggatagagcagagaatgaagccaaaaatggagagttcttctgatatcaggcatcagggagaaaacaaaacaaaaaacaaacaaaagaataaaaatggagagttcagatacaggacccatagacagagaaactaaatcctcatgaagtgttctaattgaaacagtatctatggtctacctaaacctcatgggaaccacattaaatggcggataaagccattaatatactatacatagaagagatacatccacaaggacatcttaccaagtgtggacacaagtgtgtaacaaccacttattggtgtataatattataatccacaacatcagattttactctttaaattcactagggagtattctcaaaggaatggaagaaacaaagctggctatcagtgaggggcattatgtgggtaaatataagtagaaacttcaaaataaatttcttaaaagcaattttcactttctgaaagtttatatggaattggcaaatgacaaggattgtgatcattgatacatgcaagtcaacaagcaaaactaaccaaagagacaaacagacacatgaataatgaggcagttctgatgaccaaaaaacacaactttacaagactgtttgggtaatttattttgactggtaatacatcatgtcagtttattttatttaagccacagcaacgtttgtcttcctgacgatagttattgcattccagagaagtacaatacgaagtttcagactagtgctgggcttagtcacacagagaactgcagtaggttttctaagcccctgctcactgtatttcacaaaaatctcatcccttctaccctccactctctaaacacacatccaagcaaatcacaccaaggcataatcattgaagaacaccataacttgccaattaaaatttggcaaacagaaacattgaagcaaaactgaaaaaagaatcatgtaattaacttagaagaaagcttttttcttaaatattatttttcttcccattcagcatgcacaagaagcaaactttgagcactaacgtgttcctttttagcctttgcctgtttgtttcaaagacaagaggagaagagtctgcttaaaagccaaatacactgataaatgtttactgataaaatcttccagatgggactactttcaaggaaggtcaattacaagccttgtgtctctccttttaatgatatcctttaatgatccccttcctctcctagaaaattaagtcacaaaaacatcttaggctgagagtgacccagtaatcctcataatcacattgcaatgacagacaagaagatcaaagtacaggtgcagtgagaaatagggttttacatcctattataaaatgtgaacttgccattaaccaaagatcaaatgtacctttaactcccaaattcccaacttccaatattttttaaattctgtggttttctggattaataaactttctctaatataatattccccctcccaatttttgtactaaacattggtggttttttcttcacatatggtgattatgttttcatatatccaataactaaataattttagaaatttggtaaattgtgttgaaactctaatagcactaagaagttcccaagctagttggtaagctattgtctccaatactgcaaagagaaaacctagcaatggaaattacataaagataatctgatgctaatatgttagttagaaagtgaattaggcatctagtaatggcttcaataagaaagaggtttatttttatctcatattaagaaaatgtagcctgggcatgttggctcatgcctttaatcccagcactttgggaagccaaggcaagaggatcacttgagtacatgagtttgagaccagcctgggtaacatagtgagacctcatctctacaaaaaattaaaaaaaaaaaaattgctgggtatggtggcatgcacctgtggttccagctactcgtgaggctgaagtgggagaattgcttgagtgcaggaggctaaggctgcagtaagccctgatcacaccactacactccagcctgggtgacagagaaagactcaaaaaaaaaaaaaaaaaaaagaggaaaggaaaaagaaaagtaaagaaaataatctagaaacaggtcaaggttggaatggtgacaccatgtttatcagggacctaggttcctattatctttctgatccaccatccgtaacacatggcttccattctcaattctgccatttaggttacaagatggctactgatgctccagccagcaccagcaccaaatcactactacacaaacgggaggaggagtaaaagtgagtgcttctaggcaggagctccctctgctaacatgtagttggctgcatcaatctcttagaaagcctgagaaatgcaatcttttgactaggcagatgtcacccaatataattaagattcagtcagtcatctttattatattggttactaaatgaacaaatctgtaaggatattcagtcagcaccagcagtctttgtcacaccatagaatttctcaatcctggatggaatttggtctaatcccttacttacagaaagggaaatggagagcagaaagattaagaaatttcccccaaaggacacaactggttagccaaagaactaggtgcagaattcagatccttgatctatcagtaaagatccggttctttactggagcaaacttcagtgaggtcagcccaggaaattcagctaaccaacatgaacaaataacacatcttactacctgggtcagaccctgtgactcacacttcaggctttacagtcataactgctcatatgctgtaacatccaccctctttggttataaagtgagaatcaccatattcaccacaagtcatgtacatgtttacatggccactaaataaccaacaaaatgagagatgcgccgcaaaatgtgacagtacgagttactgtttgtaaaagagcagaatgttccacactcatgggtaaaaattggtacttgaacttcatgagtgactctagatcttttatggtggtggctttttaaatacagacaaacacatgattatggtatctcctgaaactgacattctcaaaataacatccactattatacaaaggaagtttgaatgttttgaggcttttttgcttttaagccattgctcttacctcttatctcttcttcgattatggccatcacttacttcctcagactccacccagctgcattctcaacaaaccacagtccaggatgagaacttctataatgcatatgcttccttcagcactttgagatacattattaggccctgctctcatgttttacttcttttatgttccaagcttcttgagggcagggccaatactttctttattttccataacacccctcatatgaaaaagattctagcattctttcacaatgtcatgcttagaacattccaatatttttccaacctatctcccaaactgcttcccatggttccactgattctcttctttcacccctactcacaacacagggtacccgagtgattgctccaaaatacagaacacagcaagccacatttctacatctttggcggtgcgccactgtctataaactttttaataaggtcgccctaacttgctttctcacatagtcttattccttgccatttcctctgtttgcgccctacatactgtaagttactccgaaacattcatctttttctacatgcctgtgactttgtacatgtagttccctttgtctgaaatgccctttcttctttcgtttatggagattccaaatggtctccaaggtatatgtcaattattatccatgaaaggttttgctatatatatccagtattttctgggggatggggaagcttaaacaaaaaaaacttgaacattactctacacacagtccattatgacatcttagtctatttggaaaactccactcgtgtagaaattgtgtttatttcagttgactgtgaatacaggttctgatgcacaggagctactcaatagtttgctgaatgaatgaatgtcagttttcctaaacagacttgaatgattttcttgagagtctaactgcttgtcatactacatcttgtctcatttgattctagatccacagaagctagcacagtacttagatgtaaaaattgttatatctcttttgtttttccagttaatcactggagaccagggctgccctttcaataggaaatctaatatctctctttttgaaaactacccctctttcaaataacccaagaacctcagggattattcagtctaaagcagagtcgtgcttctaaacttcaggtgtagagaggacggcaattggtatgaaggcttctgccactgccatgtggtatcacagtgaacaatggtcctgtccagacctgtgtccttgctggtttgggtctccatgcccagccttggactccaagagtttggctctttgatttaactcatttagtaaagatcagccctcactcaacaatctaagatgctcttcttgagcaggcagcttaggtttccccttcctctacacagatacattaatccctctagggcccgccgtatcagcattctctcccgacaatacaccatgggactgccctttttcatccattctcatgggtttcctcagtacttctaattgtgggacaaagtgagaaagtctcttttctcctggtagactcctgaattcttaggtagtttggtccacgctatcctcaaactgtaccaagaggaggggtagcttttaataagaagggggaaattttgtcacactctttctccaaagaaaaagatgacaggccttatgtttatatagctaagggaatccacttaatgatttttccaaaaataataaatacaaaaacccctagcaggttttccaatagtagagttagaagtggacagtcagatagaatttctgcctctccagtcaccctcttacataggcatggtaatatttattgaaattcactataaaggcaaaactggatgaggacaattgagaaactcttgtcctaaatatcttttcctgactggccaaggaaacagtgagtctaataatcaacttttttttttttttaagtgcatagccctaccagtccaataagacaaaaaagattcattccaaaggaaagatctggcatttcagggtcacatttaagtaggagaggatgcatacaataataagatatttcaattagacgacaaagtcagccataggacacagtaccagtagtgtcttttccactaagaattggggaagggaggcttaaaattcaccttatgtttgtttaacaaacataccagggaatccttccttcaactgtgcccatcgagttgagctacacacatacaacataatccaggggagactgccccaaactgaggctttatttactaatttgcagtacctctgaaactgttaattttttccctacttttttttttttttttttttttgagacagacttttgctcttgttgcccaggctggagtgcaatggtatgatctcggcttaccacaacctccgcctcttgggttcaagcgattctcctgcctcagcctcccaagtagctgggattacaggcatgtgccactactcctggctaattttttatttttagtagagatggggtttctccatgttggtcaggctggtctcaaactcccgacctcaggtgatctgcacgcctcggcctcccaaagtgctggggttacaggcatgagccatcgcgcctggcccctacatttttaatgcctctaaaatccagacatgtttttataatcaatggcaccttggacttgatgaaataaagtaatcaaatagttttaataaatcaaatacctttaaaaatataaacaatttaaaaattgttctaagacccaggttccaacctcaggatctggatatgaccataatgctatattagcatattaaagcagagacacagacaatagcggtaacccttcaaaggggaaaaagcctgtcagctgaagatgatagaggaacccagtgcttctcaaagggggttccccatccagcagttcatcagcatcagcatcacttgggaacttataagaaggaaaattctcaggacccaccccagaagtactgaatcagaatttgtggggcatagggctctgtaatctgtgttttaacaagggcatgggtttgagaaccactcatatggtagctaaataaagaagacacttggtcagtatatacttggcatgcctggggagggggagcataacacttaacagccgaatgttaagactaccataaaaggaggaagaatctcaaaacccaatgcaggaaagccctttaaagtctacagttcctagtttctgactccatatatgtcaaagcagcttctaattagaagtttgtttctcaaggggctgaactacaaggacagaatgaactgatctggccaatatggtatcctgtctacttgtcaatatatttctcactgtgaattccctaattcatgttcttgctcttgcataaagttcatgagttctgagtgtcagtgacagcacctgatctaattgggttctgagaaaatcaattctgaacctgaaaaactaaaggtcagtctttgaaatttgtatatattacaaagacccagtccaaaagggcccagaacatacctaatactcatttaaatggagtatttaccaggtcaagagaagtgaagaattaagggcaattaggtcaagattgcaaactggcaatcctcaggccagatctggtccacagatgtgacttgtttggcccacacacgttgttcaaaaatgggaagtttcgcattaaatattggatttcttccagtcttaaaaaagcaaaaaaaaaaaagatttgacaatagggagcccacatcctggcacttgagcactagcctggagctaggcagaagctgtctcctttaaacaggttgtagcttccaggtcaccccagtcccaggaatctttattgacttctggctggcaagcttctccctttatgtgaatatgatctgcctgacccctggtttgagacgagtttgaagacctttgagctacataatcatttttcatggaacagatcattagactgatttgaataaaatgaattgctcagaaaattagctttattttgtacctttagagctatttgtatgtgtgagcagggatgtagaggttagttacttttgaaaacagacagtgatgaaggcaaatgttgccaggcagagtataaagagaaccagcctgggctgtctagacttggatctgccacttactaaatgtaaaactatcccacagccgtggtttgcatatccactaatgggaatgataatatctactatacacagggtttatagtgataatcgaattagataatatatgttcgagactatatagaacctcaaaaatgttagctgaattaaattttgatggttttgttttctgaattttactttagaaattgttcctaacagattacaaacttttgaaaaaacaatcaaaattaaacctcaatagtcttacattgtgatcaaataatggaattaacatttattgactgtaaactatgaaccagatagtatgctgggtgctttaaatacattgtctcatggaacccataaagaattactgagttagtattatctatcttttacacattaaaatccaaggctagaaaagtttaggtaatttaccaaagtcacacagtaagcgttggataaccaaggtccatcttactccaaagcccttacatgtgtgattactgtagtgtttctcaaactaacatgattatacgaatcgcaggctagtagttaaaagcgtaagctctcctatttatttccaagcttactgaaccagaatctaaagggatacatagccttgaaatgtgccacattttaccacagccccatgtaattcacaacagcggcaaggaaactgcttaagaaagctgataagaatcaaagtaagtagaaaaagaattactttgcgttttattcaatagaagaaaggaaagaaagggggaactaggaagaaaaggagggaaggggagggaggaaagaaggaacaaaggaaagagggaaggagagaggaaaagaaagaaaggagggagggaaggagacaggcagaaaatgtcctggagctaaggcctatggcatttgaaggatgatgtgaatgcacttactagatggatgctttctttctaactgcacccagcctgtttactgcaaacataaggaatcagccaacaggaagctcagcttgccactgcagaggagtaaagcactttgaactacaggcattttgtacacccaaattacatactgtgatacacatagtatttgagctgttccgcaagacagaagccaattattcttggcacgtacttctgtcgtgctatccaaatcaccatccctcacatgtggaactgtgccacatcaaacgcaccaagtcacaaattccttaaactctttgagatgaaagtcaaattttggagaaaaaggatagtctggtatatacaccatatagccaaaaagatgtgtgcttaacttagaactgctgggtctattatgagaaaccggggcagcaaaattctgccttaggaacttttcagagttttgtaaactgaatttttccaatgtaattcagtattatcattgccttttctaatcttagttatttcatttatagtattcatcttaaaataattttccagcctctccctttaaatgtttttaagcacagtggaaaaacatagacactaaaacaaggagtagaggttgtaggtaccatcaaattctattgagaatcacagaaactatgcataagtcctgaatggtagcattatttgataatcagatcagttagttaacccactccccttaccccttacaaatcctgaggttaaaggatttaatcaaaactgtcagatgatatgaaaatagaaatcaaatgataattgttaatagtattataaagaatttaaaacataaatcctgcaagattaaaaagcagaaagtggggtattagatgcaccagctttgtgcttcttaagctttaaatatgctgtggaaactcctagaaatcttgttaaattgcagattctgatttagttccaagattctgatttctaacaagcaccgatgtgactggcccaggggtcagactcagtagcgagtgggtcaatttaagaaggcttgcattggtgaagttctagagatgtgatagagaatctccccataggagggagtgtgacctaacactagtaatacctagaaataaaatgtaaagatgaaagacagatggaagtgttcgtgtaagtgtccagttgctccagaagaaattggttacctatgaaatagaaatataatcttagttttaatgtgagaagaattctaagaaagtaaacagatttacaactaatatataattgggtttctcaaacttaagactctgatgaggatactggatcatccacccagaaaaatacagataatgtacatgcacatactgcacacacaattctttacacagtttcaggaagttcactgagcttcctttggaaaggtgtgaactacctaagggctcatatcacaatttaagactaccaatgcacatgtgtagctggtatagaggaacaacttgtagttttaagactaattgatagagagggcagattagaatctgcttatgtgtttgactgatgatgttattgcacaaaggcttatgatttctcagtcacttctgtaaaatataaactggttgaaatgtatatttttccaaggtaagacattaagtatcttcatattaggtaggaaaaaaaccaccatgttaggccgggcgtggtgactcatgcttgtaatcccagcactttgggaggccgaggcagttggatcatgaggtcaggagttcaagaccagcctgaccaacatggtgaaaccctgcctctgctaaaaatgcaaaatcagccgggcgtggtggcgcatgactgtaatcccagctactcaggaggctgaggaaggagaatcgcttgaacccgggaggcggagtttgcggtgagctgagatcgcgccattgcactccagcctggggtacaagaatgaaactccatctcaaaaacaacaacaaccaaaaaacaccacaccattttacaaagttaaatatatactactttggaaaaaacacaagacaaaaatccaggtttgaaaatgactgcacagtacaggggtttctgaagatgtaaagggcaattgttgttttatgctggtagcatacatcagctttttttctccaatagttttgaatatcccaccacctgcctttttaaactagtgagaaattataattatttagagctgtcatttaaaagtcatagaaaaccagttaatgttttttgaaaaaaacagttattgatcacccaatcttagataagcaacttaaaatctaaaagcaagctacatctgtgtgtgtgtgtgcttgtgtgtgtgtgtaaagttatatgtcaagacataatatgaaatatagacataatgctatgagagtgctgagggcatttttctttttcttttttcttttttttgtttgagctggagtcttgctctgtcatccaggctggagtgcagtggcacgatcttggctcgcaacatccgcctcccaggtgcaagtgattctcctgcctcagcctgccaagtaactaagattacaggcattcaccaccatgtctggctaatttttgcatttttagtagagacggggtttcatcatgttggccaggctggtctcgaactcccaaccttcagtgatctgcctgtctcagcctcccaaagtgctgggattacaggcatgagccactgcacctggcaggagtgattatttccaggatgagataatagagatgtatgaaggaaatcactgagttagctctgagctggattcaggatgagtaggatttcagtagaaggagaagtagaggggaggcatttcatataaaggaactcccaaaagcaaaacattatagagggtaagagtggagggaggaatatgctgtttggtctaagaagagaatgatatttcatcatacttgtaatattactacttgtgtaggctcttcttgactcggtttgctttaaccaacagaacacaaaaaattggccacatgccagttctgggcttaaacattaagaaagcctggcttttgtgttcttggcagccctgagttgccagggaagaaattctgactaccttgctggagagttcacatgaggaatccacatggagagagagaaaagccatgagactacatgaagaaagaaagaaagcaggtcatctcagctaagcccagcctccagtctactggagtgactgcagccatattggggaccatgggtaagaccagcaggactgcccggctgagcccagcacagactgcaaaatagaatggttgtgtttcaagacatcactttctggaatagtttgtttgcagcaatagaaaactgaaactgagtgtttatcaacattttaaatcactactgccttttgataaatacaaaatgcgtaaacccaactggagattcagatgtagcactgtccttctacactcactagtcaagacttattttgaattttattattttgtatcctaatcctaaattttgtttaggatacaaaactctaggtttcttctttttacaaataaaaactattataaaagtaaataaccatcaaaaaccattccctgaatcacctcttctattgctcctccttaacagtagcactttagatggattagtgtacatgtgtatgtgcacacatgtgtgtatgtgtgtgcatgtgtgcatggtaatatttggtcatagggaagattaagaaaaggattagggctaaaaggctgaacatagggtgatatcttcggttttagagggaacctaggacagtgtttctcaaaattcttaccttaaaaaatattggccaggtgcggtggctcacgcccgtagtcccagcattttgagaggccaaggcgggccgatcacttgaggtcaggagttctagaccagcctggccaacatggcaaaaccccatctctactaaaaatacaacaacgacaaaaaattagccaggcatggtggcaggtgcctgtaatctcagctactcgggagtctgaggcaggagaatcacttgaaccagggaggcagaggttgcagtagtgagtggagatcgcaccactgcactccagcctgggtgacagagtgagattccttctcaaaaaaaaaaaagaaagaaattaaaaaaaacaaattcataggaactcaatgtgtgtgtgtgtgtgtgtgtgtgtgtgtgtgtgtgtgtgtgtgtgtggtgtaggcctgcctatccatactgaaacagatttataaaagttattccctatgcgtgatacattctcatctttttctactctattccagttctttttttcttactgatagttgtgacccactatatcagtttcataatgcacatagaagttgaggcactcagatgaaaaacactatctaaaggggcattaatcattaaaaaaaattcgttaaatcctgtatgtgccatacattgttctagtcccttggataaaccagtgataaaacaaacacagttccttctttcatggacaaaatagtcattaaacagcaaccacaacaaaacatgcacaaagtatgatttgattacattcataataaatgctgagaaagaaaagtatgggtgctataagaagctctgataaggagacttcactgaatctggagcatttaagtggatcttttcatggatgccaagttaaggaaagcccaaagtaatagaggtcaatctttagaacatttctgatctgccaagggctagcagaggacaattgcaggaggtcgctgaataagccaagtggggtggaagctgggctgacactccgcccaatcctaaagctggctttaggggctggtgcatgctgtagcctattgggcccagctcatattaatcctttccaacaatttttggcttgtgggatctagagaggagaggtcaaggagcaagagtgaagtatcccccttagagtccagaagtaagagaagtaaaattatttaccatctttcaggggcaaattatgagatccatctagagttatgaaaaactgtgtccaagagactcccaggctggacgctgacagtaattacttgaaggtgttaacatatttggaaaaagaaagttcccattagaatgagggtggttggcaagtaaatcaaagacaaaggagacttgccttgtgctgcccatggagagagggagcgcctgtatgagcctcgagagtgtgcccatcctcctgtgatgatctccctactgctcacatgcatgtcctaggccctcaaaactatgaccactgagccttctgatcatatgtaaatctgtctattctaaatccatgttatgtactatttagcattctaaacctacccataagagggagaatgcgtatgttggcaaggccaaaacactttgtagcttttaaggaatcagctgatactctggctttaaggctcttgtgagcttttgagagtttgaatcagcttactcagaggctgtgacaagatcacctttctgagactgcttggttgaggacagattctggaatatagttaattctccagggaaaacactactctgtaaggacctgtctgggtaaccaactgtctttccctaggcgatacccctagtaactcctaacctccaactacacaccattttaaatttaaaatttctacaaggtagcagctccagcatgtacacagcacacagctaactgttgatgaacactgcctaggcattgtttcaagcactatgtagattatcttatttaatccttataccaagggaggtgctatcggtattcctattttaccattatgaaaactgaggttagttgagcaccgtggctcatgcctgtaatcccagcattttgggaggctgaagcaggtggatcacttgagcctaggagtttgagactagcctaagtgtcatggcgagacccgatctttacaaaagatacaaaaattagccaggcatggtggtgcatgcctgtagtcccagctacttgagaggcagaggtgggaagatcgcttgagtccaggaggcagaggctgcagtgagctgagatggtgccactacaccccagactgggcatcagagctagacccagtctcaaaaaagaaaagaaaagaaaactgaggttaggaagcacaaggtctcacagctagtaaatggcagggctgggattcagggcagcctgattccagactgcaacctttaaccaatttatgacattgctcctgtcaatgcctccacacccaggaggatttgaactatgtcaaaaagtccatttgttcctaaactgtggcttgcaaagctacttttctttaaagggagggagggaacaaatgacctctatccatatgctgtgataatctatacacttttcttggtgtctcatagaacttcaatgttttctcccttgggatattcaatgcttcatgcaaactagtgagaagtggctcgttctctaccccaaatcccaccttttcttcttctggcttttctgtggtctcactggggatagttcctgcagattttcaacttgtttcaatttgcctccttccaagctatgactatgcaagcatgatcctggaattgcagaatggtcaacaaaatgctggcttattctctggggaaattctacagttttctagggagatcatagaaagctatttaggatcccactttccaataggctcttgaggttatgattgttccctggatgctttctattgtgcaactgccctaatgtacaactggccatttatacaaattcagtttataactaagacattgttttgagaaaaaaaaagccatactttctttcttttaaaatactgataaagtgtgggatgtttgaatgtgttctccacctgcatttttctattctaaatcccaaggggaatgagacagagaccaaagccacagctttccaagaccacaaagcttgaggtctttgatgttccttatcttctgagtgaaactttcaattatttggcaaagaaaacaaggctcttaatgggaaaccaaagaagccaaatcatctgtgtaacagaactgagtacatcgataattcatttattcaagaatgtactgagcaacctagcatggctgaggcactgttgtgtatatatatctgtatcagtgaacaaaataggcgaagattgttccacatggtagtttccagtctagtacaggagagagataataaacaatagatatagtaaattatgtgttagaaggatagacatgctatgaaacaagcactcatacatacaatagagcagacattgggaatggtattaatgtgcgatgcatttaaaaaatgggatggtcatggatggcctaatggagatgaaacacaagcaaagacttaaagcaatggaattggccctaagataccgggggaaagagcacttcatgcagcaccaaggtcttaaaatggaagtgtgactgatgtgcttgaagatcagcaaggaggctaatgggctggagctgagtgaatgagagaaagaagagttaaaaagaagaccagagatgaaacaggggtcaaattgggctacacgttgtgggccacaataatcacttttaactctgagggaaatgggagccattgcaaggttatgagcagaggaatgacatgatttgcactgactgctgtcttttgaatagactgttatgcagcaagaggagatgcagggtctcctattagacagccactgcaatcatccaagccagagaagatggtggcttgcaataggatggtaaccatggagatggtgacaaggatgctgggctctgggtatattttgagagcagaggcttcaggagttctaatgtattagatacgagatgttctaaaaagagtagacacagggatattctcaagctttggcctgagcaactgagatgaagaatttatggttagagcacattgtgtgggaggcagttggggaaatctataattcaaccctccctcccttccttcctctcttctttctacccttcccttccttttttctttttctcttcctttttctttcttttttttttttttgagacagagtttcgctcttgttgcccaggctggagtgcagtggcgcgatctcagctcaccacaacctctgcctcccagatttaagcgattctcctgcctcagcctcctgagtagctgggattacaggcatgcaccaccacgcatggctaatttttgtatttttagtagcgatggggtttctccatgttggtcaggctggtctcaaactcccaacctcaggtgatccaaccgccttggcctcccaaagtgtctacccttcccttcttccctccttgttctcttccttccaccttccctcacttccttctttccttccttgcatgcacacctgcaaatgccagacattatacccagtgatacaacagatacaaggcatcttcactagcaagccaaatatgaatgataaaataggggtacagaagtagaattgatggtaggggacctactatattctattattcctttcttaaaaatttagattctgatatgagatttgaataattcacatttctgaaccataactctgaaaatacatcaacatttgcacattgattcttcttcaaaaatcatgttaaacctaaacttaggattccattattaaattgatggtatgttttttgcctactctgttatcaaaaacacatcaacaaatcaaaataatcaccgacatgaatgaaacattcattactacatcttagaaattgtgtcttttttgtttctctagacactatctatcaaaatttctgaaaacttagctaactaactgcactatttattggttttattctaagaaacataaagcgaagtggtacactctggtagaaaggatgccctagggtacaacaaaaggcagataagcattgtgttaggtgaccaatcttggaaacagactgccaaaggtggactcctggctctgtttcttactacttgtgtgaccctggcctagtatttcactcctccgggcctcagtttccacaactatgaaataagaacaataatgtatccaatctcacagatttgtggtgaggattatgcaaagtccttaaagagtgtggcacatagtaagctgtccataaatggcattacatattgagatattgagtgtaactaggccactgttactgctactaccatacactagaaaattctctcctccctttccaagagctaatttttatcactgatattatatacccttttgggggtcattttcaatagtcatttcttaagaaaaaagcaacaagagaaataaagttgcaaagatgatgtaaatgtttaacattattagttaaataactgctagaacatgagcaactacaaaaataattttgaagtatactttgatgcagaaaaattttttttttgttaaatgggaaaaatgtgttatagcagtaagtcaccaaatatgatccctttaaatatatacaagtatacaaacatttggaaggatttaaagtatatattaatggtggcaatccttacatggataaatttatagagttttgatgcttttatgacgtatttttattttattttctgaacatgatagctgggtagtgtcaccaactgagatatataaggaggcacaaatttagaggaaaagctaaatttggttttggatatgaagaattttataaacccatgggatactcagttgggaatttccaataaatattggggttccaagctttgcagaagaggttaagatggatttctatataaatttaggggctttcagcaaacaggtggtaattaaaataagaatgcacaagtcagtcttggaagacacacagagtgaggaaagcaggaatggagaatgggatcctgggaaccccaggtcaaaggaagggtggggggaaaggaaaagaaagagtgtacgacctcatgcaaagatggaaaggtttttgagagggatacactggcaattgacttagagaaacttgatgagaaatgaactgaaaaatatctacttggtttggcaattgggagagcagaggaactacagcagtagttgcaacagagtggtggggctgcaagctaacttcaagggggtagaggaataagtggggggaaaagaaaaagaaaatgataagtgtaaactttctagaagtttgggtgcgaaaatcaatagagatatgtggtaataactgatggaagatacaggatcaaagaggaagggaattttttccttaggaacttcaaccagttttgaaggagatgcagccatcaaagagtaggtcaaagaaagagggagaaggggcgatagatggagcaatgtccaggaggagacattgaaggggatggggattaaatttgggggtagtcttacttttaagtgcactaaacagaaatcttaccataatatagaagagcaatacagattgagcaaaatataattttgtattttttgatgatttggggtcatcagtttgaacaccaaaaattatactcagttgtccagacaggatgcgctcagtgtttccaaagatgggttgagcttattgcccctttcaaaaaggccccaaatagctatgtctgtggttttcaaatgattttgtagattttctttttctgttgttgttttcaggccatcagctgacatttggctaatatcagttgtgactttccctgaaatctcctacccagcctttcttaatttgcttcatccaattatagaaggtttagaaccacatgaccaagcttgtatgaatcatcactaaaatatgaacatacatttctctggctaatgacctacattatcttcagtgagtgaacattgtgaacatctattttgagtgcttagagacctcctttgcttccttccttatgctgatctatgttctagaagaaaggggacactattagggttgcaggctaagttcttaatagttaggatgtatattgttattaataattgaggtataatagatatcatgcttatcaacacataatgtacatatagagaaaaggttaatggaccactctgagcttacttatcaaagtctactgctcttccacaaaacctacatggtttgttgaacaatttcttcagtcttctgcaagccataatctatgattacataaataattaataatagttttaaaataactttgcaatgattttggttgtttagatccccaacaatgtaaatctcacaatcttctggcagatttataattattaatggaaaacacatttcttatctcagtcgatgaattagcgtttgctgtagtcctaataaatatatatagtaaatataatatacagccaaaaaatgtgtaaacgtacaggaaataaaatgggaatctttgtccaaattcattagcaacctgttttcagcatatatagtactgaaccacattataatgttttttgagcacatatattcaagaaattaaaattgtataaagcatacaattccccattatataatcagagtaaacaagaaggaatgatttccaggaagctcatcccttggattgttttctatgtatatgctacatgtaatttatattgtatgacgatgatacaaacgaattttttttgccttctgaccctgatttcccaaactttcacagctcagacctgcagagacaggttttaaaaacaacatttggcaagaacatgtgcaaacgtgatcaatgagcatcgaggtacacgtatattttactacctttcctttcttactcagagtgcttttaaaaatcagcataactgcaataaaaagaacccacaactgccctattattgaattacaaagcaatgtgtgtcggaaacacccctcagcattttaagagggtcaaaaggaagatgctctgcacgtactccacggctgcaggaattctggtgaaaggagataccaacccagagctgtttaaatgatgacgctgcagccaggcaagaagtagagaaagtgactggaaagctggattgcaggcagaacaaggaatggtgggggtggtgacaaagtggactgcgaaaggacagaaatgacagcaggaatgagaaggatttcagatgtgctactatgatagacgtcccattccaagtctccatgtttcaagcaagtttttaaaaagtttcaagaaagatgactttctgcaagatgagaggttgctttaggcacctaatttcaaataactaacaacagctggtaattattcaatacaatcattagcaacaataacagcaagactaaataccaataaaaatactttatagtacacagtggctccatgtgccagttccttcatcttaatttctctacgtttagccactaatttctttggcttcacagtggctttacccaacatcccaggatacaatttctcaccacagaagttacaaatttccaagattactgctgaattgaattactctcacttacatgaggcaggtctcttattctattctggggtctcactgctatcaataattcaactttttataaaaacaaaatcttccttaaaaattgcttttgtcaaaacattgctatgaccatctgtttttaaaaaccattaatggctgtctactaactttaatgtaacaaaatgtattagtttgacagaccaaggctttcatggcctaaattttacctggaccctccactacagacggccacacttgtcacacacatacatgatccaatatttgtgcatcacggtgggagtgtttgttcctttttatttacatttcttatctataagtcccaactcaagccttacttccccctggagcatttcctggctaagctggctctcaactctctcttcttctttgtagtacttatatgactttttggttctattatttgacattgagaactgcagaatcgctgttgcaggaatatgctggaactggatcttgttaagtgttaaagattcaagaattctgcaaaagaactgttgaaccagtggtagcttggaaccagccatgggaggagtatttgcaccatggccatagacaaacactgcagatcaggtttttaactttttttttttttttgtgaggggtggtgggatggtgagaaaaggaggaaggagaactggcttgctagcataccacacaatagattgtcaaattcttcttactacatttaaaatattttgtcaactctctactatagctttccagtataaattcaaatgcttccgggactaagtaattcatgacctctcaaggagttaaattccaacatggacatgtatctatgtacacacattaaagtgtaggctccataatagctagctattttgtattcttcatggtgcccggcacagtgtgtggtaaaaagagatccttctacctttctagcctcagtttccagggcttacattgccctttaacttctggccttattgaaccttggaattgtttcttgaacgtatcaggtatgtcttaccttggtaactttccaaaggccacttacttgccatggctggcccaggctgactgaatccctcctgccactgagtgaccctgtggctttaacaggcctttcaacacgttgtattttaattgtctatcaattcaaccacctctctgctatacaataagctgcttaagtgttattttttccacctgcgtatctcatggctgaggtccccagcatatagaaggtactccaataaatatttattcatagtgaatagagcaattcaaacaaattaatttatataaggtaggtctgctctagcacttttccacaatattgattactcaaaaaaaataggcctcatggactttatgacactgttgcaactacacagcaaccatcgaacataaatttcaaagaggagagagtttatttacaattctatgagcactttaagttttgctttcttcccaggcactgagggagtatccctgaggttgttctcctctctttgtgtttagatgtctgtacttgctggtatgcctctgtcctctttctgccctgcttccacaccaatggcagacgcaccacaattcaagtgaaacctggtttatccccaagaagtcttcacagttgttctgttggtctctgcttaataccacacaaataaaacttaggccagaggacttgggagagtgaatgaatgaaacaaggaagaatggaggaaaaaatataaaagtaaagtaaggcatgagagaattgtataaagtggggtggggaggatacaatttaaactgtttttaagaaaagatataaaagtaaagtgaggcatgagagaattgtataaactggcgtggagaagatgaaattaaaaaaagcttctgagaaccaaatgaggttgtaatactccaaaattcttaattcaaatgttcttcctgcctcctttaaggttcaaaagatagctggcgtgaccatattcacgaaagtgaatttctctttaaattgccaaaatcttattatcattattattactattatttttggtttacagatccaggaatctttctaatgatggagaagcaaaataagaataaaatgcattttataaaaatcctaattttaaataccaagagagaagaggaaatttatgctctctatatattgtataggggctaccagcatatggcctctgtccacagaagtacatttatctgggaaattgaaataattatttagtgagctcaggcaaaagtaagttctaacaccagagcagaggacatagcctaatttcatgaaagctgatttattattgtttataaaacaccaaattgtcattacattttctaccctacgtataacttgtgtttttccagtggtgctaatatgacaaaggaaataatggaagactatcataaagaaagcttaaaatatggtgacttttacatcagtaacactatttttcaatcattgagtcctgctgtgcatcttgacattagctcttcaatcatactccaaatggagtaaaaattatcagtagaggaaacattctatgatccatttcaattccactacctttcccactgttcatattcagagaaatggatatgaagtgctagagacaagagcagaacaaattaaaattctgctttttctgtgtgtcattgctttttgagatggggtcttgttctgctgcataggccagtgtgcagtggtgggatcatggctcattgtaacctcaaactcctgggctcaagggatcctccaggctcagcctcccaagtagttgggactgcagacatgcactactctgcttggctaatttttttattcttagtagagtctgttccccaggctggtctcaaactcctggccttaagtgatcctcctacatcggcctcccgaagcaccaggattacaggtgtgagccaccaagctcaatcaaaagtcctacctataaactaaagttccacagagactgatggttaaaaatgcaaattgaaatcaaatcagcaacactctaaaatctgaaaagattcattatttctccaccagaacactttttataaacaagctgaaggttactttaattttgttcaaggttgtgtcctacctttctttgatctatcccacagcatatagtcaagtggtagccccatgacgtgcacttcactaagaggaggtcagagttatccattcattcattgattaaatacatatgaatcaagtctatgtgtcaggcactttgagtatcaacaattccaaaatcaacaagacacaatgtaagctctcaagaacatcacagtttatggtagccaagaccatttttaaaaaaattgataaacatctactctgatgtacttagtgcccaattctttctccctttctctttaaaaaaaaaaattattgtactgctcaaagcaatctacagattcaatgcaatccctatcaaaaccaatgtcatttttcacagaaataaaaaaaaacttaaaatttctatggaaccaaaaaaaaagcacaactaaccaaagcaatcctgagcaaaaagaacaaagctgaatatatcacactacctgacttcaagatatgttacaacgctatagtaacaaaagcaacatggtataaaaacagacacatagaccaatggaataatacagagagcctggaaacaaatccacatttttacagagtggactgatagatttagagtagacagagagcataatgatagatacatttgattttctataaaggcaccaagaatatacattagggaaaggagatctcttcaataaatgatgctggaaaaactggacacccataagcagaagaatgaaagtagacccctatctctcaccatacaaaaatcaactcaagatggattaaagacttaaacataaaactgctagaagaaaacacagaagaaacacttcaggacattggtctaggcaaagattttatggctaaaacctcaaaagcacaggccacacgaccaaaaatagataaatggggctgtattgaactaaaaatttctgtatagcacagcaaagcaaacaatcaagagagtgaagagacaatctattaaatgggagaaaatatttgcaaactactcatctgacaagggaataatattcagaatatattaggaactcaaacgtctcaatagtaaaaaagcacacaatcccattaaaagtggacaaaggacataaataggcatttctcaaaagaagacatacaaatgtccaatatgaaaaaatgctcaacatcactaataatcaaggaaatgcaaattgataccacaatgagatatcatcttaccccagttagagggctattattaaaaatgcaaaaaataataaaaaataaaaaaaaaataacagatgctggctaggatgcagagaaaagggaactcttacatatcaccagtgggaatgtaaattagtacagccactatgaaaaccagcatggagatttctcaaaaaactaaaaatagaactaaccactatgtccggcaatctcactactgggtatttatccaaaggaaaagaaattggtgtatcaaagagatacctacatccccaagtttattgcagcactatacagaatagcaaagatggagaatcaacctaagggtccctcaacagatgaatggataaagaaaatgtggtatacggccaggcacagtggcttatgcctgcaatcccagcacttttggaggccgagacgggcggatcacgtggtcaggagatccagaccagcctggccaatatggtgaaaccccatctcttcttaaaatacaaaaattagccgggcatggtggcactcgcctgtagtcccagctacttgggaggctgaggcagaagaattgcttgaacccgggaggcggaggttgcagtgagctgagatggcaccattgcactccagcctggatgacagagcaagactctatctcaaaaaaaaaaaaaaaaaaaaaaaaagcaagaaagaaaggaagaaagaaagaaaacatggtatacacaatggaatatgattcagccataaaaaagaataaaatcgtcatttacagcaacatggatggaactggagatctttatgttaagtgaaataaactgggcacagaaagataaatatcacatgttctcacatatgcaggggctaaaaaacttgaactcatgaaggtagaccgatagataccagagcctgggaggagtgtgtaggtgggaggggaggggatgaagagattgattaatgggtgcaaacacacagatagaataagctctaatgttccatagcagattaggtgactagagttaacaacaggtattgcatatttcaaaatagctagaaagaggacacacaggcatgataaatacttgaggtgatggataccgtaaataccccgattccatcattatacatattgtgtatgtaacaaaacatcacatgaaccccataaatatatacagtaattatgcaccaacaaagataatttactgaagtgaaattcatatcacataaacttaaaaatagtaaagtcaagaattcagtggcatttagcacatttacaatgttgtgcaaccaccacctctatctagttccaaacattttcaacattccaaagtaaaaccccttacctattaagaagttcttttctcaagaccacttttaacttcaatgtatgggaagccttcatttcgaaacaggttttgaaaaaaattctatgcccacaatcacttaacttaaatattagaattgagactaatggagtcaaagagtcctgtaacatcagacacagcctcttagggtttttaaaatggcattctgcattctctgttttttttgtttttttttttctttggttttggttttttcagtctgtcaattttccagattcctatctcccaaagccggtagatgtctcctttgatccagtagctaaggcatggttgaactgatcatatttataccgaatttccaaagatcaatcaacgagaattctcgggtctatgtgcttgtttatttagccctgcctctatgcctgaacttcatctggaagtcacacatagtcttctttctgtcttcagccatgagcaatagtgtatttgcactaaaaacgtttccatggcatcttcttctttatttaattttctatcagcagacccttctttgatacttcctttttctgcccattctggtaattcagttgactaaaacacaaaactcttcccaggtaatctttgtttccctttcataatctgccgtttatacatctacttaattcataattttgctaaacatctccaattatttgttcctacattgttatcttgccatcaaaatattgattttaatacctgtgacccctccagtccatttaaaatattaattaccaagtttcctgccttggatattggagttcttaatactaacatcaaaccaaatgttttatcctcatttctaaagctctactccattgcagacaccgtgacatctaacacttagcagatagaaaaaaagtatgccattgtaaatctgaaaacttctgggcttgcatgtcagagactggaagtggtttgtttgaaaggagcttatactgaggcagcatagcataacacagtggttaaaagcaagtctgtgaaagtgagaaagactggggtccaaatcttggctctaacacttctaagctacgtgactctgggcaagttgcttaaattccctgagcaccagctttctcatctgtatgatgtaaaaaaaagagcagcactgtttagtaaacatggtcttggctttataccacttcctaatatttctacaactgtcaagtcaatcaacatgttaccttagaaactgtggaaaaggtataacctttggaaaatgtaatcaggggggaacaacttttcctagcccaagtccagcttctggttctgccctgacaggtatctgtaagttataatgttttactaggtcttcatttccttacttataaactgagggaggttgagtgaggagttctatttgtttgcattttggctctgcaattcaggggttttatttgacacgtgaggaccaaggagtagaaaggagcaatcaagtgcagtggtttggtcaagatcacataaaaagtcttgctgtaaaaccaggagctagtcctaaactgctcaccagcaagcttgatttatactcgagtagaccatattctcttgctcctccagctgcagctccactcctcatttatcttagcccaggctgactctaagctgctttcacttctacctcactgcatttcgccctgataattttgtagcttacctagcctccctctttgagatcccttcttaaaagggtcattctattaacctacccatatcagttactttactactgctgatctatcgctacctgtcaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaggttgttctggagaggatggaagaaaaatgaggctggcagtgatggtggggaaatgcaacctccaaaattatctatctatatatttttattaaaaacacccacagtaattatggcaaatgttaatgtttgtttgttctaggttttggatacatttaagatctcttgctttctgggtacatttcttttcttttcttttctttttttttcaaattaattccaaaagacttatatctgctacatgaagaacgaagcaagttcagctctcttgctgaaatgttcaaatgctgaggcaaggcctgtactacaaatttgtgtaaccaaaaccacagtgctctcaatgctcctagtgttgcattacagcagttagaagagattgagctattttgtttccatggctcattaagctagagttagactggtgtccataatcaaatttactgcacttacccttgcttcttccctatgaagtacagccagaccttagggaaaatctcaactattccaggtccatggtaatttggtccacgaaagaaattaacacacctgaaaaggattaaattatttttccttttcaaaatgatcctcttccttaagcttcctctgtcaattgactgccaaccttatttgctaattcccatccctcatcgggcttcctagcacttcctgctgcaaattagtgtgcagtgaacctgagcctgctctccaaaacacatccagactcttggggctttctgggcttccgctagggtgcctggtgcaaagggggcctaaatcaatcaattaaggcctgggaagattccaggcaagaggaagggatatcttgggggacaaaaggaatgtgtaggtgggaagaagggagaaagtctttcttcgtttttcactgcaggaaatgatctggacagagagcaattcgaatcatagacagggagggttgggcaggatgcgatgggggagcgaatgacagacacaagtgacaggaacaacttagggagacaggtcagaaaacatctaatctaggcacatagcagaaatagtgaagggaattgaaacagttgttctgtattttgttcacagtgttaaagtcaaagtcagtgctttttaacctcatgggatggagcgggggagggggcacaaggagccttgtgtgaaggctctggctctgcttattgatcccccaaatacaataatacatcctcacaatcataaatttgagagcaaggggctctgatcctgtgatatacaatctaggcccttattggatcctggaactgattttcagaatcctttattcttttaagtacaattgtaaaaaaaaaaaaagagagagagagagagagagagaaagcaaggaagaaaggaaaaaaggaagggaagaaggaaggaaggaaaaaaggaagaaaggaaagaagggttccatttataaacctcagacaaaacaaaaatgaaagcaaaagagaacaaaaaatagccaatacgacccaagttacaaatttacttgtatcctttcagaggataacccaaattcctgcaagacaattagccatctttctttcgattattacagtaagcaagacgggttaagagtatatagtaaatgtgctttgctaaactccttctccctttattgactctatcacaagaagcacacttaatataatttttacaattttttaaagaacaaataggaaagaggagaaggttgtactttagctacctttgtgtatttgaaaggaatgctgttcagggcttcttccttttcaaaaagaaacaggtctttgaaaacgaagaatcattactgtgcatatctctcgagggctgctcctctagtatcagtccatttgaaataggagtttcacataattcaatttattaaacccacatttcctgccagattttgctttatgtgcctatgtccttttgtttcccggctaacatttccacatctcggaaatcattctttctagtataactgaagaatatggatattaaaatcagatcagcaaaagatttttatggacttggaaagctgcccattaatgccgtaaaataaagcgtgttatacagctgatatcatcagttctactctatgttgttttcatattcctggcggtgggtggagagttagagtggaacaattaggagtgggaaagagaatgaaaggattcgatcaattgtggaatttcaaagcggagacaatttacactaaagaattcaaagacttcgtaacctccaagacattttccagtccaggtaaccgttgaattatagctggaggtgatgttcttggagctgcctgtgaaagctgaaatcacaacatgcctgcagtgttcccttcctaaaccaactttgccattttctcaggcagacacacaaacatgcaagcgtccacagtaatgtgcgtgtgtgagggatgggggaagagtgattgttgctttgtagtagctcctttgaagtgtttaattcctcccttgtaatctcttcatcaacacacatttaaagcatatcagttttacctcagcaatttgattctcagaggcttatgtggctcagggcctctgtccagcacctgggtggcacagtttgttttatgtgcatgcagaagtgttaacagaattaatttttttccttctttctctctttcttcttcccccacctcccccaatttaggttaatgagcccaggcagcagtgtgtgtgagtgagcgggcgtgtgcacaggagggccgtgagcctgcctttttaaaatacaggaaacgcatagaagaaagaagagttcagctggagccacgacttccctctttgcttctttccctccccacccccccaccccccacctcaccccccacactccagcaccggcttttaattttcaaaagcactgcaattgcttggtgtggtttcaagagctggggtgccattctccctgatgatgactctgctgacgtcaatggcattcttatcatgcctagtgcgacatcagaaaccagtcctcagaggctcctcttattcacagtgcctgggctctcagcaaaatgtggaccggattctgaaacgcaaaggactccccgttcctaatcagcgctgcaatccaccagacagtctccttctgccggcagcttgccagttaagactttgttccttagcgttctgtcctgcaaggaccccctgaaggagaagagagggctaagtggatcacagcgtgtcctccgtgtctgagctttcagagccgtgtgtgtgtgtgtgtgtgtgtgtgtgtgtgtgtgtgtccctcaaccaaggttagagactagtcaatgctgcttctgattattcttcaggttttactaaaaggcttcagtctttgatataaggctattcccccgacacagtggctaagaccctcttgtgtaagtgctcctagctcactctctggatcagaaccagcgcccaggtccccacgtgaagcccatattcaccccagatggcagcatgcacctcctctcctttttttaataaagaaaaagaaataggaggttgggaggagaaggaaaataatcatagctgaataataatagcagaataggaaaatagtatcactaagaattaaatatttcactctaaatactcatgacttgttaagaggtctgctctcaaaagctgaattcacaagggagttaatacatactaaacccagtatgcattcctacctagcagtttgggggcaattattatggggatgatgaactttctccatttacagtggagtgtattatggtccaaatctaccctaaagcatttgggaaatgtctacagttcaaattaagatgtttagagtcaaggtcatttcgcttgatgatggaatgatacatgtctagttagatttcatctgaccaatctttgacacaaacacatcagaattgtcttggtatccaccaaccaaataatgtttgtttctcttgaagattgctgagtgacccatagtaagcttattaggagattaggagcaactgttccagagagaagctgtttaacaacatatgaaatgtgcaacataattccatctagaactatttagaatcataacatggaagaacagcagcttacacctggttcaacccttctacctttaagtgaggaaactgatgcccaaaggctgcgtcatgctttactcaaggtcatccacctattaagaggcaggactgacaaactaaagctgtctctctctaaatggtatgcttttcctactacaacacatagctcctgattattcaaaacctaatgaccaaacctcaaacccacttgccaagggagtttccatttttcttttaaatctgagcaatatttcttaattttttgattaaagtgatatttcaggaatgtttagatgaattataatgagtttctcctttgttttcagtgagtttcacaactagtgtaaaggttattaagtagaatggaacaaaataatatatgttggaatgcatgaaattcagatggttttgttctttgttattttttgtagagacagcatctccctatgttgcccaggctggtctcaaactcctgggctcaagtaatcctcctgccttgcctcccaaagtgctgagattacagatgtaagccactgagcccagcaaagacgtgtttttaaaaagtgatgatgggctctgggaagaaggagcaaagatttatctgggttccaaatgtatgagctccctgagcccagccatcattctgcttcatctactacatagctctcaccatggtttgtaacattgcttgctaatatattttatttgccacctaattcaagccattaagttaatattcgattatataaatatgatctttatagttactttttccctatccccaatagttttgccttctcttcagaggactgtaactgcttctataaatcaccttttgctactctctttttggtagacgtgcatcacattctggtcgcgaatggtgaggagatggggcagatgctggttttagagtcagacaaacctgtgttggaaacctggcttaaccacttgctactatataatttcaagacataacttctctgagcctcagtttccttatctataaaatatgaccctaccttgcagggttattgaaagggttagagatgatgtttactaaagtcctatcacaatgcctagcacataggagaaactcaatcaaggataattttattaatgatttttaaaaaataaatggggaaaatcataaaattaataaagattagtaagattgaacaaaggacatatagtatttccccccttataaccagagctgttcctcagtaccactaaaattggaaggacaatatttctttaaagaatttttctagtgaaaagctaagccaaatatatgatcattggcctgcattatgaatgcatgtttcactgagtatctgattataattggatgtcaaatagctacaaaacctaattgtggtctcaaaaattgtctcttctccctgagacaaacatccaatatttcctaggtgataactaagctttgtgtacactgagataagacgccaaatcaattccttaaacttaaaggcacaaaggtttcggaaagcctcattgtccatttgagagacaagccacggcatctcgtaaagcacattttcactgtatactatgttactacaaaattgagttaatttcattaataacaaaatttatcaaaataaaaatgctttctcctttgcaggaatccataaataacataaaataataatagcattttaactcagaagcaaattacagccatgactgtttaagttggctaacccaaatttcgtaagtgaaactggagtggtctgcgtaagtcctagattgcatatgattcagggaaacccagatgtcaaaagggtgtgtgaatcaaaagaaggtattcatcttggtgatttagccctgaaccaatcaattcttcccagagcactggagaaaaagttcttgtttctaatggaatcatcctgcccttacctacctagtaaaaattttgtacccaatcaataccttagtcaactttaaattcctgaatagcccttctgcctcattcaagtgaatggaaagaaaaggtttaatcatatttaaatactccagactattgagtaaagttaaatgcaaatttggtcatgttattcccttctttaaaaccatccattcattagtgatgatccattcacctaactatgccctcagcaggcagggctgttagcctgaggaaggggtgcccttttctatttcatccagctagaagatggccctttggaatctatctgctcaatgatattgtatttctagaatataaaaaagatgccttaaatatacaaaaggcacagggggagtcctttttaggtctcagtttaaggctgatttctgagttggttatatgctctcacagcaatttgtatgttgccttcatggtgcttaaggcagttcaatcatacattttgtttttctttcccctactagagtataaggtagaaattgtgactatatttttcactttcgtatccccaactccatcccagtgcctagtacacaagtaccaggtactttattgactgatacacaagtactagtgaattaaaaaattgttatataaagttgggttgttgtcttgtccaatagtagctgtgtttcgcactgcaagtcatttttgagagcatatgaaataactctatgtcctcatgaatgactttatcataatcattcctgaacagcacgggcgtgtggtattccaaaagggagttttactggcccttggttaaatttaaagaaataataaggccaatttaaaacacacacacacacacacacacacacacacacacacacacacacacacattaatgagagatttctaagccccccatgggagatgactgccctttttgtccttgttttgcatattaaaagtatatagaatgtggaaaataaatgtcataatatgaaatcatggttccagtatatgttagtgtgttctgttgaaaatagttttgtttggcaaaaatgaagagttggtaattgtatgttgggcctcacagttttttgttttgaaattccaaagtctgggaaccattgacttagcagggttttcccatcagaacacagatttgagggtttttaaggatacatgtcttagtttctagtcgcgtatggctccaacctacaatccttccttctttcgggtcccacctttattttttacttttctgatagttcccacaactttgcccacaaagttgccaattcctaaatattattatcaaagtgcaattttgtataccccaaagctaatatataattaattttactataagagaaatcagttaaaatgtaaaaagtttaataatatacattataataatggccctggtacactcccccaccgttctttggaataagcaaaggtataacccttgaaagtaaaattaacttttctttgcacatattagacttctcaatggtgtgccaaagagtggagatgacaggtgagccaagctattgatttcccttggctcttgtcgctagtgggtgggagactgaacacaagccacatcctttatttactgcagttttcgtagaaatatagttatcagcgtatgtcatgaaggaacaaatgtggggaagtactgacctaaataacttttacgtgattcagtatacatgtaaattgaaataaagaatattaaatctcaaaactatccagaggaccttattcaatggtataatatttcaaatttaattttttattacagtatattttcaggtacagttttaaaaatggggagcatgcaattaacgaatacataaaaataacactagtttaatcttccctttaagaaaagttcctgtttgctattcctgttacatatacaggcataggacttcatggcctttaagacatgttgataatattaacatttccacttgattgtgggaagtagcattcattttcagctttgcttagagcttattaacctgatgtcaacaagatatactagaaatgtccttgtcagtccaaacccacaagtagaaatgatcatgttgttgaatgtgttcagtctgatttgacaacggtaacaagtcaacactgttctgctaaaggaaggtcaatcatcccattgcaccagggatttctttatttcttttgctaacattagcattatgaccagtgtatgtcaaagaatacattgggataaaaaattctgcttgtccatttctgtttttccattctcttatgacttagagaattgaaaaattaatctcaatttttttctgtctgtaaatatacaatatatatatacacacactcttacacaaaatctctgaaaatgctgtcacatgcatgaaacacaaaatgaaaaaggtagagattttttcataaacatgaaacagaaaaaactttcctcctcactacaattcatagctaggattcatgattttctagtaagagtagcaaaatggatgccgattctatggcatagaagaccaatggctttagacctggattcaaattttaactctgccacttcctagcttggtgaagataagcaagttaagtcttagttttctcatttgtaaattggagtccatagagtcgtgaggatttcacaaggtaatttatttgaagcatttggcacaacacctggtacaaattaggaactcaagcaacagaagacacagcattaaaatacagtgcactacatcaggacattacaaaagcttaatttaataaatctcttgtctgattcattctaattctgctagtatactgtagaaaagtacactaggtcctgtttgtggcctccccaggtcagctctgcccaccctaccccttgggcataagccactctcccagtttcccaggcatgccacagcagccccagtaaagcagcggttatcactgcaattgcctcatgttttccacctccccatccttgcgggcttagcgtgggcaatggcctctgacttgacaggaaccatccagctacacgtgagatggacaaaggctctgtattccccagggactctgggagggccaagggtaccatggagcaaactttgaccaatgagagacaaaagacctatgcacagaaaaattgctcaccctttcttctccatgtggaatgttttacgacacagcctcacaggcaatgtcccttgtaacttagcaactagttttgttgttgttgttgttgttgttgttgttgggaagctctgacaagcttagtaatgcattaccttgtacatggtttctcttcttccctactgctgttcctttcaccccctcaactccacttttgctttcttgggattgcatgactcacctccctcataaagctagcatgtaagctgtccctagggaatttgatcaaaaactgtgagatttagaaaaaaagatgaggcaactagatacagtacaagaatgaaagagaaaaagtcataatatttgacatcaatttacttatctatgattccttggattctctcagtagtggaagctcttaagaccacattaccaccttattaacaaagaataactgataaaatcaacgggacaatgggcctttgagaacaaaccatcattaattttgttccacagagtccaatttcaattataacctaagatatgtttggaaccacttaatgctattttatgagagagagacagttttctctttgaaaagtcatgttcctttgaatttaactaaaacgtaacaggatgttaaaacgaaaccctggcatttttctttccttcagaaatatgcccacattttatagagaaagctatatattgaggttctgcaaacaacaaaatgcaattttcacattaaacatggattctaacatctggcatttctcctagtgcttgcacataattatccaaaattgcagtttttccaacaggggacccacagtggtagctctgattcattccacattatatatatgaccctttctcatagtgagggtggtcttcaacaccaatgctcctgactgctatcttccttcaacttacatggaatacttttcctcatggctccaaatgtatgagctctaggttgttattcagggttctttcatcctcattttttgtaccttttatgactactttctgaaaaggcacatttgctgagttggcgcctcacaggtggtttggtttgtggcatattttaatagctatgaaaccatgagttcagctattgggttgcaatgagttacataatgcatgtgcaattcagtgcgcaccaacaagaagattttcctaagaccccaaatgacccaggaaacggacacattgaaggggttgcacctcaccaaatgtccctgacaaggatgcacttatttggaaggatgtgcccttactctgaaggctggtggtctgaggagagtagatgtggtaatcatccaactacattaaggcacatttatttctgttgctttttggttcattttattttgatttggtttgttttctgttcttagcaatcagtccattttatgagtactttggcaagtagtagcaaaagctgttttctctaggaaatttttaacctttcaaacacagcagagatgttagggacattataaattcaattaaatgtggtccctgtttctggggttgatggtcataaccatttttctttttcttaccactccagtttaatttacttggaatgaaaaaagtaaatctgagcttctgaggattatcagttgagattctgggcctttaaacacaatcctctctggtctggacttatttgcaacccagcacttccagaaatgcccatcattagctcaggaggatgaactccaaataatccacgttctatttatctcattattctctatatttatgtattcattcaatacgtatatctcccatacgccagcactatgcagatgatagggacatcattttgaacaaaacagaaaaaccactgcctgaagatactgggccatgaaattctgttcaaagatatgttttggcattcattttgcaaatctctacatagcatgaggaggaatgaaaagaataaattatatccttcacttattcatgcattcgttgtccatttatttaaaaaacatttattgagaatctattttgtgataggtactgcaccgaatgccaggaaaaacaagcataaaagatacagggtgtccagaaaccatctgaaaggatgaatttgactactcaaatattttaaaagactaaatgataaaaaaaaaaaaccctaaacaaattaaaattttttgaaaagtttacacaaatgaggagagttcattttcttaatatactcaaaacattaacatatccataaaaaataaactcctcaagataattgattcaatgagtctttggaggtaggagggaactggcccataaatgtatgaaaggtgactaattttctttgcaattaaattagatggggaaaatatgttttttgtgaatctcagggtcagtgtgtatagaaatacaagcatttcttgtgatgatggtgggattgtaacttaatatattctttttagaagacagcttggcaatatttatgaaaattttaaattcagtttcacagctaagactttattcaatgggtaaactcacaaagatgttcaggcacaaggatgcctgcagtgttatttgtattaattgtagtaaaaactggaaatgacccacaagactatcaatagagttaaatgggtttttagacataacataatgcaatactatgtgtcaaataagaatgatcattatctctagatcatgatctgtataagtccatacaaaagggccccaagatacactattaaattacaaagagcttggtgcagaatagtatttgtaatactctcttggaggatatgcaagaaactattaacactttactcccgacagtcatgaccaagcaattagagttgccccaggtaacatctatttgctatcctgctctgtcacataacatttactgtaagtagagctctctctgagaaatgtgctggtccaagctctttgaatatttgtatacagttaaaatcacgaagaactgaagatcactgcaattttcaaaggaatgaggactttaaaaggacagcagcagcaagggaaaggtagggtgaccaacttgtcctaatttgtccaagacttccccagttttagcactgaatgccccacatcccaggaaatccctcagtgccaggcaaactggaacagctgatcaccctcacctgccttggggctgctgcagaggcctaagcatgaaccgtagacacaagagaaactgagaaactttctttctgcccccatcctggcttccctgtacctctgcccagatgccaaagagtcctcctcactttcccacagccacaactcccgacttcccttgcacctctgtcctttggtacaaagatttctacgtttgcgttagtgatgtgacctcttggattaggatttccaaaactagaaatgtttttggagtttatgtagggttttacaggagaaaagaagctattgtgaaagaactgtgagggaaggaattggatataggaacaaaagttattttgggggctagaaatcataaatctaaatgggttttcaaggcaaagaaaaacttcatggtatagataggaaaggatacagtattattcattagaaaaatggaaatggtatctatgaaattaatttagatttaaacaagaatattttaagagggaaagtttcttttttttttttttttcttgagatggagtctcgctctgtcgcccaggctggagtgcagtggcgagatctcagctcgctgcaagctccgcctcccgggttcacgccattctcctgcctcagcctccctagtagctgggactacaggcgcccgccaccacgcgtggctaattttttgtatttttagtagagacagggtttcaccgtattaaccaggatggtctggatctcctgacttcttgatctgcctgcctcggcctcccaaagtgctgggattacaggcgtaagccaccacgcccagccttaagggggaaactttcaagagagaaaaacgccaaccctgagggaatatgggattaaaaaatgtatcagtaatttatatgcttctgacactttctatgtgactcagaatactctgctgggaatagctaatggcagaaaatttcaattattcccagttgcaggtgctgtgttgtgaaaggcacaatagcccctagcaaccctaacgaggttaaaggaacagtccctgaggaatctcactgttagtatccatggcaagagaaaagctaaacactggggatacatattacttcacttttgtccctgaaattgggcaaagtttcagatttgagaatggcatcagaagtatagctgtttagtgcatgtgtttctcatcatagtattgatattcatttcacatatattcccacagtaaccatttactgaaggaaagccaaagccattttagcttgattacattttctttttttggtttgttttttttagacggaatctcgctgtgttgcccaggctggagtgcagtggcacgagctcagctcactgcaacctctgcctcctgggctcaagtgattctcctgcctcagcctcctgagtagctgggactacaggtgcatgccaccacacctggctatttttgtattttgagtagagatggggtttcaccatattagtcaggctagtctcgaactcctgaccttgtgatccacccgcctcccaagattacattgtctaagacttcctacagaaagacaacttcatttgatattattcacaagccatctagtctcttgccttcaacatttttggccatgtagtgggtgggtgtgctcctttttgcactgatagatcagcagccatgccacttttctaaaaccatatttattttgccccctgtatcatccattcagtcatttaaccaatatttgctaggaaatgagtgagccattttagcttgattacattttctggggtttcatagatgactaagatgtagcgtccactctcaggagttaaggatacattaaggaagacagataaaaccaactaatattatgacattgtaggatgaaagaggtgtgtgaaagatttatgaaagtatagaggaggaatgcttaaattcgggagaaattcaggaatagctatctcaaggggcaagtaggtaccctgcagtttctataaaaggtgaaggtagggaagacttacagggagactgaacaatatacgcaaaagttacagaggtgtgggagagcttggcttgatcaggaaactatacactgcaggctagaatcaatgagtgctttggaaggaaggggatgcacatgggagaaaggaacctagaaaggtaagtcgcagacaatgagggaaaggcaaaagacaggacatttacatttactgagcttttattttgtgccaggctttttatgtttggtatctcacacaattactccagtaacttcctgacaatgtttgttactccattatgcagatgaggaaacagaagatggggaaggttatacctgggctgacccattttttgaggccaggtgtatctaataccaaagaccctggtcattttaccgcagaacattgtttctagaaggaagtttaaactttaccctgaaggcattgcagactctgatggacatcaacaggagagaggtatgatcataattggattttattttgagacagggtctcactgtcgcctaggctggagtgcagtggagcaatcacggctcactgcagtctcaacctcccaggctctgcctcccaagtagctgggactactggaacctactgccatgccaatttttttattttttttatttttatttttggtagagatggggttttgccatgttgtccaggctggtctcaaactcctgggctcaagcaatctgcccatctcagcctcccaaaatactaggattacaggtgtgagctattgcacctggacttaactccattttagaaaaaaactaaaaaactaaaaaaactaaaaaactgtcgtgtggaggaggaggaactgagaaactgggggcttttcctaggatgacagagaaacattttcctgcaacaaacttcaatgtctaccatcacatacatacaagtctaagtttcataggccttgatgttgtcattcttgcatttatgcctagaaacatgtaagtctgagatgtaaattgcagaactaaagatgatggattccagaaactctgatccacctaagagaggagtaggattgtggaaggcacataagggtaaaatagtatcacatttctaaacttgaaaaactcaattcaaatatgtgcagattcagtcccatatgaacagccatgttggctagaggacatcatacttctcaagggcaacagagatgctgggagcagattaagtagttataacttgcacctgtgtaattactatagcgagtcacacttctgtcaaatgatcctattgctttaaaagtttgagatgatgcctggtctaagagctttctttagctgcatgtctcaatgtggctataaatttcagtcaagtcatgtcctgcacattgggtctaattaaagaacacaagagtgagaagggcagggtatacactcagggatggtggagttagtttatttcttggatggaaaatttaacggtcattataatgcctctttgggttggaaatacagattcttatgtacacattcattttgcacaaatgaaaatggtaaaccaaaatcagagagtgttgaagttcttaaactaaagactaccttatagtgagctctagtaaagaaggttagaaacaatttttaagaaaatttaataacaatatttcagagaaaaatttgttactgaatattttccagaaatagtaacaagacatctgtattcaagtagatacaagtgattgtaccagagggtcaatattttgagatggcaagcacacattcttatcataaagatatggtacaggaactagaagagatgtaatattccttgacgtgattctgtcataaaaggttaacaatgttacatcttagggccaaggagacaatcctttgaaggttgcaaaggactggctagagtcaggaatcatcagcgtattcctttaaagataaaaattatatatatgcatacaagtgctacttttaaaatcaggaatgatcttctatttttaggggccaaagagaagagttaaaaactataaatggatatttgacttatgtggcagaagaaaagttcagaggtttcaggatctgcaggtgagaagaaaatgtaaactaaatggcaatctgttcagtgattttaaaattcctaacaaaatgcatttcctacaaatgttgctacctgaaaagtaacaattagacatccatttatttgtacttacataataaaaatatttcagagtaatgtataccactgtctaagtctttctgttctttatctgtagccaaacctacttgcccaaattagttgtactaagagttttcaggctgtttacaactgaaaccatcttacaaagtattttaggccacatttgttttgttgatgaggccaagagaagtgaaatagtttttccaggggcatgcagtctgttattaacaaagttaagactatggacaatttcaggatcttgttccttggtgttttggaggttctgaggaagttggtgaaaggcttctcctggaaagtaaatgtggttaagagccaaccaggtgaggctccaggcctactgcctcacttcacctaaagcagatgggctgtgttacagagacttatagaccgggctttttttgaagactatttatttgaaacatctcttctgtcaaatgaatttttaaatgctaaatgaaattttttaaattttaaatgagtggcccacgctaatgtattaggcatgtgaaagggacgatgttgtggacatcggcaggcagcctacatgttcctgaaggtcagacccgtaacccattcatcttggaattttcctcacttggtgccttttaaaaggggatttaaaggcaatagggtctggaggttcttgcagttatagcttcaggggctcccttctgatcttgcacagttttctaattattcccttgttttcttccactgacccatgggatgtggttaacttgtgtcttctaaggccagctgtgactttttccttacccacgttacttccaagttgggaacacaatcttgcaacctggccccaccctgttgtctctgcacaagcctgaaaactcaggtaaatgaatgaatgaatgaatattaggctgataataactacagggaaaaagataagaggtaagaaaaataacagtgatgaaattagcaggcaatagagcccctaaatatcaaaggaaggtaaatgagttcattctagcattccactagccctcttaggctttgtcatgattgctttctcttttttctgtttacgttaatattttgtttctgaaatgcatctcatcctttcctccctatagagtctcctaaattgctttcttttctccccaaccttcattttttcctccttcactttcccactttcaattctaatttccaattagatcacttaggtttacaataatccccaacactacgtattattcccatctcaaagcaaactttagattgtaaccttcaaattcaaagtcccttatacagttttattctggaaaagttgacttcaagcaattattgattggcttgacttcttgctaaattttgcctaaaggcgagcctttttgaaatcacacaaagggtggaaaccacacaaaagtagtggttctcaaactaggtgggaattcataatggttataaagaatgaaatgggctggtcacagtggctcatgcctgtaatcccagcactttgggaggcccaggcgggcggatcatgaggttaggagatcgagtgaaaccccatctctactaaaaatacaacaaattagccaggcgtggtggcacacgcctgtagtcccagctactcgggaggctgaggcaggagaatcgcttgaaagcaggaggcagaggtttcagtgagccgagatcgtgccactgcactccagcctgggtgacagagcgagactccatctcaaaaaaagaaatgtaagtaatggattatttgggagttaggtaaggagcactgaaaaatatgttctaaaatttatattcatgaaaaataactgtatttttatttttaaaaaataacatttattaatagagattctatagaggaatgaagttactttttatttcctttcttttcctttactgtttccttctttccttccttccttccttcccttacttcctgcctccatcccttcctccttcccttcctccctccttccctccctcccttcctccttccctccctcttttccttctttcttccttccctccctcccttctcatcttggaatgagaatacacaaatcctcagttaactctacacttttattcaaacacaaacttcagttgccttgactagttttacagtaagaatttaattttgaagaaaacaaaaattaaatgtcactatcaataaatcaacctaaagatcaagtagatgtatagcatgggcagatatatcaatttaatatagggattaagaggttgtggagtcagcctgacccagtctggacttcagctgcaccgcttactgtgcatgtccttgagcgagttaactaaaatataccacacatccatctgcaagcatagcagtgaaggttaaataataatatgtacatgaaaaacttggactgtgcatgggacatagtaagtactcaataaatattataattaatacagttttgcaaaacatagtatctcatactgctcacatcactgcaaagtgataaagcaaaggacatcccaatatcctacctaagaaaattagtgttcaggcaatatttaattcatgtgcttctagtgctatttataattatctcattcaaatgtcattttgtaacaagtatttgatgtcccagctgacttgattctagacctagaacttggaaccaataataaattggtgggctttgaacttggaaaagcttgtgatagagtctaaagttttaattccacagggttgatgttggttcactgcttgtcacgatgtgcaattgaagctggctatcaaagcagaataaggcaaaggtactttaactccttcacaatcacatgttttcactttaatccaattatagctgctagtcacatgctttaaagatcacagatccaaataaagaaaccatcgggggtttctctatggcttataaaggagcaacatcttttatgactttaattagtctaattttctattgttaaagagaaaagaattatctgtccttaactaaggcagtcagttgtgcacaaagccaaacgtgctgtgggtcaggagatgtgagttctgacctctgaccaaccatgacctctctgagtactgagactagtcactggctgtctctggtttcactttccttgtttctaaaatcaatccttgcactgatgatcagtgagatcctttctagccatcatagcctattatttcatacaaagtgatttttccagaataactaaaaagctgtaaatggtatgttcagagatgacaaaatgagacagtaaataaagggtaaacgtatgtctccagaaagcaaaaataaataaataatactcaatgagaaaaaagatgagtggtgttttgaatattaacctctatgatatttcagttattaaaattagcttcatagttaattggctgatataacaggactttgtgtttcttaagcaagtatttgttaaacactgatgaagtctgtagtttatatctaagccccatgaagtttacaacatttgagttcaacaaagtttatcttgcaggagcttgcaatcaagtagatgagtaaaaagtacggatttaatatacattgcttaaaaggttacatataaatcacatcaagccaaaatatcagcctagttaagttgcttgacccagggttataactcgaatacacaggtctctggatttcccttttagagaccgtattccctttaatagggtttaatgggggggggggggggaaccatccagaagctgattgttgttattgttttataaatgtctttgttcttttaaaggtatgtttaatatgctgtttttattacagactatgtatccatgaaaagtaagtttgaaaatgcagaacatagattttttttctcaaagaaaataaagggtgaatttaatggaatgatcattttcaactggaaaggtgtatttgttgaatgctttttgtgagcactcaataatttagcttttggagcattctccatacagtctaatttaatatttgtaatgatccatagtgttatcactatcccacatgacagtaatggaaatgaggttcctggaggtccagtgatttttctgaatttaccaagtaaatatttgggaaagtgaaattaaacccaggctggcaggctggaaaatgtgtgctcttccgaatctttcatcttcttctggttcttggtgcttctctggaattttgcatacagagagaaggggacaggttcttttcacttttgatgtacagaggttatgagaaaataatcttaagaaatttactgaacagctcggttactaaaaatgtacatctatctttccgcatgatttttaagaagtgagattcccaatgaatggatttaaaatgcaattttacattcacctagaatgaatgtgcagatctttcctaaagatataagaaatcgactgaagtaagcaagaaaaacactattccggaattgcaaagggtatccctgaagagtatgtgtgaatgccataaaagttatactatatctaatattatcgagccctaattgaaagccgctgatttcacctacataattccatgtctgcgaaatcatgtggtgtttctagtgaacataaacacatttacagttaaggaaaacttaaaatatgtatccaaagataagttcaataggtttaaaaacccaaaatctggctgggcgcagtggctcatgcctgtaatcccagcactttgtgaggctgaggtgggtggatcacccgagttcaggagtttgaaaccagcctggccaacatggtgaaaccctgtccctactaaaaatacaaaaattagctgggcgtgatgacatacgcctgtagtcccagctactcgggaggctaaggcaggagaatcgcttgaacctgggaggtggaggttgcagtgagctgagatcctgccactgcactccagcctgggtgacagagcaagattccgtctccaataaataaatagatacatatatacatacacacccaatatcttgttcttattctttttaaactaaaaaaaaatatacacataactgtaggaagctttccttttcctttctgatagacacctttgaaatattaacttggtcagattcaacccttcctatgtttttaagagtgctagccaatatgtattttgcttgtatatgcataagatttgtttacataatacacaagaagctgttaataatcgatcctttctagggcacgttttgaattttgaagcatacgaatcaattatcttttaaaatattttcaattaaaaaaagttctagggtggtactacaggcaaggtatgatggaagtgccacattctcaaagccactgaagagagccagttgaaagttagcaaatgagttagttgtttcatcaagaaatggaagtggtctgatttttttttttttccaaatcaaataatgcagtacagtgcaaattcttgaaagatacttttattttcaaattgtacttggaagttcttcttattctgattctgttgagcagtgcaataggattacattggtagtataattgaataaggctctgtacagaaaaactataaaaaacaattgcctattgctttatttcctgagaaaaaaaattaccttttgataaaataagtagaaatgctgaaaagaatgtattcaagttagaagtatactccccactgaacacctctttcacatttctggcccatatagcagggatccccaacctccaagccacagactgcttccggtccatggcctgttaggaacctggtggcacagcaggaagtgagcagcaggcaagcgagcattaccacctgagctttatctcctgtcagatcagtgggactgtgaatcctattgtgaactgtgcatgcgaggcatctaggttgtgcactccttatgagaatctaatgcctgatgatctgaggtggtttcatcccaaaaccaacccctctccccaccatccatggaaaaattgtcttccatgaagccagtccctggtgccaaaaaggttggggaccactgctgtatagctacaacactcaagaatacatggcagttccatttaaattttaaaaattgaatgtctttggtttaaaatattgaatggttttaaatattccttataatgcaagaccacatcttaagctacaatggagggtaaaggacaaaggctatatttgaaaagtagaaaggaaatacaagagttttcagttaaattggaagattttttttaaaaaaaacctcaaacattttctaaaccctcaaattattcctaagatgcattcaactttgaatacattgataaaattcattgcttgacaaagttgcctatatttttcattgaattgggcagtggtgtgattgaattggccaaatcagaacctagagtgagcattctataaactcacctttactttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaactgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattaggcctgccagaatgtgatttcttggtataaagtgattttcaaatgttttcctaactcagtagccacttccatcatttatatctgagttatttcctctttttcttaatagagaaatgaattgatattcaagccaataattgatattcaagtgacatagttatgtcactaatgaaggtaacccatcctcagctaggaaaaaaaaaatatgtattttccaaaactgctgacttttactttgttgtcagtgaccttggagtcctggttctatactgtataggctgtgtgaccttatttcagttgagggtagaagagaaaaattatattgcaaaagtgggaaagaaacacacttataagattttcagtggaacttgagaggacttttcatttttctttttactataactcctcaaacagtatctaaaccttcaagttgttgtttctctccttctctaagcttcagtgctctcatttgtttcatggagataataaaaaacatctgtgcctcatctcatttatagcatggagacaatgacaatagatccacacctcaaacagtgtggagagggtgaaatgatgatgtagagagaaagcgtatcccagcacctgcatggtaaccactcagcacaagttatttgttattgttttaattggttacgaattgtattttacatataacctgtcctgtctggaataaatccattaccaatgaaaacttttaaataggaactccgtagatgataggttattcaataaagatctactggaaataaaactgttttccaaaataaaatatatagcggtgtgtgtgtgtgtgtgtgtgtgtgtgtgtgtgtgtgtatctgtgtgtgtacatacacattttaaaaaattgattctgttctcaatagcagaaaaaagtctttccactaccttaaacccacatttgactcaaatacactaacgatatgtaaccactgttcaaaggaaaagctgacggacattaggctgcggaatcctgcaatgcttgtgctcagcttgggcctgggtgtcaggataggaataggagatgccagacctgtttggtagtagtggtagtagtcattgcctaacctaggcaatcatcagctcatgggatttggtgctttaagcaaaggtgttaattattcccctcctcccttttagtaccattttctcttaaactaacacccatctttgggcttaactaagcagaaaagcaaacagggaagaaccaggtggttaaggaccagtgtcttaaagtaaatactctgtatttgagtccaaaatgaatttcaaactcaggttagatgtttcttcttaatcacttaggagccagtaagactctctaagccttccttcctacgctctttcactaaaggaccaggttctttcaggtgctatcctatttggaatttaatttgccctaacatttctccaagagccattacagcacaccacattgctgtatcccatttaactcccaaaccgcagagaagctggctgcagcatcaaacactattaaaaataccacaagggaaccttagagtgggatttcaggcacaagttacagcctaaggacaaacagcggttgtaaagagcttgaatgatactggaatggagatttaggagaattttcagagtctgaaaaaacagtccttaagattttagtgttggttcctagggctggttctccgtggttatatgggttagttaaaacattagagtaactttgcctttctccctctctcctcgagttttttttttttttttttttttttcggtcaacagatttggtaccaagagtgactacaagtgagaatggcttaacaaatatttccaagaagaggttcctatcactaggccttgcaaaggaacaacagactcattagatttttttttaacctgaatatctttattgtgccatctaagcacttatttgaaagtcttcaggtgtaatcctgattcagggtgtttaaaatgcaaatgcagaaattagcccagccatggctacacaagaggccccaggcatttcaaatttgaatgaatattttggaaatggagcagaaacttaatggattagtcattatttagagtcctgtcatgtgggaggtccaaattcagagccttagagcggggaggaatatgttatagtgtggtggtggcagcctcaaaataggtagtagtggtggtgaaggtggaggaggaatatgaggataaggatggtttttctgggtggaagaacaagaggaagagaagccagtacttgcctttcaagctctgcagtagtatcactgcaaactgagcacaacaatggaagaaatggcttctggcatccacttgctcattttctcttattggccaacatacttctggaatcttctcaaaagatccattctgacagactttttattttcccataaaattccaggagcatgtgtagactggacttctgggcttccattcttatagaatgtttccttcatataaaatgcttcagtttggaattttacattcagtacagattatttcattaatacagtgcatatctcccctgtcctggaccctagattataaggagtaagaatggggataatgcttctttttggtcatcaatgtatctcaagagctttgattagggcctggcacatggaagactctcaaaaaagtattgtttaaaaaaatgtctgaattgttaaatggacctggtctgaatatctaatccaaaggcaggcaattcatgggtttaccagcagccaataatctataatatttaaccacagtggaaagttacctcattgtatttgtaaatttgtaggctcaagttgcaattataaatgggaaattgcaactaaggtaattggtgtcaagagaaaaaaaaatttttaaatctactgatggcctaaaattgggcctagagaagctatggcaagccatgtacaaactcaggcaatgagaaagcagacactatggagagtagagaactatctctagaaaacaaaaaccagaccagatatataaataaacaaagggcagagtcctgagaaagacaccatatttactacaagcaaaagaagaagtttcaggtgcctagaactgtgatggttcccaaaacttctaaaccctagtccacctgtgtccatgtgagaatgacatttattttgatctagttatttctggtaaccgagctgatccagtgaggatattgtcatatggtgatgagggacgtttgtgaattactatgtaaagaaaagatgcttactctgtgccagtagcttgggaatctggaatcccttcctgtaagcctcagagtgtttccaggaaaagtcaccaaatagctttgattcaaggaaatgaatctcttctgtcctgtactggctgcttgaaaacatagtcacctgagtaatatgagtccaaagtactacattacatctcagtgtttcttgcaattgactaacatgtagaaattgtgcttggctgggatctcacagttatctggttggtttctgtctgctgcatggagctcacttcctggtagtgaccatagaaggaggcattatctttttccagtcactaaaaactatatgaacatcaacaataacctaatttgtgagctctctggcaggaatgaaattcctctttataatcactgatggtactccctgtgtatggcagcagagtgacacacgctgtcctagtggaacataccctcactttgccttgtgtttaaagctgggcaccacttctaccttagggagagagatggtgcgaaagcagaagtgaggaatcacagatgggacagagttggactgggtgatgctgcagtgaggaatgagggagcatgatgaaggaagaatgatataattttagggagctgggaatgaatagggtgaagagggagagaaaagaggagatttagacaaagaatgggaaacaagacaaataagggaaggagtgagggaagagactggaaaaagaagaggcagatataaggaaaggaaaaaggcaagagaatagagtagagaacatgtgaaaaggagaagatcggagaaaacaaatgaactgagataaaatttgagggaggcagcagagtgttgactgcagggtgtggaatctgaaatataactgccaagttttgaagcctggctccacagctttccagaataatgaccatgggacatatccctaaattctctgagcctcagtttcttcttctgtaaaatgggaataataattttacctaccttatgtgatcatgcatgcccagtcttagcacagtgtttggcacacagaattgttattattgaggttaaaagagagaaacaaagcaaagaaaataataaaatggaggaagtaggaaagagagatgttcagacagtggaaggatggaaaagaaatgtatttctgctaataattttaaccttagtttttccacattataatcaagatttctatgcctactatattgtttctacctgctttaataacagctggaaaaacatgttgagtatgaacataccttttttaaaggtatttttgtattaaaccagcctgtaatagtttgcaaaacagatgttcacatttccttgagttgaaattattccctagaaatgagtaagacgaaggatacatgaagctaaaccggtcatccaaaaaacggtttgtttatttgccctacctctttactgtattgactaggtcgtttgatgggattaactaaattgaccggttattttgaaatgtgttaacccaactgtaggctttagggaaaataaagcccctagtgttcttggtggtgtttctttccaagtttctctccacaacacaaaccacttccttttacttgaagtcattttgcttttctcattagtctcacagtccaggggctggtgttgagtgctgaggcagctctcagttcaagaccataaaacaacacaacaaaattagcccaaaacataaaaggaaagcactgtggagttgttcttctcctctcaagaaaaggaaagtggaagttagggcagataaagtatgagaaagagatcagagatctattcttgcataggggtggggaggtagaatgaatgaaaccacagcccaagtcagagggaaagaaaatggaaggagcaaaaacaacaaaaatcccccaccacctctctcgacattcatcacaacaactctctgtgcacctggcatggtgctgcacagttgtcagatcccaggcatgactccctagtgtttccatgaggctgaataaatagtgttctcacagactctccagtagcagcgggtgaaaggccaaccttcattgaccactataaggcttttcttaaatgctactcggacacaccaaaagaaatgttgtccttttcacaaaaacatgtccttgttcaggaccatgtaagttatttaaaataatggtcaatgaaacaaatatagcaatggtatcgcttctcacattttcctcattctgctcagagggctgacagagtggagaagatcatccatcatccacttctttcaagttactcccttctgccaaagggattaagagacacattttcatcccactttctcaaataggagaaaaagttttccatgctggtttctactgttccatgttttgctcttatattgcacccaagaatcatttcaagatgttctgagaagagatgtaaaagagtcagctgatcttccctacttcaggtctattgaacacaggtaagttggcatgacagtgccccagaaccacacactagtactatgtgtggttataacaaaagaattgctatactggtgggcagggtttttttttttgttgttgttgtttttttttaataaagaggcatagaccataatttttagagcaatttcattaggttatgctagaggtaggtttgggagaagagcctgactcggcctgaggaaggggactgggcttgaattttaggtgtcctctaaaatgagataaagtgaaccaggcaattatgagagagaagcgagttttagatggtgagaagagtacaagtaaatgaagacagttgtgaaacatggtgcacgtgggtggaaaaagtttgctgctgaaagagtcagccaggggctgggctggagaggaggtacaatacatatctggataggggctttgggtaccacacgaaagagatctgattttatcatggatgatgggaaggcttgaaaaggttttaagaagagtgacatttgcagattaatttttcaactacataaatttgctggcatcatggaaggccagagctaagaagaggtgcaacagagatcgaccatttaagaaagtagttctctaattttaaaaattatagtaagaaatacattttcatggcaaaatgtctgtgtgtgtttgcatgtctgtgggtgtatcaataattttataaaaccatatttatctttgatattatagatgtggttttatactcttattttttacgcaattctgtatcatatttttaaaataaaatgctaaatgcaactgacagtttcaaaaacactatttcaggtactagtactataattcaggggagagttggtgagtgcttgaactagggaaatattagcaggttagagaagagagcatggatttgatcaatagttataaaataaaataaaaattgtattcatttggggccgagcatggtggctcacacctgtaacctcagcactttggaggccaaggcaggaggatcacttgaggccaagaattcgagaccagcctggccaacatagtgaaacgctgtctctactaaaaatacaaaaattagctgggtgtgatggtgtacacctgtaataccagctacttgggaggctgaggcacaagaattgcttgaacccaggaggtggaggttacagtgagcttaaatcttgccactgcactccatcctgggcaacagagtgagacaactctgtttcaaaaatatatatagacagacagatagatttggtagaaggattcatgatttataagtttcgatcttggctaaaagtgtttcactaactgagataggaagaacagatttgcaaagaaatatgtgagtccagctctggacatattggatttgaagagttggatatcaatggacattgggcttttgtgtgaataaatttggaaattggggaagtgcctactctgagtagagacagagttttgggacccactttcataagatggaaaatacaactatgaggtacatgaaaacatctacagagtacacagagtgagaaaaccaattaatcaaaaagaacattctagaatactcacatttaagaggtaaagtggggaggaagagagaccatgaagaatagtgaaaagaagtattcagagcagcaagaagagtgtggaaacatctggaacaaaatggctcccaacaaaaacatgttgaataaatatttactcagtaaatgaacaaagaaagagtttaagaagaagaagcctctaagaactaagaagacaattaggagttcattggcaaccaagggagggcagctggaacagaggtgttgtgagaaagtcgtactacagtggactgcagactgaatagggatgaggaggtagagcaacttgactgaaaagagaagatcaagaactagctaaaggatcaataaagagttggctgaactttgctgtggtttgctgtgtattgtttttaagattgtgagagacatgaatggggaaagagccagaataaaagtaaagattgaagatgtgagagatagaaaggaaaacagacgaagcaaggacttgtgggagctgggaggagagaggatcaagggcccagatgcaggggttgacttagagcaggagggagaagggaaacgtcatccgctgagaccagaagggaggaagggattatggatgtcagtaagagacctatggataacatctatggcaagaggatgtaggagctgaggaagttcatgccttgacacagactttcttcaaaaagcaacaagttatttgctgaaaggagatgaagagctgctggtttgggaggcttaagagagaggacaggtttggaattagcatgaagaggactgagagaggggcacagcaggaactaactgtcaagtgctctgagagtccgatgaggtgacaggtcttgactttgttggaattccagcttgaagtgatgtgggattatttttcccaggaattcaggtaaggaagtggaaaaggcagactgtaaaactgacagagctggattttcccaaagtgagtaaggaggacaggatggcaagagattcgagagagactgggcaggccagagggagaggttaggagaagactcatttgcttaaaggagattgaaatccctgaactagagacttgccagaaaaaaaaaaaatatatatatatgtgtgtgtgtgtgtgtgtgtgtgtgtgtgtgtgtgtgtgtgtgtcttattctcttttgtggcagacactaaatttgagccaaggagatgtaagtagaagcattatgtgggatttctcagaagccttttctaaaaggagtgggtgtactattccttcttttttcctccttcttgctgctggccacttagttgtgatggctagggctcttgtagtcatctcagaccatgaagacaaagcctataatctagaaatgttaaaaaaattatctgaaagaagctctgggcccttggtgattttagagcagccacagcagccctggactgctcactctgaatttctggaaaaagaaatcaacttctgtcttgattgaagcacaattttaaaaaattgaaataaaaatattttatatatttatggtatacaacatgttttggtatatacagcgaaattttcaggactcatttactaaccatattctagctaaaagagaatatatacacagcaactagagaacgaatagagatttcttggaacagaatgctatctttctaccatgtaatgcctaagcagggcacatactttatagtaagcaaaaagctttgatctttgcaggagattatagactgcttttgatttgggtagagaagaaacaaaagtcaaatcttggatttcttcattaattaaaaaaaaaaaaaggcaaaataaagccacatgtatgttgttttttcccgtaaggtcaagcaaagacttctttatactttttgtgagaaaatgtattgaaaattaatgacattaatacccaggatggtacatttccattgcttcacaatttttttttctttctgaagggttagaatttccaccagtcagcataaaatggttaaaactgaagcctagtaaatcacttgtattgcattgttttcaaagtgactaaacagctgtagttttcaaggtcagccaaatcatctgccagggtcacacgtgtttcacatgtcaagtaacgtatatgggttcaattccatccaggatcctaaggaaaaagacatttgcaaacaagtgatccgaagacatttttctaaacaggtgctgtggttactgggataagagttactattgtaaaccacttgaatttacgactaagtttccaatcatttaaaaagaatattcatttcaaattataatgtccaaaccaagaggaccagctcctgatcataatgacattcaatgaggacagaaagtaatattgtataattgttattattaccataatgacattgttcatgtacaaatgagaagaatgtatattgggtatcaaaataaaaccaaccaaacacataattaggatggaacctagttaaacagttgaagagaggagacttaaagcaacaagacttggctaatacttctccctccaattcttgctccaggaaacattgcatagaaacaaaagacatgactaccatatgccaataactgctttaacaagctggagtaattggtatcatggagccagactgatggaacaaagaaaggatgacctcaggatttaaagagtttagggacagaaaaacattttaaaaatccagtttaattcagaggatagttagagatgtctggctccaactgagagaaggaaagggtattgatttgcgtgagtggctctccattgggctcttctaactcaaaagagataattggccttgaatagtagcttttatattgaatttatattgagttctcttgatgttcttggtatgtgctcttcaaagcccaagaccactccctgatcttgtttatatttgctagtcctaatgatctttcatgtgtcagacgtgctgaatgaagacgattgccttctgatcatttaactcttctctgccagtttcaaggttggcttccatattttagcaagcaaaataataggcatctccaagtcacagtatgcagacaggaatagacaaatacccactttagctaagtatgggctgcagtcaagctggaaaaggtctctcagctctgagtcacttatacaatcgagtccctgaacatgtttctgtccctaatattttgttgctctgggcaaccatcaagtccacatgaagacttctgccaactggagaggatgactagataggagtgccagaattttcttttaactctttgttgaaaactcaaaatagcaaatggtgtcaaggatatcccctaaacatccagattggaaaaagtggaattcacacattgccttggtatcttttattcacttcttagggaaatatgactaaagaagataaaggcaattcatcagaggcatgcatttttttataataataaaatattaggaaaaagttagatgattaggtactatttaatccaatatcatcattttacagaacacaacccaggttaaattactgaccaaaaattacacagagagctaggcagagctgggattatacccctggtcttaaaaccctgaggtcattgctctttcctggactttcagaagcccagtgccagaggcaaagtgaagaaatgttaagaaatcacaagtgatcacctctcttttgtaatagcaaacggttctagttgaaaagggctgctttgctgggatactggaagcaatcctaaagctctggagtagttatcacccattaacactcccaatacagaaagtgtgactatggcacattaaactaaagcatctaaagagtgttcaaggcccaacaaaaataccatgtttgctggaagccttcattgcttattattctaatttggtctttgcctcctctgaattcttacgatactctgtggtacagtcctgagactacttaagattttttgcccaggctggagtgctgtgatcatagctcattgcagcctagacctcttgggctcaagcaaccctcctatctcaactcccccagtagctaggactacaggcatgtgccaccatgcctggctaatttttgtattttttttttgtagagaaaaggtttcatcatgttgcccaggctggtctgaaattcctaggctcaagtgatcctcctgcctcagcctcccaaagtgctgcgattagaggtgtgagccaccacacctagacagtttcttttgcacatgtacaattatattgtgtcaagtccttgggggtaggactatatcttattcatttttgttttcttgaaacccagagcacagaattaaacatattttggttgattttattttctctagaggtacagtgacgacttacttatccagattaattatccaggaatttatactattcaaaatcagtaagtaggtgaaaagaacccagaaaagtcaagtaaacacttgtaggatcttgttcactttatgcatctcatatcctaaaggtctacctcagaaatgaattgccctcaaccttcacttttattttgaattaatttacctttattttatgctcaatgcaatagcttggtaatcaggtttgccaaggaaaaagcagcagcagctcacaaaagatgccaataaagccaagcttagtaacatcatgaactgaccaccagacaatatgggacagcagatgagaaattaaagtgcagccagatttgctgctcgttactgtaggggaaaaaaaagtcctcatagatcattagctcctaagtgcatttgtgaatgacagggaagtacaaaagcagatgttcatgaggaaccagagccagcaaaaatgatttaattacattcagtgtacacctttaagaggttaagaataagcataacacctttcagagattttcatgaatattcaatatacaggacattttctcttaaatgaaatgtaggaaatctaaggatggagataaactagccttaaattcagccttagaatccaggtcttaacctatgtttatcctacatataatacgaaggattataaattttcacacattatcagaagcattttacacctactcagtaaaatcatatgattagcagttatgaaatcctatacatttatcctccttatattttttgtaactatctcttcctttttattctggctatctagctatctagtgtacaacctttattacatcttatgcttgaatatcgctgttgtctttgagttggtttcaaaacctcggatttttttttccttcattagctgcattaaaaaaaagaaatttccaggtgattattattatcttctgtagaaacaggatctcactgcgctgcccaggctagtctggaactcttggcctcaagtgatcctctggccttgacctgctaaagtgctgggattacaggtgtgaggcaccacgcctgccccccaaggtgattttaaggaacagacaaatttgtgaaccactatccctaagtgcttagcacaccattcatttcactcttaattatatccttcaatggaactaactcccttagtggcaggcgtaatatgcctgtgatttctgagcttagatgctctttaaaaatagttgtttttggccgggtgtggtggctcacgcctgtaatcccagcactttgggaggccgagatgggtggatcatgaggtcaggagttcaagaccagcctgaccaacatggtgaaaccctgtctctactaaaaatgcaaaaattagccaggcatggtgacgtgtgcctgtaatcccagctactcaggaggctgaggcaggagaatcacttgaatccaggaggtggaggttgcagtgagccgaattgcgccattgcactccagcctgggcaacagagagagactccgtcccacctcccacccccgccaacaaaaaagttttttcatattcattgtgttagcccaaaatatctgagacaggtctcaatcagtttagaaagtgtattttgccaaagttaaggatgcacgtgtgacactgcctcaggtggtcctgaagacatgtgcccaaggtggtcaggctacagcttgtttttgtacattttaggaagaaataatacatcaatcaatacatgtaagatttacactggttctatctggaaagctggaaagcgggaaaactcaaagttgggggagggcttcgaggtcacaggtagatttcaacatattctgattagcaattggttgaaagagttattatcagtagaaaggaatgtctgggttaagataaaagttgtggagaccaaaggtttattaggcagatgaagcctccaggtagcaggcttccaagaaaagagatcctaaatgtttcttatcagacttaaggtctgtggtgatgttaatactggaggggtaaaataaggcatgtctgacttcctttgcggcctaaatcagtctttcaggttaaattttaaagtgccctggccaaggaggaagtccattcaggtgagggtgcaggcgtgcttcaaattttatttttagtttacaactgttagcgaaaagtacgtcctctcaatttccgttttccccctgtatttacttaagaactattttccagttccttctatatcttgctttgcatctccagcaaagagatactaaagttttctcttggtcttcttttcagaggtgcggtttgatgattacgcacaaagagacaaagataatgagtgggggtagacctgctagcttaactttttcttttagagaagcacctaaggggatctgtcacatggatgaatctacccttctttgaaggtctgatttgaaagcagattggactacattctgcacaaaggcattttaaacatgcaggtgtgaatgccccaaataacaatactttgaacttttacagaacctttcatccagtgataccaaaacaattcagtttattaaaggcctaggaagctggggacaaaacatccaattgatctatatatggaaatttattgcattaacttggttggtgattcctttcaagtctcccaacgctggggcatataagcagagaaaactgtacggtttctgcaagctacctctccaaattgtaatattttccatttccaactcctcaagaagagctaatcctcttcttttcacatttatgcttaattagagagttaccagttcacagacagttatttatgttcagaacctaataaattcttgtttctgccttaatttgaccaaggattgccttctatgtcatgttctaaagaagcccattgaacaaataaataaaaacagacttcacctgtagtgagggagaactattatctaatcaatttttcattttaaaaattaaatacttcaaaattggctgggtgtgatggcccacacctgtaatcccagcactttgggaggccaaggcaggagaatcacttgagcccaggagtgcaagactagcctgggcaacatcgtgagatcctgtctctaaaaaaaaaaaaaaaaattaaaaattagccaggtatggtggtgcagtgctatgtgcctgtagtcccaggtagacaggaggatgaggtgggaggattgcttgagcccaggaggtcgaggctgcagtgagctgtgattgtgccaccgcaatctagcctgagcaaaaagtgagaccctgcatcaaaaaaaaaaaaaattgtaattaaatcttatttttaatctgagagcatagatttaagttgccctgaatatacactctcacttatctaattgattttttttttttcttcgaggcagagtcttgctctgtcacccaggttggagtacagtggcatgatctcacctctgcctcccgggttcaagccattttcgtgcctcagcttcccaagtagctgggattacaggcatgtgccaccatgcctccatgcctggctacttttttttttttttttcagtagagacgggggtttcaccatgttgcccaggctgatcttgaactcctggcctcaatcgatccgcctgcctcggccacccaaagtgctgtgggattacaggtgtgagccaccgtgcctggccaatcgaattgatttttaaatgaacaatctttttttttttttttttgagacagtttcactttttgcctaggctgaagtgcaatggcgcgatctcagctcaccacaacctctgcctcccaggttcaagcgattctcctgcctcagtctcccgagtagccgggattacaggcatgtgccaccacgcctggctaattttgtatttttaatagagacggggtttctccatgttggccaggctggtctcgaactcctgacctcaggtgatccgcccctccttggcctcccaaaatgctggataacaggcgtgagccaccgctcctggtccttaaatgaacaatctatcgtacaaatctgttggatacctctactttttaccatatatctttcaaaaaacttacaaatttaatcttttcctcttttccaccttctgacttccttattatatacattgcagtgaactcaggacagctaagattcagagtggcaactggggtatattcctattttcccatattttaaatctgctgtaaaggaaatagttgttatgagcaaaatgtgtctgaggaatgtttatcagactatcgtttttatttggcattgtcccagcatattagtttttaatttttttgccccatttcaatggtgactttgatgttttgttttgaccagctgctgagctttttgtggctgtccatttacatcactttaaaaaatggtacataaatgaaatttgaacaaaatgaacagtactttaacattgtttcaaaatcaaatatcttcctaaggaatctgatttgtggcagatggagaacaaaaccttccagagggagggctgttaaatgagtcttaattgcttgcacatgaaaatattgtgactaagattgtgtgcacaattaggaatttaaacatgtagaaaagaactggccatagaaacaggcagacatttttgcagtcagagctagtttcttgtgaacacagacaataaagacaagtcagtaaaggaaaataatttcaagagaaattcagttgttttctttacttcattgttgcttacattgagcttccaattctaaagatgattcatttgccttggaaactcactgatggaagtatcacagtacagtcaagaaaaaaatgtttattcaagaactagtatttcttttttagttcctactatgcgtcagatgctaggtttcgtgcttaattcacttcatttaattcttacttaatgctctgagataggtttgctattattcccgtcttctaatgagaaatcaaggctcagagaataactttcccaaagtcaaatagctaacaaatagtgcagccaggattctctgtattgatttaatgaatccaccctctgacaatgcctcactgctcccctgggaaaaagcacatatcttttttttaaaaaaatgatttaataaacttattctaagagcgcctatactttgttctgagtcaataatgccttccttctgttggatggcatgatgtaggttgctaggctggacttgttaaacgttgggtaaggaaggcatgattgcacccaggcgaagtgaatggctacgcagagggcacagataatctgaataggggttgggctgagatgacagatttagagacagaggccaggacttcctacaggggccacacgtcacggcgtcttgtatagaaccaagcataaaagaggcatcaataaatgtgtgtggatcaaatgatgagatggtcaaattatttttgtgccttcagaggaactgagttctcaggatacattaatgacaggtaccatctggatctctaaaaaaaatgagtatcataaaaagaaattcagtgagaaataaattaataaaataaatagtgcattgaaaccaatcctactagcatttatttcccctatctaagagcaccctaatttctttcaggaatatactttgtatccctattagataatcttaataatagttaaccagcaatgatcaagtgcttactgtgagccatgcattttgcttcatttttcataaatatctttttttttcctaagacagagtcttcctctgttatccaggctggagtgcagtggcacgatctcagcttactgcaacctctgcctcccaggttcaagtgattctcctacctcagcctcccaaggagctgggattacaggtgtgcaacaccatgtctggctaatttttttgtgtttttagtagagacagggtttcaccatgttggccaggctggtctcaaactcctgacctcaggtgatctgcccgcctcagcctcccaaaatgctggaattacaggcgtgagcaaccatgcccagcctttcataaatatctcctcaaataattttcatgaactccctatgagataaatattattattgtgcttacttcaaaagtgaggaatttcaggctctggaaggttaaatgaattgtttgagcacaagcatctgtaagtcgtagtgctagaatatgaacccacaaaatctggtcccatcattcagctcttactaccacattttataacatagtttggtagaactgaagccacctgcctgttctcttttagccaaggcccaggacgcaaacaagacaaattagatcccttcactgctgtttgactcttgaaataatgacaaagaaactaagaacagttgtggggatctcactcgactactcctgccatgagactttccccttgatttgtagccttctagcactgtaaagatgcactgattccttcaaacctcgtcctccagcacccccaccaccacctgtcgccccactaattctcagggaattcagaattcttcctatattcttccactaagaattttgcattaatgagcagagttggtttttttgtattgcaagcaaaggatcattgctgagacaccattttctaaggggaggtgataagccagccaaggggagaattgtatggaatccccaaagaacaagatgcagacaacactgtttagtgtgccacaataatttaatagactcactgagaaataatagcatgacaaaaggccaggttaatttcctctgctgccctttctgtggaaatgatgaaggttcttgggctcctctctgatccactggtcttagatacattggccttctcctttatttccagtaccctcaacagtttccagtaaagagaaacagcaagggagggtctgtagaaagacagactgtcttgaggttggctgaggggtaaaagaaatttcccagaaattgctccttttccttcacaaactgcctagaattcagattttgtctccttcaaagttgcatctgggaaaatgtgtttatatgcttattccacacattgccatcattgtaatgattttagggctccctgtcttggaattgccttaaaagtccatgtgatacttcttaaaaaactctttaaaatcccttgagaatggtttcatttctggagttagccccatctaagctaatttgacattctgtctggtgaatagggttggtaatcatattggaaataatatttttggtcataagtgaagtgttactataaaccagtgagattgcttattgctttttggtatgtgtgtgtcttatatggtctgtaaatggtctctaaagccacttccaaaatgctttcagcaatggcatcagggctcaaataattgcacagtttccagagatggctgttttgaggatcaacagtaattgaataatataataatatttattggtagtttataatacttttcaacatattaagcactttccacatgcttttaaataagacctgacatttactatgtcccagacaccgtgctaatttttttacacagattatctcatgtaattcctcaaaattaggaaggtataattattacccaccacattttaacagaaaagatctaacacatcggcgtgacttttctaaggtcacacgtaaagtgggtgagcaggacagccagccacgaaaccccaattttctgacccctgagtcttgttcctcctccttcacatagattttgacttgtatgtcaaaacacaaaaacaaaacctaccaatgtttgagatttttttctatgggaggataaaacctaggtctgtctctgtagaagcaatattagtcaaataacagtcagtccactgtcagtgacttcagaggtatcttacttgtcattcaactctgaggtctcggtttcacgaccagttcttttctattttccttttggctattttgaaacatgtcttcttttaccaatctcagccctccactttctcatgctgtgaagtattccctaaatttctgaattattttcccaaaccattttcagtctctaagctaacactgtaggcagcttcttagctctttagaaaaacaatctcacctgcatctgctccattcttcctctctcccttcctttctctcttctttattttacttattcatttatccattcacttataagccctctgttttctattaacttaatgctttttgtcattcaacagaacacattttagctttttaagttccacaaacctctagagtaatggtcctgaagcttactggaggtattttattcatccttgggtccttggagcctaagcatagcctttcacatactagggactaaatgagtaaaagcaaagccaggaagaggcagaaatcaagttctctatgtggacagttctgtgttcaatatgcaaacatcagaaacatatccagaaaagaatgtcataaacacccatctgttttgtgtggcatatagaatacagtcaattagaaatacttccacaggaccaacagtgctgaaaaggaaccacaaaaaaacaaaacaaaacaaaacaaaaatacagaaggaagacggcacactagaaagcactggatatttaagcatcagaaatatctcaaggaagtgcattcaggacatggtgagctaggaaacttttgcctagcaatggtagctaagagatgataatggcatgaagagacttcacccaaagagaagattaatattcccagtagttggggcctgccctttcaggccttcgtggtaagtggtcccagaagcaaggtgagtgctaacgctgaagcactgcgttaccctggttcctccgaaacaccccatctgcctgacttctcacacacacctgggcctttccttgtcaatgctctgcccctgggcactctggtgacaacgggcacttcagaagagtcaggaagagaagtgtgggaattgaagaatcctataccccctggcaggaatcctttccttagcttatataactatagagagtttttagggtttcccaaagagtttctgtgcatccacagatcttatccctcctcttgtcctaccctccactcatatacattcaggaatagatggtatagatttgttttctgttctcaaaagaaaaaagaaaaagaaagagagagagagagggagggaaggagagagaaaaaaaagaagagagatgtccctagggaataacttttgaggaccagcacatccagcagcttgtgtatgtgtgtacatgccagtacattttaggagaggacttgacattctccctctgagtcaatccgtactttgtaattttctacctatgtatcttaatcaaattattcaacttgtctagcccagttttgcatctatgaagcaggaatagcaacggtgtctacctctttggatatcataaggtttaaaaagattactcatctagagtgtttggtacatttcaaatgtcagtaaatgttaacttttattaatattagtattaataatatatccaactgatttttaaagcattttttgagagaggctttttgatataacaaaagaaacgacgctgtgagtgcactccctatttatttagagttaaataattcagtgtaacatccaactagtaaaatttgggaaatgagcctcaaaggaattttcaacattttgccccaccacagtcactgtatttctgagtatgcctagaatattttttaaggctgaaatgggtgggaagcactttgtggagaaagggagtgactgaagaatgcagtttgtgtggttcttttattttttttttttcttttattagtttaaggagacttggtactgtgtccaagaagacaaaaagaatgcaattactaaacatttcccaaattccctccctcccacatccacaaaggtagatgtgatacttgattttcttctcagagacgagcaagctgctctacttaaaatcttgtatgtattttgagagataacagatgatgaccctgacgctgatgcccaggatgacgaagtcagcacagataataatatcaccttgtatcttctttcactaatcgtggagcactttgcacatatgatcgtgcttatcctgggctgcactgtttgttagatgagggtgtgggtgtcactatatatactttccagaaagacaggtattttccaacaagctatcatcaactcaatgacaacactgtacacaggcagccctctcacctgctttcttcagtattccattattctcccaaatttggccaatcaagcccattcacctgggagtatttgttaataatttagatcctgagccttatcctagacattcagttctggaaagtctgggaatcagtcattttgtggttgttctcaggaagcccttggggattcctttgatcagagacaggtttgggaagtattgctctttttaaactcagggcagcggggaagggatgctggcaggagtggactttggtgacactgagatcttttattcatgtggtagcttttcttactctgagacagagttttgctctgtagcccaggctagagtgcagtggcatgatcatggttcactgcagcatcaacttcctgggcataaatgatcctcctgaatagctgggattacaggtgtgcaccaccatgtctagctaatttttaaaattttttgtagagatggaggtctcactgtgtttcaggcttgcctcaaactcctggcctcaagccatcttcctcccttgcctcccaaagtgctggaattacaggtgtgagccactgcacccagccctaagggtagtttttctgatcatctgaaggataatacaacatttttgtcataggctcaataatccataaaatgctgccctatgtgagagatattattattttaaaatacagttaatgctggactgtggaaccataatattgaaatattgttagggcgggtctcaccagtgccctttctaggcaaggagaggcaaactaacaactgggacctgagaaataacatgtttgtcactagattcaatgtaaaatggtaaacctatctacctttgctaactactggtcaacaactaaaagtaacttaagttcaattcaatatacataattaaagtgcattaaatgtgtgcctattgcccacatggcactttattatgtattccttaaaatacaaacatttttccatattattaaaattttctcaaaaataaattatttaaaatcattttattatgggaattttttaacccctacctaaatagaattcacacattatttagaatttggattgtttttaaccctttatgcacattcacagtgctgtaatgaacatgtgtatatatactttcactttttttttttttttttgagatgaagtttctctcttgttgcccaggctagagtgcaatggtgccatctcggctcactgtaacctctgcctcctgggttcaagcaattctcctgcctcagcctccagagtagctgggattacaagcacgtgccaccacgcctggctaatttttgtatttttagtagagatggggtttcaccatgttggccaggctggtcttgaactcctgacctcaggtgatccacccgcctcagcctcccaaactgctgggattacaggcgtgagccaccacacctggctcatactttcactttaaaattgttcatcctcagtctctgctctaatcaacccccaagtcccttcaatcctatctctgaagagttgtgaacccattccctcatctccacagccccacttccaccccagttcagagctgcattatcttgatcctgtacaaggcctgtgacagccccctgaagagtatggggctgcccctagtctttcttcttttcaatctctttctacactgcttccaattactgtcattctgaaatgtgtatttgttcctacgattggaaatgctcaatgattttccactgtccataaaataaagtccactgttatttatgtaggcctcaaatattatttccttaatctacctctggagcatcctgttcagttgctcctatacacctttaactcaatttgtcctttactgttcccagtcccctgatatggacaggcattccatgcttccataccttattcttgctggtcttttgttgtgaggtaatcctcaatcctcccctaaccacatggaaagcattatgttcttcaaatttatcagggagcatttcctaggtagagccactggctctctctctctctatatatgaatacatattcatatatattatatattaaatatataatataattatttaatatatattttatatatttattttataataaacatatatatttatatgagaaatatatttattatataataagcatatatatgagaaatacattatataataaatattatatttatttatatgagaattatatttatatattatatatttatataataaatatatattatatatataataaatatatattatatatataataaatatatattatatatataatatatatatattatatatataataaatatatattatatatataataaatatatattatatatataataaatatatattatatatataataaatatataatattatatatatttatataatatatgtatataatatataatacatatataataaatatgtatataatatataataaatatataataaatatgtatataatatataataaatatatatttatacaatttataagaaatatatatttatataagaaatatatataattttataaaatatataatatataatatattatatattatatattttgtatatattatatataatatatatttatataaatatatatatttaaagaggtttcagtccaggctctgtggctcatgcctataatcccagcactttgggaggccaaggtgggcagattgcttgagcctaggagttccagatcagcctgggcaacacggcaaaacgccgcctctacaaaaaatacaaaaaataaaataaaaaattatgcacacgtggtggtgcatgcctgtagtcccagctactcaggaggctgaggtgggaggattgctggagactgggaggcggaggttgcaatgagacaagatcgtaccacttcactccagcctgggcaacagagtgaggccctatttctaaaaattaattaattaattaaaataaaaaatataaaggcttcaatcatggcatttagctagtacttaactatttataattccttctcccttactttgtaaatttcttgaaccagtagtcacattttacctccagagcgtatgcatgccatatataaggtgcatggaaaatactgttgaccaagcagataataataataataatattatagcaataatgataagtaacatttgttgaatacattctgagtaccaagtactatgttaagcactgaattagaatttactgataaagaatacccccaaaacttggagaatttaagtacattgaccaaaattagacaactactaagaggaaagctgggtttttaacatatatgctagctcatcacctttttgctaggctaaatgaacatgagccccatttaattatttcaattaaagttataacaaagcatccaaatcagatattcagacaagagagacacaattaaattatttcccctcataattaggacatagcccttgttttcactattcttaaaacaagtctaacttcaatcaattcctggtcaaaaagccacggtgtcagatctgatctttttatatattaataggtatggctctactcattaaataaaagcataaaaggccaaaacaaattcatttgtaagaaagagaactgacttttactgctctaaaagatcataagtttaactaataaatagtaatactccatgcatttatgcaaatctttcagttcaatgtttttaccggaagattctttttcaatgaggatttttgtaaaagtaaactccttcagcttaaaagatttaggaaatccgacagtcattagatgtattagatgctttatcagttttttattaaagctattaaacacaatgtatcatcagcatttttcgatcacatttcttaaaaagcttaatgaacacatatttctggcaattattaaagtgtggccacaatctttattctattaaaggaaaaaaagaactacagcatgaagctgctgcctgctggtggttgatgaggaagtagggcttctctggcaatggctgggtctcttgtcttccctatacactgacacaacacatgttttacttcagtatctcctgaggacttacatatttctctcatgtagatcccttttgccttctttatatggttcttgctcccatctattagatctctctatatttctttttaaaaaactatatatactacttgcttttatcacacacacacagatttaaaaggcagatctaagtaagtagccagcatccttattgtcaccatgaaatagttgcttagtttctttcattcgataagctcaaagcattaagtgattagcccagataacaaaaaaataattgtcccaattaaatatcattattgtttttcccccttattaattcttagaaactgcttgtgctttagaacaacaaacatataagattaaatttcttctcattgtgttttgacagactagcattatttggatagtttactttttaattttctacgtgccaattgactaaattctatttagaatgcacttactgtttttaatgaagccatgaatcttcagggtaaaaaaatacaaaaaggaatgaagacttagaccaatttacttatttatttattttctggactaaaaccacttctgtgctgttctatgcttgtcactgcatcatgtgtctccccctacaggtaaagagcaggcagctgtactagtttcaccgctcctgtagaagaatttgtattttccaaagtcaaaatccagaagtcttttgctttagggtgctggtctctatgcctctggggtataagcagtagatataatcaaaatagctataactacagagatatgtccagtgagaggttgggatgagaaattttcaagctcatatacaaataatacaatgccacatctattactcaggagttagtattaatacttcatttactttctctaaagcatatacttccacggtgggtataaaggccacccgaatctaatggtttattttactttataaaggtgtaagaaggaccatggactcgaaaaaggaaccacatgtttattcctggcattgtcactaagcagcaccctctctcactaggtctcagttttttcatctttaaaataaagatatttaaatacgttttctttagagttgtgtccttgcatgaaaatcctctaattgaggatgattaaataaacatattggaaatatggaaattcagaagcattgaaaatggtattgtgaagatgtaacatttaatgagatggctgcagaatgcttgccttgagctaaggttgttcgaaaatgaaatgcttacaaggaaggactgtgctccaagctacatggctgtacttcaaaaatgggatcactgtcccagtgcaggtatggcttgggcatctctgactctttgccaccctctcatgttccaatgcactctttacttctggtgtgcaccacacattaaggacgtatgtaggtgagccttactctaaatgataaaaggattactaaaaatgtcatgccatgactgtgtgaaaacaaaatcataaatgaaatgtaccaaagaagctgacataccaatattctctgttacctctattctaccagtttttaaattagctttaggaacaaaaaaatgtcaggcattgggacagggttataggaagaaacacttggtgagttcctcatcacattcggaactctatccatttttctttcttttttttttttttttttttttttttttgagacggtgtctcactctgtcacccaggccgaagagcagtggcctgatctcggctcactgcaacctccgccctcagagttcaagcgatttcctgtctcagcctcccgagtagctgggattacaggcacctgccaccacgcctggctaatttttgtattttaatagagacggggtttcaccatcttggccaggctggtcttgaactcctgacctggtgatccacccgccttggcctcccaaagtgctgggattacaggcatgagccaccatgcccggcctccatttttttttttttttttttttttttactttaggagacagggtctcattacattgcccaggctggtcttgaattcctgagctcaagcagtcctcccaccttggtctcctgagtagccgggattataggggtgtgccaccatgcccaacttgaactctatccttttatataacttatctccttgaattcttgcaacagtcctaagtgttaggtactcaaatctccaaaatgaggaaatgaagcaaaaaggagagactgggttcacattcaggctccaaatgccacacatcatctttgtcatatcacactaaagagcaaaagagctatttaagtctcttttataaatgcaaacttcaaagccttacttttaaggaattgttagatcattttagacctgtatgtttacctactatatattgaaataaaaactggccagtgacctacctttaaaacctagctttaaaaccctaatgctataaaatcaaactctcggccaggtgtggtggctcatgcctgtaatcccagcattttgggaggccaaggtgggtggatcacctgaggtcaggagttcaagaccatcctggctaacacagtgaaaccctgtctctactaaaaacacaaaaagttagccgggcgtggtggtgggcatctgtaatcccagctacttgggaggctgaggcaggagaattgcttgaacccaggaggcggaggttgcagtgagcctcagatcgcgccactgcactccagcctgggcgataagagcaaaactctatctcaagaaaaaaaaaaaaaaatcaaattctcctggctttaatacatgtcaaatgcaataaccttgaaaagaggaagagggtattgtaaattctatgtgacaactccttagaaagcatggtatgtgatatgtagactgctgaagttcttaactcttcttttttaaaaattagagttggtttacagaaaagtgatagagaattaatatttctccttcaaacaactatgactcaaaagtgagttcttagacttagaaattcatcctgaacaacagtgtatcatctctatcacaaagctaccagcgtctgtgaattgtgatgagaataaaggagacagtgctgggagcaggaggagaccccattttgatgggcacaaagcaagcgcatccattttggccaatttaaggacccacaagttttcctctcatgatcttgcaagcttgcctttctctcactgttccctttccttcgtttgtgtctttgtcctattctttccattacccccttgttacggaatgagtgcttgtgtgcccctaaaattcatttcaatatcctaacccaatatgtgttggtatttggaggccgggcctgtgggaggtgattaggtcgtgagggtggagcactcaacactcacaaatgagactagtgcctttacaaagggcactgatgcaacctagaagaagactctcaccagaccccaaccatgctggcatcctgatctcagacttccagcctccagaattgtgagaaataaatttgtgttgtctataagccacccagtctatggtactttgttatggcagcctgaattgatgaagaaacccctagttctatgtatacagtgggccctagaaacaaaaccaagtaataacaacaaaatggaatttaaaaagatgtattaagtgctggttctgtgaggcactatgctaagggcatcatgcgtgttcactcattcaagccagcaacaactgcaggaagcagtgtcactattttataggtagggaaactgagcagagaaagggtatgcaacctgcccagggccacaaagctctcatgatagagcatgatttgagtgctgggtaggcagagcaaccacgtggtataattctaggggcaccatgttgtgatgttctgtggagttgccctccggaggcacttggagctgtgtgctctagcagccttttggatcagccatgaacttaactgttaggctacactgttactctagaccttattcctatgttgagggatagacaggcatacatttgcgaacctgtacctggggcctctagtgagagaagccacatggaagctggtcctcatgctgctccaggcactaggtctgacccctatcaacagggacccattcatcttaagggtgcctcactgactctttttaatacttctttgcccttcccaggactactgccacagtacagccaggttccaacttcagggggagtgagcctagagggtggggcctgagtggtcagctgcagagggaggaaaggcacaagcactgccttttctgagtgtctcaaatcttactaatgtcaaaatctcaaccatcattattattactagcactgaggttttaagggcccactttttcaaaatgggctcagaaaggggaaccttcccctgctactgccctcatccctccatccctatgccatgttcccaccttggtttgctatgcttgggcaagaaaaacgacttcccagttttagtcagttcatttcctgttgtgctttgtgaggagcccagcagcactaagtggtaacaacagttaattagtttccctttctagataaggtatttctgtgtcccccttgtccctaggcctcaggtcaggagcttgtgggtacgaatgaggccatattcaccttaatttcttaatttctgtggctcataattccctctggtattgctccaggacccccttactatgtatacatttctaggagcttctatgaggtctgtcacatatgcttaagatcaagtgtgtgccctttgagtgtagctactctctcctgttaatctgtgcctggcatctgctgggatggctgggcagctgccctgaccactgagcacccaaccatctgttgtcagccacaacaatttccactggtacctgatgctgctcttctgggagaatgctgctccacctgtgaggccagctcatatgtgacctcaagctaaaaaagcttccagggaccaaaatagcactgcattctgcccaaatagcaatgtcagttcttgcttattgcaaaattgggggttgagggtagttcctcttgataggggtcagatttagtgcctggagcagcgtgaagaccagcttccatgtggcttctctcactagaggcctcaggtacaggttcataaatgtaggcctgtccattcctcaacttaggaaagtgcatagaaacagagggatccggttccacacctccaactcagtttagactcatttatgttgaatttgaattttggcagaagaaatcagttactcaaagtatttattttagcatataggaattgttattgttcatctctctttctctttattttttggagacagtcttactctgttgcccaggctggagtgcagtggcgcgatctcggctcactgcaacctctgcctcctgggttcaagcgattctcctgcctcagattcccgagtagcttggattacaggtgctcgccaccatgctaagttttgtatttttagtagagatggggtttcgccatgttggccaggctggtcttgaactcctggcctcaagtgatccacccaccttggcctcccaaagtgctgagattacaagcgtgagccaccactcctggccctattgttcatctcttgatcaatatcaagaacaaaactggttaaccatatatgtactataaaatgataattggaagtcatcaccaataatatgttgaaagagaaacatgaagaagagatcaataatttaacattcattgaaatacaagtttcacttgatgacattcagaaaagatgacattaacaatgattccagaatcaactctaatgtggtgaccacaaacacagacagacgtctggacatgataaagttaaatttcaagcaaagtgtactcactaataacttaataagagctcctcagcacattatgggttggagctcaaggaagacacttgaatccaatgacgaattgttttagtttggagaatatgctaattttcttctggtaataattttagaaaacataggttttcttttccaggcaattattttaatgaatcaattggggtttcaagaaatagtcaaaagagttcaatttggtttcaggttcagcaaaatgagatcatgcattctgtttttggttcagctggggtcaagtcctgtgcctaaaacagactaataggaattgagataattttatttttatgcacttggctcctctcatctttcctcctatttttctttcccaaacatctatagatcccaacgttttgatctcattgaactttttctgcattgtatattaacttctctcccctcccaaactgagtttattctcagctctctcagtcctttattggactactggtacaatgttgcttcctacacacaagtgggatattgatgaaccaacacgttactccttttatttatgccttcactcttattaaactaaatgatgacatattatatcatgctaataacacatgtgtggaaccagaatgggaagtgacttgaaagtaacatcatctctcaaaatacaaatgcccagagcaatgctcaaatgagtataagcacatagttaaatggttaaaaataatgtacatcagtaaaaaacgtaaatcggtaaaaatgttccaaataacagcttagacaatttgtgagatcaatgatagaaatgataatgtagagaagaaagaatttctttaacattttcaaattgcagcatgaaattggtgttggtgttatattgactcttggcagaaatggtttcttcctagacacatgaagaataagctccagatctttcttacctgttatggtggctttgttgatggatggttggttgcacatgggtgatcttctgacaaagacagaaaaacacaaagcagtaaatatgtggggcttattgatttgatcactctctgagtcatttcagatatagcattttactttaaagaattatttttaagtttggacacgcaaatgatttctttcagactagccagacaagtccctaggcgttctttgtattatggctcagatcacacatgtccaaaaagaaaactggtaaatctcacagtgattgatttggggtaaataaagctgatgtaagtgtcactgggacatgagagaagaggaaattcttacagactttattcgctgaagccagagcttatagactctgaatttgaaaaagcagtcaatttataattgtcttccctaatacagggttaagaaatttttattgttggcctaaattctcgtgattgcctgtacattatcagaagtgaatgatttgttgtaaactatcttataattagagaagctatttgaactttttcctttcttttcttatattgaaaaacacctctgatatatttgttagagaggtatattaatgacttgtccaaatagatactatagaagctttagaaatactctaagccaaaggtacttaaataaattatatcttgtgttctctaagttttcagatgtttgccaagttccacaaaatgactataaaccccttgaagtaaaaaaaaaaagcatgctgtctgattaacttatattccctacagagcctagcacaatgcatccagtattccgtcagtgcttaataaattatgttgaaaagaatatcatttataaagtatccatcaacatttttgaaatataactttataaagttattacttgtaactgacagcttttaaaatataatgattaaaaaacacttttagatacattcaaagatgtctgatatatatatatatatatatatatatattaggtatataataattatatatatattgcctctaccaagggtgaacacttaataaacacttcttgtggatcagacattgctaaataagtactttaaatgaattatctcattgaatccttacaataagccttaaggaagtaagtttcattgttctcattttaccaatgagaaaaacaaaactttgagaatttgaagaacttgttttaagtaacgaagctgagatttgaactaaacgaatgtgatcctagggtctatgctctgctttgctgccttagtttgagatgtttttgtggaacctgcatgcacagcctcacatatgtgccaatggcatcaatctcttcaaatatgccttgctgagatgatgaatttcttagcagggtgggggaaagttggggaaagcagcctgggattttgtaaattctcactggttccactcagcctctggctccctttcattgctcctaaggttattggtatcgatttgggattaaaattttgtgtttgattgaaaatgcaccaaattttacttctgaattattttagttttttttagttataaaataaaatggttgggggaaaaatggggagaatttaaactcgataaaccaaaatattaatattttaagcagctgctctgaaatagctctggtctatataccagtaattatcttcttcttcttaaatttttttttttttaaagttttgagatagggtctcactctgttgctcaggctggagtgcagtggtgtgatcatagctcactacagcctagaactcctgagctctagtgattccccccaccacctcagcctctcaagtagctgggactacaggtgcatgccaccatgcttggctaattaatttttttttttttagagatggggtcttgctgtgtgtaacagggtgttatctgttaccttctggctaagagtttatcattcaaataattgatatcctgattactcctttttagtccttgctctgtgaaaatttagaaaccattgattttgtctgggaatggtattaaataaatattttcacactcttctacagttttggaaaaccaaatggttgactcaattctaattatctccttttactatcaatcctacaattaactggtactcaggaacttgatatctgaacaagtaatggcaagcagaaaatattaatactttgatccatggttgcctcgatacctcctctaatgacagatgagccagaactcacttctggaataaaaaatctcaagggcaaaacaaaaacaaaaaacccaaggtgacaagaagcagtaatgtgttaacaagtcagcaatgtgcatctgaatacccacccaggggctgggtttggaatgcattcttcctagactccttttctgcagcaaataaaaagggtggcttgtgcaaaggagcacatgccttccataaaatccaaggatgagcttggaaatgttctagtggctctgtgagtgcccagcaggaaaggttctgattctcccagggtcatcatgtgatgaggcagagttacagcactttgttctcactgaacagaatcgagtttagccgtgaatagattgaatcctactattctgatacccaaagaagccgatttggtttgaatcagtaatggaggcacaaatttgcattgaccaaaaggaagaccacagtggcctttacttagagtctgccagataatactgtttggttagatgtcaccctgggcattgacaaggcagagaggaagttcaggctcaagctatgattttctgttttcttctagctcctcctttccatttcaatctgttccatccctgtatgtcagctgaaaacttctgtcttgcatagaaacaggcctcagatcgtctctggagcctgactgatcaactatttacctgccacagatttaaatgctggtacccaggtgaccacatgtaaaggaagcataaagggagtttcttgttcactttttaaagacaaaaatctcagtttcctgggtaaaattcgagactaaaaagtttgggagtgacaaccagttaacttcatttcttctgcagagctgagactttctaagggggaggtgattgaccttacaagctaccaaatccccaaagcccaagggggccgctgaggtcagtatgacattgcacggccacgttacatagaaaacgtgattggtaatgaacaggtacctcaaagcatgccctcagattttacatgctgagttactactttgccctttcagcgaacaggcctttgcagactgatagactctgcattatgctaggcacagggaatacaaatgtgaaccgactacattcctactcactgggaactgacagtgttcaggagcatcccaacagacaaacaggcaacaggagcacagagagctacgtgctaacataggaatcaagtacaaggtacaatcagacagagatggaaaggcacatcactttgattagggcttgtgggtgtgtgtctatgttgggtatcatcagggacaatgctccaagagaaattttatttaagctgcaaccaaaagaatgaatgacaattatcccagtagatgaggagaggaagaagaagatgagaagtattcaggctgagagaataggactgcaaaaattcattacctggaaaaacagaacctaatgggttccattccaatagcttgcattgttacatttatattgatttttaaaaacttttttctatcacaagaagtacttgaataacggccagagctatttttgataatgaaaaacgtgaatctgggaggtcaattttattactatgaaatgtaaagttcagatttctcattgtttttaagaagtagtaactactatgaaatgttatgcacttaggtaagttatagttcctaatacacttatatttactatcctcttaatatgatttaaatgttttttttccttctggaaaattatttgaagttggcattttaatattttatttcatattaatagcagattttttttaaaaaaatggacattgaaataacagcaaaccagttttccatttaatattgaaaaattacttttatctttttagatttttttgcctttatcaagaacctgaaatgataatcctttcccatctttcaaatgctttccctgttgtcatataaaccacaattctattaattgctccatgaatgctgctgatctgaaagtcagtaacagcaggagaatcaaagatctttgctatgatatggcgcttctccaaatcatcgttgtcttgagaggatgactttcagctgatcttaaggtgtgatgagattattcacccacggttaatttatgaagtaagccgaaactataaagttaccctgagtgtaaataactgggcggaggactgatcatgccaggtgatttctgacagatggaatcaccatatttatttgtcatactgcttcatttctgatattagaaccatcaccacgaagtatttatagaaaattaacaggacatcatatgacttagtatacacagacaacatggcaacaacacagagaagtctaacatattgccttgggctcaatcaagttgagaaaacttatttaaaagttcagcaaaaaagaggggggaaaaaaggatatcttacttgctaggtgctcgatcttgcaaattagttaatgcagcaaagttgtttcgtacagttcgcagactggccaagacctacaacaagaaaggattcttgaaacttcttgagctaaggccattttaaatacacttgaaaatggtttgttaagagaaaacttgatattgcttgcaacttagtttcatataccactaaagaatctcccaacacttagtgcagtttgtaggtatccacacgaaatccagagaggccagactgcagaaattttccagaaatccctccacattgtctatgcacatggtgacagtagcagcagtttccacagtatttctgggttccttagtcaccaagacaatattccaggcaatacacagataacatgattgcatttttgcacatttcaaatagtataatataaaatgctaataaagctcactttagggataaaaaattccctactcccaaatctcttcaaaaattgatgaagaatctcataataataagttggcaagtgaagtgaattttaaactgtttttctacctttgccacatggctactctagctagtaagcagacattgttttcttttgttaaggttatctgaattgtgcattgtaagaagctctcagggatgcgtttcttatgtaaaatgctacgccctgtacatgcacaatgcttggcacacagaagatactcaataaaaatttgttgactaaatgaatacatagacacaacatgcccacacacataacaaggcaggaccaataggtgtcactatctctaacagtcgctttttctaattccagttggaactagaaagtagccaacggactggaagtgagcctaggagaaggttcctagagccttatctccttcttccctcctctctttctcctgaaatgggcaagtttccccagggtcaaacccatattagatgggattataggtgatttgggtgacagctagagtgctaagtttatgtaaaacacagattccaaatgtctgagtaggtattacctaacaacccagactgtctggctctgttatgtagtaaatgtgtgaacttggactagatatgcaacctctttgtacctcagcttcctaacctggaaaactgggatagtgatacctacctcgtagaattgttgtgaggagtatatggaatgacaggtttggtgccaagaacagtgcctggcaaatagaaagcattcagccaatattagcccatgatggcagcgttacctttgacttaatgacttggcatgcacttgggaaatttacttaatgcctagcattggtaattcaagagtctccaaagttttaattgcttcaaagtttccagagttgttttcagaaatgtttcatctggcacagacctagactaaaatcagtctaattttttttctaagacaaaaatgtcccagactctgttttgttgttgctgtttatgaaattgacattcatttgtgtaagtcaatggagagctgtgtacgccttgggacagtgacttagagaattttcccctaaaggagttaatgctgcttcctaagaagccaaccgtgattaactcagtcactggaaaaacctggctcattatctcatataaacaacccacggctctgaaaggtcacgctgcctatgatggagtattcaaatggccgactgctgacatcagaccacgatgtctttcattaggcatgaaatcttgaatgatgcagaagtaaatcggataaatgatccactgtcgttaaatcatgcaggcttaatttatgttttaagaagtgaatatcaaacatactaatggaaactttaagataaaatcattgcaccagctaattgatccccttcctaggcaaaatttttaaccctagaattctgagatttttattccaatacataatagttaagttcattgcagttgacagctgggtaaatagacatagaaatgcaggcaacttattttctatgatcatttgaagggaaacatcagtcatgaaaagaaaaattagttcatcaaagaaaaaatttctgtagaggagtttttgcctctattataataaacttctaatttaataagtaatctaatttaatattattttgtctttgtttttagtttaaaatttatgtatttttgtataatttatatcttcacatgcttcagaatttaaacaaaagagtataaagcaaaaagtctccccttcaatgattaagataaaaatcaaaattattattacttctgaaaagacgcaatagaaacagattaacctggggagggacactcaggggacattaaaatactgataactgttctatttcttaaactgttcattttagtattattctttatattttacataattacaagctatattcccttatatatatgaaatacttcaaaataaaaagtgaaaaaaggaatctgtcttccggtctctccttcagacaatcagctgcctggccactagcaatcaacttttaggttttctatcttaaagttgtttttgtacaaacactgttgcaataaataatcttgtagagaaattatttcctaggcatgccagtattagattatttattgtgtgtgtgtgggtttttttttcttttgcagcaggacaaactattttataaattttatgtttggtgttaactattatcttctacagtatgacatgtatgctattggcagaagtgtaaataacatttctagacaaatcttataagggggtgttgtcttgggcctcgctgactgactcttggtgtcgtcatcactgttatcactgtgttagtcttttaagctttcactttgcattgcagggcacaaagagggagcatctgttactgcaggctgtggggagaactataaacagttttactgaagcccctaagttaaagttccattgttctttgcttttgttcagggcagccctcacttcccctgaattcgactctttaagaactgtagtcaaagctttaaggctccttttacagttgtccttactccttaatgcttgctaaccaaaaagatccctgacgtttcttccacagagctcaatggttagaaaattaaggtcatttctttctcttctgccccaccaagcagaagtatagccagtcaatgtcaaaattacattgggaatgatgagaaatatatattccttaggaaggaaatactggtagttttacagaaaaattttagacaaagatggttcatgtattagcccatggggaaggattcaatgttatttacgtacactactctcggatcttcttaggtgcttctaaacatttattaaacaataagaatcactgaaaatagcaggaaaatacggttatcatttaacacttaaacagctgaacatcatagcctaaaaaaaaagaggaaaataaatggtttcgaggattgtttttcataaccatatacacttgttaccactagatggcggtaaaacacagaccatgaggttgaggtgccactggcggcggaggaagcggcgacccgcactgggagagattcattacttcggttttacctccggaaaaagctggagtcaagttatgcttatttacaaaatagaaaggtcatttttatgaaaagaaaacctctttccaggttatgttttgtttaaaccctatgaaattgctggtttgtacaccagaaaaggttgatagacaattttatatggttcgctcttaaaaagaacttagatgtccagaagatagtagttgtaatttaaattaattaaggctaaagaaaagctaaaaatttagcaccgactgaaacgaggtgactatcttctttcatagcctggcagggagggcctagcacagtctgcaagcttgaggatggtgatgaggccacaagatcgttgctgctgggtgaagtggctgagggacaggcaggaatatgagaatattggttatattttattaccaactaaatggtaatattctatagtattaataactactgcatttttatcctagaagtatcccaggtgctgtattttggttagagtaaaggtaaagagatgtagttgttcctaccccgtttttttttttgttttttttgtttttttttttttgagacggagttttgctcttgttgcccaggatggagtgcaatggcgcgatctcggctcactgcaacctctgcctcctgggttcaagttattctcccgcctctgtattttcaaatcagggatatctccttagtctgaatgaagtgagggtttctccagggatccagcataatgcttgggttttcctgttttctctttctttcatcagagtctacttcatttaacattacacacttccacatgaaaattctagtcaacttagagttttactacagggtagttgtgtcacaaatcctgggatcactgagcccggaggcagctgacagcagagaagagtttcctacagtttatcagcattgtgcctccttagtgctccttggcccccaagaactctggccaagaaaaaaaggtcagttgccgcgtgcactccagtgggattcctctctagccttcgtgctaaggaaacacccacaccaaaagatttcaacacaaacacaagagaatactttaacaattgaaataagaaaaatatttaaagctgtcactttttctgaggaccaaagggattctgagcttacaggggaaagcataagaaatcagaggtggaaaagagtttaggttaaacaccagcaagaatttctagccctgacagtgttttagacaatgggataaactatggagagatactataggatcctttctgaaaattactatccaagatgtttcaggctttagcctggccaaaaaagtgcaatctatctttgcacggcttcctaaattctcctctaatttaggattttgctcttttcacgtcaaaggaaaccatgatttggaaaccatgattcgtgttttggagatggactcaggcataaagaaatgagttctcaagaagaggcagaagatgagatggatttgggaggggatctttgaacaccttagacaggggaaggccatttttaggagccatgggacagaaaatatgcacagaaaaataaatctgaagggatataaaataaaatgtcagtagcagttattttggggtttggaattttagaaaattttccttttctttttcttattatttttctaaacttttatgcaaaaagtttttgttttgttttgtctttttgagaagcatagctttttcactggaatttagtgtgaaattccaattttcaaagcatgctgagaaaagagggtaattctttggcctacttggctaaatatttttctgagtgacttttctaaaatccattgttttctgtcctttggtgaaagcaattatggtatatcaggacaaattagattggtatcacttcaagtgacataagtatcttatatttttagttttaaatagttaatgctaaaatagcacttaccattaagtggtaagtgctttactttgtattaaagaaaatttgagaagttagtgattgggtcagcaaaacatgccaatcatgtccaacagggtttaagagaaggccactcaaacatactcactgggacttctctcttaacccctccccacagatgctctatgaagagtggtgaaactcttcagggcttaacagttttttgttttgttttgtttttaattctagtggggctttccaggtcttatactccagtaaaaggccatttgtgaaaaccatgatgaagccccttaaaaaaaatcggcagcctctcaagtaatgaccactctctacaaggtgttatgagtcacttagctaatcataagcaaagacttaatatactatgggattatttttaggcatcagatatgcctataaattatacagctgatttatattccaagttctaatttcaagtatattaagtacacatcttttttatttaaatagcttactaacatggactaaattacatatatgtgtgtatttcccaatatcttgaaattccattagttttttttccttggagattataggtacactacagaaaatatctaatcaggtaaaagactagatttccttggaatttaagagcactgatggcagggttcaagtccaatttactaatctatttgttgcagcttaataaatattacttgatgtaaaagaccatatatcatacacagaccttttttcatttgttattaaatatttatatatattttttcttataataatacctagatcatttggttagaaacaagaatagctacttgaatgaactcaaattggaatgattggttctatgtttgatgatgttacttacattgttatgccatattttgtctgttcacctctctctgaggtcttagatatagaattataagttttctttctttcctttttttttcttgacagagtcttgctctgtcacccaggctggagtgcagtggcatgatcttggctcactgcaacctccacctcccgggttcaagcaattatcctgcctcagcctcccaagtagctgggattacaggcacccgtcaccatgcctggctaatttttttgtatttttagtagagacagggtttcatcaagttggccaggctggtctcgaactcctgacctcaggtgatccacccacctcagcttcccaaagtgctgggattacaggtacgagccaccgcacccggccataagttttcaatagtaatcaattaaaaaccctcagctttataagattttgctatcacatcatattattaaatcatacaagtgtaaattttttggacacagaaatacaggtactagaaagaattcataatctccagcaaaaccttcagcaaacaagatattaaccatctgaaaaggatggtgattgtattttatttttaattgcctgcattaatttaaaaagttactattatacattatgttacttatgaattgattatattataggtctaagttacagtaataaaagtttggaaagttttaaaaagtagaactatacataatcctactatctaaaccctattatccatttaaaaaataatacttatgacattttagaaatgaaagaacattttcagctctatacatttaaaccaatcacaaagtttttataatattatattttcaagcaattgtgcctagcattttataagcgtggtattatttcagtgtcttagcaatcttatgaggtgggtactcttggaactgttatttaacagaggaagagaccaggcttggaaaagttcagtgactcgctcaagtccattgagttggcaagaggcggtgaaagggttttaactagatctgactgtctttcatccagctcagtcccctaactctaccagttgaaaaaaaagaggacccagaaaatttaagtgagttgtccaaggtgcaagagcaccttgatgtatgatataggcctgattataatttttacaacctctcaggattacttgcattttaatatttaacatttcttactcatcagtgttggttttaaacctgcttcatgccccaggttaaatcagttttatctcattccgcccttagttgtctataccagagactctcaacttctcctgcacactagaaaaatactaaggcctttaacaaatacagatgcttgtaacagatctccaaatttttggatttaattgaccagggctgcagcctgggcactgggataagaggtctctaggttaatctaacgtgcaggtagggttgagaagtattggtctatacatagaacatctggtcatcaactctttcatatttatattcccaaacattttagatcatgttatcacctgcttgcacatatgtcatgtggttaaagtattttcatgatttgtatgcctagaaggaagaagtaaacatcaacacatcactcagctaaatctctgcacaaatggcatatgtaaaaaagagataaataaggtattgggttgaattggaatattgaatttcaagcactgatcatgtacctaattatactaaacataacttaagccatgatatagccttctgcttctagtgcttatgtcagtatgagcccaattaagtatatcccttagctaatttattatttgaagcaaagacactctttggtactatgggtttataggaaacagattaatatagccaaagtcactttctctagcattgcttttgaattgcttgaatgaaccaagaatttgtatttgtacttgtgcttgatttaaaattaaattaaattaataacccgaactaattccccaaattaaatttttacatctgtgagaaacctgcccattcaccaagctgtgcttacctgagcaaatggagtcacaatcaagtcatctccgtgtctgaaaaataaaccaaatcccgcattagaaatcatcaataactctgtgctcagtgtcgttcaatattaaacggcaagttccactttcatgagttcccatagagaattacagtgattccatccttatacttcagcacatgttcttcccagcaactgggttaaaaatatgtcttctgggatgttaacaattgtccaactccctgggtaaaaagaggggcttcttgatcatcagccagggtcactgttgctttttaggcacacaggatatgcaatagtagaaatggtgttccagcagtggggcctgagttttacttttggcctcttactgtagatattagtaaggggtgctgtggaaggaaccagcaatgcagtgacttcagtgagagaacccttgaccatctaatatttgaaggtgattagcatggagtgttccacatcatcccgtgtaagtcttggacaggctaggaactgtagatgacatgggactgcatcatacactaataaaaacccagtgaaatgttcaactgactcatcccagccactgtagtcactgggaaatgttactccttgtgtgctgttgctgcagcaaccccagctacaccgtgcctggggtatgggagcaaggtgtcagcatgacgtgtcttggagggacagggaagggcaaggaaagttgtgcaacattccagttagaggaaagtgagaaactggggcccagggttcttttgtggtatttcttagcatgaataatttgagacaaggatttccagagtcaccatcagctatttcttgatctagctagataaaattcttaaatcaaaagtgaatgctgttattcaacacagacagctccctggacatggccctgagaacagtgcaaataaacttttcgctcactcatgaacaatctgaaaacaacctgagtgacccaaaacaacacccatgaaacatgctggggcacagggagcatatggatgatgttactcaataaattgttaccaatagctagaataggtgctgtggtcgtcatcaaaccatgtggagatcttgaaaataaaaatgtgggaaataaaagcagaagaaggaaaaaacaatgtaaaggaagcatgtgttattttacacccccttagttccagaatcatgtttttcaaggggcacctgctctttgtagagattattcatagaactctagaactctaagaaggtaggacattgggttttatgatcattttatagaagaggcaactgaggttcagagagggcataaggtctaaaaactaataagtggtagaggcaggatgtcaattgaaaaaggtattttcccatgttgatgtttaattgccattgcaacagtattaagaggtgggggcctgtgagaagtaattaggtcaggagggcttcacactcatgaatgaattaatgctgttatggtgggagggggttagttatcataagagtgggttgttataaagtgagcccagcccctcatgttttctcttttgcatgtgctcacttgcccttccatttttccattgtttgggatgatgcatcccaaatatcctaatcagatgctgatgccatgtccttgaactacccagcctctagaactgtaagatataaacttcttttctatataaattaccctgtctatgctattctgttatagcaacagaaactggactaagatagtgttcttctgtcatcaataaataatttacataatttaccttgactctcaaaaaaaaaaggtcttctgaggtcaagcccagaaaggctctttcctagaacaatggcccagggtaggagcaggcctggtgcactgaagtggcaaggaggccattgagcccgtgggagccagcagagagggatgaagccaaggaggcagagcagctgcctagatgagaaagaagcagatacagagctgcaacgagaagctcggtgattctagagaatgccatggaaggcaggaaattcagaatcatgggtggtaacgagccaggcagcagatcacagagcccttgtatgaaatgtacaagaacttggattttactctctgatggaagtttgggttggaatttcagctctgccacatactaggtgtgtgaaattgtgcaagttattaaacttcactttcccttggcctcttcatctgtaaaatggagataacagcacatacatagagtgatgttttgggattcaataaattaataatgttaagtgctgaaaaatgtgcttaccacacagtaaatgttcaataaacatttctataataataattagcagcagtagtaaaaccttttaaatcataatgatttttgctttcctatgcagtcaggaaattgcaaagactcagaaaactgatacttcgctaagaaggactcttgagaccctgtgacaggtctataaaagattgagggctttaaaggggcaaaaatggaagcagggagaccagtgtagagaaaagaagagatgaggacctaaactaaatcagtggtagttgagagagagagagagagggacgatgacagcattaaaagctctgggggaaagaaaaagttctggggaaaaaaagatatgaaaatttcaagcatttacaaaagtaaaaagaatgttatcacagcaagtgtattttatatacaatcatcagctgttacaacaatgttgcaaggtaggtgacattactcccatttttcagatgagaaaattgtagctcaaattgattaagagatttaacacaaagacacgcaggtagtaagctgcacagccatacctggaatggtccccttttgtgatatgcattggctgattcctatggaacagcttaaaaagattaaaaataaagctctaggaaaatggcccaataaatgcaaattacaaagtgatgccagggttggccagctacatttcttccttggcccatcattctgactttcccttctggctgtgtcatataggtaaatatagggctgcaatttctcttatgtacttattttgaaacagtagcctaactctcacaaaacaactgagaaatatttacagatacaccagtgtttaaaaagcatgaagacaaaatccagagctaaacacttcagcatttgacaaatttctacacacataaaggcacctttagagttcatttgaagccaaacattcttgggagtggtggacaaatcagtaaactgtgtagtgtgttagaagtccgaagacaaaaaacattttcaataggtgtatatactacatatattgcattcaagatagttcaatggtttctgacattaaaaaatgttattaaaaattccataatgggaggtatattacacaaggagaaaagacatgccacctatgccgacttgatttgccagtctgataaactattcatctgcttcagtgcatggccaagctgaagacattgtattgtaaaatggatgagaggcagttcagataaccaaaattaaaataatatgacatcttcttattgtcccaagctatagtctcttctttcattttattctttataattgacctactataaagtttatttttttcaggactaagtcatcttgacaaggcacatcatcaatctgaaatgaatccatggaaatatgtctcctaattttttatatagattgcagtggatttgaatctttcaaaactcaaaagggttgcatatttattaaaacatttaattttctctttggttgtatctcctttataagtattataagtaatacactttacaatatttatgataatttaccagccttttttccctatgaaagcataaagacagttatcattttagtgaaggaaatatattactttttaataaattgcccagaaattgtttctgccaaatatctcaagatggtctcattttagtaacagtaaaatgatacctagcatttcagtggcagatgtcctcgataaacggcaggttatagcctatccatttattttcaaaagtatgtcatgcttaaattatctttgaatatatacctaacatataattttaaaatctttgtctaagtcctcaactcaatattaaaacagatcttttcagacatactgtcactaggagaataaggcaagtaaaacctatttttatttgtggttagaagaaaataaatataatacaaacatatctttgaattgtgtcttacactttgcttataatcatttaaaaacagatctggtagttaagatcaacagaagattcactttgtgaatatgatttggtttaaagtatgtgtgggttttaatgaactgaataatcacatatgctcaaaaaaatcctatgaaataaaataattctgaaatcttgcacctgaacaactttacccacagaagctttttaaagcgccttgccacgtaaagtggggctgggagggattacaatacaatgtaataaattggggcttcctaggcctacttggctaaatatttttctgagtctcttctgagatgggaagagactattagggtctctataaagtgactgaaaagctagattcaaagtcacacagtgaatatcgcctggacattttgaaattgtaccgcctggtaatgtgaattttgggtgaggatgatgcaatactgtctttcatttaaataaaaacaattataacaacaacaacccttaacaaaaaacagctgtgatctgttttaaggaaaatacagctcttttaaaaaaaagaactggagtgttcatggaggacaggcggagaatgaatgagggataggaaggctcagaaaaaaagtcattttgacactgcgtgtctatatgtatgtatgtatgcacacatgtatacatgtatgtatgtatgcacatatgtatgtatgtgagagatgagattggtaccaaggtaacagtcacagcagaatgcaagtgcagaaacttctagaacagccaggatgagccactgtaggtcactgtgggagtcagtgtcacattggttttaaatttcatgatgtccaaggaggtgccacatgctctgtcaccttccctggttaccaggaagtgaaccagagtcatcttcactagtcctggcgagccttgtctctcccaaagagaaagacttgctgagtcctgagccagcgctgttgaaagcaggagaatacagggctcaacagtatactattgtctttttttttctcacaagagaaatgacagtagagtcaggaacttctattctctattccccctcccatccttcttctacttctgtattatttatcacgttattttctaccctttttctttctgtaataaggaaacagaaacaagcaagaaactaaaagcaagaaatccaaatgcccacactcttatggtgactttgttgagatccatatatggttcaagtacttaaaaatgaaaaagcctgttgtcatcttaaaaaaataagttcaaccaacatcagcacctgaaaatataatttcctatagaagttcatttcatgattggttgaaatcttaaacacactaggtggcaatctttatctgttttactattacgaaatcataaggaaaaggagatacagttaattagaagaaagtttttactttatggagcaaagacccctaatcctactatatttaaagcattagtggccatgtaagacccactgcttttgaatatcacacattgcaaattttagcatgacaaatgaatgcatgaactagcactgtgaaggagtcacaggctggggcttacgtttgaatctaatcctttttttttttttttcaatggcatggaggtttgctatgttgcccagactggccttgaactcctgggctgaagtgatcttcctgtctcagtctatggggtgcctaggattacaggtgtgcaccaccgcgctggccgaatggaatcttgtgcaaacttttttcatcttctgtgcttcactcactcttactagaaagatattctcctctgaagtttgtcaataggattaggaaattgataaacatatagaaaattaaaataatatttttgaaatatattttaaagtccaagattttgataattttgaaatcttagtatctttctttcctcagcctaaaaactatcatccatctatcaattcacccttgacaacttcttttagaattatagagaaacaagtatgttctaattttaaaatgaatataaaaatatttctgggagcctagactatttgacaacacccaaggattagctataggaggaccacgtctactcacaactctctagacccatcttcatagaagtatggacatataaaacaaacatataatgtaacctacttgatctttatgtgtgtgtatgtgtatatgtatatatacatacatgtacatatatacatacatctatatacacatgtacatatatacatatatgcatgtatatatacacacaggcacatatatacatatatacatacatgtatacatacaggcacatacatacatatatacacatgcatacatgcatgcaacatacatacatgcacatatacatacatgcacacacacgtatgtacacacatgcatgtacacacacgtatgcacacatacatgtatgtagacatacatgtatgcacacacatacatgcatgtagacatacatgtatgtacacgtatatgtatatataagtatacacgtgtatgtatatatgtatacatacacgtgtatgtatagatacacgtgtatgtatacatacatatgtgtatgtacagctacacgtatacatacatatgtgtatgtacagctacaagtatacatacatatgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagatacacgtatacatacacgtgtatgtacagatacacgtatacatacatatgtgtatgtatagatacacgtatacatacatatgtgtatgtatagatacacgtatacatacatatgtgtatgtatatatatacatacacacatatgaagtacatgcatacatatacatactttgggagatatagaacaacttaaagaaccattcaaagataactattgataacattttcccactgcatgtatgtgagcacatgtatgcaatatagtatgtgactattatggactacatacttccttatagaattagagtcatagtgtatattcaactgtatatcttgcttttagcattaaacattaatgaaccataaaaattatacatgcctttattcttttaaaatattgttaatgattccaatctatattcggtaatctctaaaatttttcaagttatgtgaatccaaatgtattaaaatgtaagcattgattctatttttaaataaattaaaaaataatcatatgggtttttcagacgaatttcagttcatttatcattcattcatttttaaaaagctacttattaaaggaaacatgcttattttaattaaatatacataagacaaaggtaaatattaaaatgctacatgagaaactgggctgcacaggtaattcatgggaatgttaagtattttatattgctacctgcttaaattaaaatcatgaaactctaatttcagacaacaaaaattctgtaaaatgtgactaccaagaaaattttgcaaaaccaaattattttttccatatagcgtttaaaagagatgatttgtttttccaaaaataatgttcactctgacaaattataaatttaagaatataatgaatgatttaaaattacttataaaggaggcattagatttttttataaactctaagtaatctatatagtaaataaaacaataccaaaaatacataaaaactgtttccttggtattagacatacttgaggatatggatcctctgtattgcttggccttttaatttgaaactagctccatttaagtcaaaataaattaagcagtacatctatttatgaaaccctagggaataaagttcctaatataataaagccaacttcagttacaagtgaatgtgcttttcctctttgaagctattgccacttagaattaaaataatctatttaacacaaaaacttgtattaaaaatcacaactaccaaaactttcaatttggcaagaatgtccagcaaccttttactgagaatcaaagaaaatgtaaattaatatatgagtaacattaaagctgtctagtattgtgtgaggtaacatcttccaaattgaaacttttcaacgccaaactcaggccacctgtttgtatatctgtgtatgcagcttttctggtgttttgatcatttttttttttttttttttttctgagatggagtctcactctgtcgcccaggctggaatgcagtggctgcaatctcggctcactgcaagctccgcctcccgggttcacgccattctcctgcctcagcctctggagtagctgggactacaggcgcctgccaccatgcccagctaatttttttgtatttttagtagagacaggatttcaccgtgttagccaggatggtctcgatctcctgacgtcgtgatccacctgcctcggcctcccaaagtgctgggattacaggcatgatccacagcgcctcgcccgttttgatcattttaaatattttgaaaaaattttaaagagatgtggggtctcactctgttgcccaggctagagtgcagtggcacaattcacagctgactgcagcctcaagctcctggactcaagtgatcctctcacttcagcctcccaagcagttggaattacaagtgcaaaccactatttttatttcttaaagcaggttagaattttttttttttgagatggggttctcatcttgaattttaactccgacaacttccacatgtcctgagaggagcctggtgggagatgactgaattagggggtctggtctttcctgcgttgttctcatagtagtgaatgagtcttatgagatctaattttttaaaaagaggaggtcccctgctcaagctctctctctttgcctgttgccatccacataagatgtgaattgctcctcctcgccttccaccatgattgtgaggcctccccagccacgtggaactctgagtccagttaaacctcttccttttgtaaattgcccagtctcagatatgtctttatcagcagcatgagaacagactagtacagtgaccttcaaagatatttagttttctgaaatttaaactgtttgctcacatcttattaatattttaagaattaagaaacaactcaatggcaaaaaaacaaataacctgattttaaaatgggcaaaaaacctgaataggtctttctcaaaacaatggcctgacacagtggcttacacctgtaatcccagcaccttaggaggctgaggtagcaggatagcttaagcccaggagtttgaaaccagcttgggcaacatcgtgagacaccttctctacaaaaaaattaaaatcaaaacaagacctacaaaaaaaggtcaacaggtatatgtaaaagtgctcaacatcactaatcttaagtgaaatgcaaattaaaaccatgatgagatatcacctgacacctataatagtttttttttaatcaaaaaaaggtaacaaatgttggtgaagacatggagaaaaggaagcctttttacactgttggtgggaatgtaaactagtacagtcactatggaaaacagtatgaagggtcttcaaaaaattaaggataaaactaccatatgatccagcaattctacttctgggtatatatccaaagaaaatgaaatcagtatgtcaaagagatacctgcactcccatgtttggtgcagcattaatcacaatagccaaaatatggaatcaacttaagtgtctaacaacagatgaataaagaaaatgttatatacacacacacacacacacactagaatcctactcaggcttaaaaaggggatatccttccatttatgacaatatggatgttcctagaatacattatgcttagtgaaataagccaggcaagaaagataaataccatgtgatctcacacatatgtggaatctaaaaacaaaatcaaacttatagaagcagagagtagaacagttgttcccagggactggagcagggcctgggggagaatgggaggatgtggaatgggagatgttggtgaaagggtacaaagtttcagttagaaggagaaacaatttcaagagatctactgtacaggctggtgactataattaataatcatgcatagtatacctgaaaattgctgagagtagattttaaatgtactcatcacaaaaaatgataaattgttaggtgatggacctgttaattgcttgatttaatcattccacaatgtatacatatatcaaaatattaccttgtatataataaatgcatataatttgttatttgttgatgaaaaataaatttaaaacaagaattagagcccggccccatctttgaccaaaaaaaaaaaaaaaatctttcaaccaaaaatccttaatttttggctcatgtgtgctcatatcacttgtggaggacaggcactgatgataaagcagatgggactgaagtttacgcaacataagcaaaaaataatctagtctaaaatggaatctctttatttgtcatgagaaaacaatttaggactcattagagaaaatacatgatgccaatgaatgccttcaaatttgttagttatatgatggcacaaagactatctctgttagaaatgatacaccaaaattttccaagttaaataattaaacaaatgtttagcacatgtgtgtagacatattcactaagcatattaggttattttgtttaataaaaaccaatacaatagagagacttttctaggacggctgatgtcccaaattatcaccagaaggtttgagtacaaagctgagagtctgacttccatggagggaagaaagacagcgaaagagttgagtacatgggcagggattcacaagtgctctcactttgtgttctaggaacgggatcttctttcacagtttatcttattggcaggcttgttcttaatgccagtggccctgcccttttggtttttcaccagaatgggatcctagggaaaagatttttggtcaactagtgcaacaattttaaaggtctgcatgtggtgaaaagattcaatagattaaaaggaagcccttgatcaaacagagaggagagcaatgtgttttatgaatgcctactaggcaccagacacggtgttctaccaacatgctgaatttaatcctgacaactctgcattaaatggatgctcatattcccattctaacataaggaactaggccctgacaacttaagttactcattggcagtcatgcccttgacaagctgacagaactcagtggtttccaaatgccactctaagatctggtacttgcccaacagaatgctcagtggtccttgtcaaagtcagagtgtacatggaccatgcagtgagattttttttttaaactatacgtattcctttggaaaattcttttattctgagattatgctctttctttttcactgaagtgaaaatgtctttaaaaaataaaattaacatatatattgatgggtaattccttgttaatgttctttacctggcaaaataaggagttagtaaccctaggtcagtgtcccagaaattttactgggtcataaaatcccaaggcatggaaatgttcagtgtagctggatttgagcccaggccttcaaatactgttttgtttttaccatgccgctttctgtatgctcaaatggatttagactattctgaaggcacatagaagtaaatgttttagactctagaacagcactgtccaatagaatatttctgcaacattctatttctgcaacagaatattctgcaagactctcggtgctgtctaatatgctatccactagctaaacacacacacacacacacacacacacacacacacacacacacacaccaatccacaaaaacaaaactgatcttggtggttataacaaattcaatttgaagttctgtaagcaccaaagaaaaaatgaattttgaaacatggaaatatgagatctgcatgtagctttgttctcccttgggagtgaaacaatgagttaaaaaattttggacttgggatcattcatgacatttattgggagacaacatcatttactgaactggtgaaatgatttcttgtcacatcacaaccttccacatttgttgaggggtgagcagttattctttttctttctgctctgaagttccctgcgtcttaaagagagggttgcaggaattgacacattatatatgtttagatacaactttccagtattcaatgtcagcaaatttttcttgacccaaggttaggaaaaaccataaagtctcaaggcaattaaccgtaggtggacacaaagcctaggagatgctgcagtaggcagacggaataattggggttgtttcctctgtgaacctggtgtgaatcataccacagattaccaggaatctgaaagcaaagcccagtggttgatattccttacttggttttctaaagaaaaaccatgggtctgcttgatgctttctttctgtttatttatagaagcacatctttagatgattcatattgcaagggcttagacagtatgatttagtaatactccctggaatatcttatctcaagaaacacatcacataaatgttccagcagtgtgactgtttttccttatatggctcagaaaacagtaaaggagacattgagaacaattcattaagaagctaagactgacaagcaaaagtaaatatttaaaatgattgatgtgtaagtgaaaacaagtattcatatgggaatctcagtgttggctggaaacatctccttttgtatcaagaatttttaaaaattaaataaagacaagaatgcatgctccaaacaatttttttgtcttactttcatggatctatggtgtcttcaaatgataccctggcatggagtaggtgctactgttattttccaaacgagtaaaacagtgatactcattcaaaaatgcacatcaattaatacacacctttatttagaatgtggtggaaaacacgtattggtcatctccaatagaagtcaactttcttcttcttcccagcctgccaccatatgccccaccgtcaagacttaaagttcaggctgtgcatagtggctcttgcctgtaatttcagcactttgggaagccaaagcaggagtattgcttgagctcaggaattcgagaccaacctgggcaacatagcaagacctcatttctgctaaaaattaaaaaaaattagccgggtgtggtagcatacccctgtgtttgggctactagggagactgaggtgggagaatcacttgagcccaagagctcaaggctgcagtgagctgtgattacactgctgcactccagcctgggcaataatagagtgagactctgtctcaaaagaaaagaaaaaaaaattaaagttcaaaatatttctattttacaatacactggagcatggttttgattttagtcttctttaatatacagagggaagagggttgagataaagtgagagtacactagtgtacctctaggtacaatatccacaactgggtgaaccaatatctctcctgtaatggccatttgcctcttggaatttcaagaggcaggaagaatcagtaattttcaactatgggtccttcatctaggggccgtgtttcattgagagcactatccaggttactggactagtttttttctttcaaaatgttcttcaaactttccttattttagtttatttcacacataatgtgctcttagagattgcattcttttggtatgcactgaaaaataggctaatcttccttgactgaggccaattctgagtttactttcttctggcaggaattcagtgtctcataggattgtggaataattgctcttgttattaaactaccacttctccctgcatttttttttaaagaaagtagatattatcctttgaaatgtattaaatctgatgtataagcataattatataatcattatttataagtttaaataattcaccttcacactctttctcttttatacaggagtgagaaaaactcacatgatttttagagttttttttttcacatttaaaagatttaaaagtgagttcagtctgtaatcccagcactttgggaggccaaggtgggaggatcacttgaggtcaggagttcgagcccagcctggtcaacatggtgaaaccccatctctactaaaagtaaaaaaaaaaacacaatcagccaggcacggtggcaggtacctgtaatcccagctactcaggaggctgaggcaggagaatcgcttgaacctgggaggcggaggatgcagtgagctgagattgtgccactgcactccaacctgcgcaacagagtgagactctatctcaaaacaaacaaacaaaagaagtgagtgcaaatactgaggaacatagtgagtataaaggaaatctagaaaataaaatggtatgctaaatattagcacaaagtcctagagttcgaattgcagcaggcttgtcatagaaacaatgaattacgtatatgtttggtcagttttcacttctttttccctctgctttaacaactttttataactaacatttatccctctatctctcctaagacttcagtatatatctattactttggcagtaatagccaagatatattactacatataactcaattaattcgttattttaaaggttagagcactggcaatgatacttagaggtgctggcaccatctcactgtagcagtgcattaaaatcaatgctttatttttatactgtggcattaaaaacattaccatttaaaatgtctaaacatcaggatttcatttttatgatttttttgaaagtatgagattaggaatataaaatgcctattcagctaatattttaaatcccccagttcaaggattgaagaaacttgtttagctaatttataagacttattttacaattcatgaaactcccatttttttaaatcagaaataaaatgacttaagtgattgaataaatggcaccaaataaagcagaatttttaaacaaaaagatagtaaaaaggtattctagtagcagatgaccttagcatattttgccaataaacttcttgagatttaatagctagtattaatgcctgcatcaacactccgaataatactagtaacagtggccagcacacagcaatggaagaaaaagcctggtctatctaggtcattaccaaaataatatcacattttataaaaaaagattttggctacctgggatcctaacagaattaagaaaaagataaattctctactctagagcacatcagatacttcacagcttggaaactgttatttttttaactcctaacaaaattctctcaaatagtctcacatagagatctgatttatctttaatcatttttttttgtcttgaggcagggtctcactctgtcatccaggctggagtgcagtggctcaatcgtggctcactacaacctcaacatcctgggttcaagtgatcctcctgcttcagcctcccaagtagctgagactacaggcgcccaccaccatgcccagcaaatttttgtattttttgtagagacagggtttcaccatgttgcccaagttggtctcaaactcctcagctcaagccatctgcctgccttggcctcccaaattgccaggattacagatgtgagccaccatgcctagcctgatttagctctaattcttcagatatgaataaacaactaatccaaatattttcagactttctcagtacatggtgcccttaatatctcaattttttaataacagcaacacattggccaaaataaataatagttccaattattaaatagttaagtccaaataacttaataaggttttgttctaacaatttagcacccactgagcactatgtcaatttctcattttggaatgagattggacattgcctcccttattttttgttgcacattgatttctgctcagcacttcatttttatccagcaactgctgaaaacccaattttgcaaagatatggtgtcacagaaaggaatatcatggtcttaattggaaactgggaactattccaagctattagttttccaggtggttgacagatgttttcgtgtttttcttgaacatttaaaataacgcttgcacccatgtacattccctctgttgcctcaggacacattttgagaactctggccctagtcccatcactcctacaccacagggtgaggggtgaggatacctccccagctgggaaaaacccagaactggggaagagatgatttggccatggtagctttctttctgtggttaatggaagaaagctttcaagataacaaattgatatgcttttgaaatgttcattagtgtaatattatcttgcaatctaggtaagagatgactacaaacttttcatgtagatccagtgagaattagaacctttgtaatgcaacgtgtctttttatttatattcttcctagtgagaccagggaagattaataatctggaataaaagatacaaattgacataaagggaattcttcttcctttttcaaactcaggactggaagcaatactactcttatacttagcaggcaaaagtagtagagaggagtggctgtgactgaaaacacacattagaggcccaagaagtggtgagggacttgttaattgctaaagaaaggacagtagtttgacatgggaggtagggagagtattatctactagctgagaaaatgccccaatggggcaccccgaaggcctgatcagtgaggtctgagatatctgtatagtgcctggggataacttagctagattcccaaatatgccccagctttttatggtatatcaaatctactcacttcctcgtcactggccctctgaatgcattcaccccaccccatattctgtgtgtagaagcaatgtatatgaatgtgagtgaagagccgattggatcatctttgcattctatgtgttggtgttaatttaacagaggatggggaatagaggattagttatccaggtgaattgagtatttcttaaaacttaagtagtttgacaggtaacttatacttaataaattcatagttttgtgacttaattctacttatcttgtcattgctaattctcctcttaatctttgcaatgtatcataactttatgtgtttccaaatacagatactatattactggatgatgtgaaaacacagaagtgattgttattcagatgctgaaatattaagatgacaaaaatattgtctatttacgctgtaattttcttcatgttacttcatgacaccacttgggcaaccagccttttgttatctagttgtttctactgttataaaaaatttttactattaatggtaatgcaagtttattttcatgtatttatttactagactcatgctaatacttaacatttttctttttcttacttttcttaagaattaagttgctactgcatcatctatatttaacaaattgtgtgacggtctctgagcagaagtggtcaggaacttctcttctgccttatatgagctaattttttagattctgaatttagcctagtgctatatacttgtatacattctctaagagttggctgcatatttactttgtacctccttgagcttttattttattcttaatcaaattttgatactgctatgtatttcattggtttaatgaatttggtcaacaattacttctgtttctcagcagtttttgctgtagtagtataaagtactttgtttacaatggcattatcaaattatgtgctcctagaaataatcaaaatgcttgcttttttttcaaaagattaagctcattggactttggctttctaacctgtaaaatggcataacaatgtccctatcaaaaggactgtgagtatatcaaataagatagctggtgtgaaaatacttgggaaagttgatgatatacacacaccatgtatgttatgattattattactaccatctttatctgttttgttcttcagctatttcattggtttctatttatagaggataagatgacgatatcctatctactaggaagggattatcttccttcttctcactttcccaatagagtaaatagttatatttaaacttaaagagtatttaaaggttttccaaaacagttcaattaaatagataaccacaaaccttcattttaaatacccttcattaggtacctatcctcattaggtactgtttgtatttgaaatttctaagaaaatttctcaataggaaagcttaactagaactattaataagaaatcatcaagtaattaaatatataacatcattctctataaagcgcagttgaattatacacatcagacagtcttcatagcattattgtgaactaggtaaggtgagaaaattaaagtttacacatggccatatgagaattcaaattaagagaaggcacagtcctttatggtggaagatatgtgtcgtgtcagattaaatgttgaaatagttattatttattctatttccttttccttccacagaaacttaatctccttggtagaaagaatgctttctaggagttggtatcaaaggaatatcttactgctccaatgtaaatatccaaggagaatggaaagctaaacatatcaacacattacttttcagcaaaatatagtgttgactcatggtctgattaaactcatcattcctacctgagtctgatcagataaagaactcttgaggcacacagcaaaatgaggtatccttgcaagtttgattttgaaataaaagcatttcatatttaaatatgaaatgctataagcttttcataaaatatatgtatatatttaatatttactaactggagtagaatgtatgaaagaaacaatctatcccaaactcagtttactacaatttaaaaaggtagaacacataactacataaatggactccactaactcactgtgagttttcctctttcttttgtcaataccaagcctgactcacctttgatgaagttgcattagatgactttcaattctgtcattcgcctatttaacattgtttattgttatctatggggctggtcagtattctactcacctttaccctgttcccttttttgatctgcatagtggcttttttaagcctttccctttcttctcaagctgccccatccctctctcctctggctattgatggctgtaccttctacttttacattcattcatctggagatggaggagtaaaatgtttagagaactcatggctaatatctcttaacattttactcctccatctctaaatttacatttcccttcttttactcttcttctccttctccttcttctcttctctcttattcttctccttctcctccttcttctttttttctttttttccagacacagtcttgtcttcctctgtcacccaggctggactgcagtggcatgatcgtagctcactgcaaccctgaactcccaggctcaaccaatcctcctacctctccagagtagctgggactaaaggcatgtgccaccatgcccagctatttttttggatttttagtaaggacaaggtctcactatgttgccaaggcaggtcttctttgtccttcctaaagaatacagttctggtatttactacttttccaaggatagcctccttactttggctcatgatcatgtttttgtcagcaactacagctccatctttaaaccctctttccccttgaatttttagtctctttctatctcctggagccttccctcagctcaagtaacctgaattcaaaaaaattccgcttgaacctaattctctgtcaggcagccttagttctttcttcctactccacccatcagccttttaaagagatgcctgcatttgctcacatttccactttcaattcactccttaacccaggggctcctaatgctattacctgaatacaacgcaccactcaactgtcattcaaaaacctagtaattatagaaggtaactgttctatttctcctggtcctctggactgttatttctgtttgctgtcccagtactttaactgttgtcttgtttcccctagccttatcatgtacaaaccaattcatcacctgttatctgtcatgttttctactctctgccctttgttcctcatcaccatgtacgtacatcaccatgtacgtactcattcatggacaaaaatcagcactctctttgattctccttctccactggctgtcccccaacatacatacatacttcacacacacacacacacacacacacacacacacacacacacacacaaccattctataagcctcttgcatctaaaccagctctttgctccactgccatcactcccttgacttaggtcttcatcatatttagcctgccttacttctgtgaatttcgacatgaaatacttccctgtagtgacttcgctatgcaatcattcaacaatagagtaatcaagatgcaataaaaacaagaatatgatcatgccaaaactcagctaaaaacctctgtggctctcaggtcccatagactgtatttgaaattttcttctctcttgccaggtttcgctattcacatcaagcagattgtcattccttagttcagccataattttccatgcctcacatttagtaaatgttgttcccttagcccggtattttctgtatctttcccttgggtggaaaactctccatctcctctctctgttcctgcagtacatgataaatgcctcaaggattgtgctcaccatattttattacaatggtctaaaatgccagacctcactgctccacagattcagagctttaaatacaccatatttgctcaagaagcattctcattatgtgtgaatgaataagtaagtgtcatgaatttcaaatctaaggaagtgagataaaaataatgtaaaaatagggccactaggaatagaaagttgtttagagatgaagaagggtagacgtcaataatacaactgctaaaatagcaaccatagtttgtaaaaatgagtgaaatataatttcatttctagaaccccatgtagacctattgcaatacaactgatgctctgttagaatggcaagaataacactagacactcaggggttccatacagactaattcttataagataaattgcagcctgttatgagtttttgagatgggtgtcatgaaaagatggtgaatgttattggacaaatgtatagaccaagagagaaagatgaagatcgattctatacagaggcagatgtgccacgaatgatagtataggtattgagtgagaataaagacctatgtagaaaaacatgcacactaccacaagaatgaaatgcactgagaaaatgagctagtgatggtacaggatctgcaaacctgcttgtcagttttcattgtttttcaagctgtactatatcttaaatgatattcaagtctgtctaatgttttctgtgcttgcctctcatgatccttaaaagttggtttaattttggcaaagtcccacaaagatttcttaaatgatctggcaaaccagtgctaacatctgtacatacattaattgaaatatattcaaaatgctatacagtctattatcacaggacttttcaatggagttgaaagcttttcaaaatattagaaaatatccatgtagttaggtagctaaaactcaggctctacataaatataagctaatgatttaagtgttagtttccattaaaaatttaattctcagttttcctataaagtattttctgggaaaataaatacatgcgtgtgtgtgtgtgtgtgtgtgtgtgtgtgtgtgtgttaatcaagagtgacagtgcactcaggttaaatctaccattcatttctagcttgtataattttattcatattctttctacattggaggagagtgatacagttgaacaaaagtcattagttttattatgtcatcagctctagatataaatttactcggttttctctctctttgcctgcccttgtacttacatatcactggcaatggaggagttccgggacatagactttggagagaggtcataatcgctgtcggatcgatacaggaaggactcccgtcgttgactgtggacaaaatttgcttggagaattagcccggatcctgggctggtcatgggatccaagggactccgtcccgcagatgtgccattgtccacatcaaaactgtaaaggaaggagaaggaattatgttgctgtgaacattcacatgttcatattttcaaaaagcatttagcgtcagctgaggaactgacagtggaattagcaggaatgaaaattacagctaatttctgccataaaaatatgataatattgaaatacataaaagaaaaacacattgacttcacattcttgttctcctggatactgttgttaactgaccagatacaagatacaggtttttccaaactctacttcagttaaaagggaaacactctgcaaaacataatcttctaagtacaaaattcctttcggaaaataacaaatacacagtaattcatcaaatatttgaattcgattcaacaaatacccattttgtgcctaatgctgttctcccaaacctgggcttctccctccacactcctaccctataacatccatccaagcattaatttctattgtacccacttccttccatccctactaccaatattttaaattcaggtctccatcaaatttcacctatattattataacaacctttatattagtgtcttgaatccattttccagtgtcattcttcagtttaaaacccttcagtaacttaccattgctctcaggatgaagtcaaaatttctttgccagactgccagtctaaccatctgctctcaattgcaattagttgcccccagcctcaacttgccatcctcagctattgggtacttcttgctcaactcatattgaggcactatctccttctcacaggccatcaccacctcacctcctgctcccctaaataatcaaatcccctttcccctgcctaactgtcactcatccttgagacttagcctgcacctgaaaggctaccctggtacatcagagctttatgaaaggccctttctctacgctcccaagacactttcccactccctaatgacagaatttacaatgaattgaaaatgtttttcacccggtctccattcctagattgtgagctctctacaaatggagactcagcgtattcttggcacattgaaaactgtgcccaagtgtcttgagtaaatgattaaatgaataaaaggcactgtgctcagcaatacatattttagagctgggaaaaaatctacacacacagttcttaacgtcatagtccttataatctagataaactttccacaaagaacctttctagtgaaacatcaaccagtattaaaataaagtcaactttcatgtgttcttaggagaggagggtgatagcttatgatagcccagcaggtgtgtggttttaaagaaaaacttgttgaaagaataaataaacatgtgaattcaagttttgctgtcattaatattttccccattagaatctttattcaaactattaactagctcattttaaaacattcctttattttctttatcggagtcattaataaatagagttatgactctaagattggaagatgtttcatggatcacttttgaatctgtgatcaaataacagtggctccgaaataatccatcaaataaacagaagagggaaaactcattatcttgagcagctgtaaatatgtttttccaacttaaaattttcttagaattgtgtctctttatagatatatttatttggttcaggaaggacaatgagagattgtcaagtcgaacagactcactttacagacgaggataccaggtcctagaaaagttaattgaccagtcactgagctaactgcattgaatcatcgattgttcctaaagtccttccagctctactgcatgattatataaaccacaaatatatgtggcacccaaacaggggacatctgtttcaccagaataggataggcacatatgtatgtgaaaccttgtcaattcccaggaaggctggaaggggaggatggtctctaatcattcaatagacatacattagggatctttggcaaactctccttggatatgcttaaataggcatttattaagcacttaatatgagtgcattaagatacaaaaataaaggatgaatgactaactcaggctgggatatctgagaagttttcatgaagagtagtatttaagaaggtttttgaaggtatttagtacacaactggaagacattaaaaacttctaaatagtgggggtttggcaaagtagatttctcttctaagaagatagtcatggcagcttttcagcatgaggaggacctagtaatgtgaatgcctgtagaaatgtttatgtttatttccctttaatatcaagatattcttattgctacactttaaaaaagaaaataccccctccttcctgtgcatgaacagaaatgtaagagatacagaagtgtgagttttggtttagtttttttcagttcaactgagtaaacaccaaatttgtataaatcagtaattttttctttaattataatttttccaattaaatcaagcaagtcttaacactccactataagttttgaaacaaatattgctaaataccttaagtcatttagatagttatgatatttttaaatcttacaacttttaagccataatattagcactaaaaccaaaacatttattaataggtcaggaagtgcttgatatgagatattctaggggctttaatatttttctttgtatactgtaatataaaaatttgtccactagatggagatcattttcttaaacaaggaaactattttctactgaagggttaaataaccttaaaggcctaaattatttcttaggaactcatgaaaataaccctttaaatgacatccaaaaaacaaagttcacaatgtatactaagtaattatcaatattgataaaattacattaatctaatattagtattagctttacaaacattgagaatgaagatctaaaaatagtgactgatattttattggactttttcttaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtatctaacctgcacaatgtgcacatgtaccctaaaacttaaagtataattaaaaaaaaaaaagaaaagaaaaaaaatacttgagaagacttaattgaatttccgtaacaaatcactgagtacttattgtgttggagtaaagtaacttgagcatcattaatagtctggggtttcactctaaattttggcaccacaagtattctcagaatacggtttgttctgggaagtgaacctagggtctgagttcatttgcataatttatttccatgatattaaatcctcttataatcaaaattaattatcaagaaaaagtaatattaccgagaatctccagtctgaagtatcagccaatgtcagtattagtgaatgactttatacaaagagagactttgtattttgaaatagtcattgaataaacttttacattacatcctatgtccttagatcagcacttgaataagtacagatatactacacattgtccttttctagaaagcactaaagtctagttaaggtaatagaacatcaagcaaccagagaaaataaaagcagcaaaacaggtggcatctgtattaaatagcatataaatactaaaacacgaaattgtattatataggcaatcagactatgtgatgtagacaatgaatgtaaagggaatttaagaagttgcaggatgtacacctttgaaggagagttaaaaaatgtccagccagagtagagctggggttgggggtggaggccatccagcaaaagtgaagccacaaaaacaaaaccaagaaggaatgaataaggcgtgtatataaaacaggacatttagtgtctggctaaatttgaggcttggtattaaagaatagtggggacctataaaaatggcaattttgtacagttcaacctaataggtagggatggatgtgtttatggaaagctgggccaaggagtgtcagcagaagcttgttataaagacttacgtggaaacacacaaatcaacttttaacattgaaatctcaggggagtaagatgaggaagaccagtatttgttaaaataaacatgttgcttttgcaacaaataaaaggtagaaaacagagtagaggctgagcacagtagctcatgcctgtaatcccgacactttagaggcacacgtgggaggatcgcttcagaccaggagttcaaggttacagtgactgatcgtgtcactgcactccaatctaggcgacagagcatgactctgtctcaaaaaaaaaaaaaaaaaaaaaaaaagaaagacaaaaaacagagttaaaaaaaaaaaggagaaaaataaatgttttaactacaagaggacccccaaaaaggcttgttcattaaatacttcaaatattagaactagggggtttgccttgagtagggaggttagttgtggattttaaaaggcagcacatttttactcagtaggtagtaagttaactgagaattagacacttacttaactttctgaaagttagcctaattagtcagtttgggctgaaattatagatggcttcaaataagctagttatctttgaaacataattttatcaatagtccacatcgtggtgttatgaataaaacaagaaggtgatgaaggataaggtagccctaaccttagatgctggtatcaaaatgatcagttgtgaattttccaaagacattctttagaaaacacttggatgtggtgaattctcttttgactcacagccaattagatggagcccaagcaaaaaactagaagtttgaaaaagtaactaaaggattggggagagtaaaaattaccaagtttaatgatgatggtggcaataataataatgttaataacaataaaacttctggagcactttccatgttccaggcgctgtgctttgcatatattatctcatttaatcctcacaataacactttgaagtaggcactgtattttccattcgaccatggggactctgaggcatagacaagtgactctatgttcagtagtatgctcaagctcataagtgggttttaaactcaagctgtctgattctaaggctggggagaatggactctgtttacacctctattatgaagtttcatttaaaaaaatacaagaataccttttagcttcctcacctgcagggaacttttgaaagtaacattctgattaacttacaggtgacgcatgcaaaggctaattctgagactaaattttcgtatggggctgggtgtggtggctcatgcctataatcccagcactttaggaagccaaggctggtgaactgcttgagcccaggagttcagggccagcctgggcaacatggtgaaacaccatctttacaaaaaattttaaaattacctgggtgtggtggtgcttatctgtagtcccagctaccccagaggtggaggcaggaggatcacctgaactaaggaggtcgaggctgaagtgagccatgattacgtcactgcactccagcttgggcgacagagcgagactctgtctcaaaaaaaaaagttttcatatgacccaacattttggaatttgccaaatccccagctttttccaattctgaacataacagtagggtgtaaaaaagtctttgctgtaacccatttggcgggtttctttatagcatttgagatttcatttggaattaaggaagggtcagtgggtctgcaaaagggcttagcaaatggaactaagtgaggtgctttcttgttccatatgtttgcttcccttaatgcaatttaagaatgcacacaattcttaaaagagataacttttgccagaaggcagttttggaggaggaatgatatagctatatttggtctcccatgagggggcagtaacagtaatgaccagctggcctgctgcattcagaagtgttaaagaatgtgtgtggctagcactactcatgaccatttactccacagacccatccttttctatggaaccagccccctacaagaaacaaagagaagtcggacaaactgacgaatgaactaattactcccagttctccacactgttccatttcagtggaattactggatggtaatacagttccaatctacctttcatccacgctctcaactgctcgcatactttgtgtctactgaccttgtaattgtttgtctgctgaaggtcatttctcatctttttggccttttgctagacactgcttccctagtttaaacttttcccaatttatttttgaccatgatatgggccctctcctgagccagagtcctgctactgtgctgagtaaatagctttcctcatctatcctagccatcaggaccttatacttagcactgacccccagtatgaagcccaaagtgggtggggcaatgagggcctcagtggagcagctgctaaggaacctctatcaatagcagcctccattaccgaagcatctatgaaggccactcacagggaagatcttgctgaatgtcgctgggaatcctgggagccatcactgaagccaggaccatctgaaagctgcctttttcactacatagtaagaacaatggcacatagaaaatattgacctaccaaaaatgttcctgttaagatgtttatttaagagttagaaaacacaggttaaatttgaaatcttggttcagccacttcctatttgggtgctctagggcaagttgctgtattttctaggctttcactgctgataaagataattacaatacctagctctagggccattataaggattagaagagaaaatgtttggaaagcattcaccacattgcctggcagctagtacactcccattatttagcagctattgtttttcatttttattactctttttctcccagggagatcttcatctaggtcattctctttaactttatttgaacacatggctttgggaagaacctaaagggagagatgaaagaggaagagaactgagggccaaatcacctgaatcagcccttgcaatcaatgaggtgacagatgctggagccagattgctctaaaagtttcagctgcttttatgtctccacccaactccataattccagtgtgataacatctggggagggtggagactgctgatttttttctagatattactcactgaggagaaagaataatttcctaccaggaagtgtggaaggcttggaggtcccaacaacctaggtggggctccagctgaatataatgagcagaaacagtccttcagacctcaggtctccagacacagggtgtagcttggggacctcaggtcacaattatactgatgtttatattcctgtactccactctcccctgtgtattgtagctcatgctgttagccaacacattggaactcattttgatgctttgccctcaaggggaggggaggcttacccttgagcttaaggggagagtaactgtaactggatgactacatacatttttccctctttataatactaaatattttacccattgttatcaatatcacaaggttatgaagctcgtttctaatcaatgccactgatacttctctattgaaaatttccctgcaggtcaaatagcttctctgaagtaaacaaaataatgatttgcaaaattcaccattttaatatttacttttctctgattatctatggagatgagactgtagaaactagcattttacagtgatatgcacagatggcaatctttcccaatcaatcataaaactgcatattaaatttaagtaggatacccggagaaggcatgatatttagctactttacaagattacacagctaaattatactacacatgttagcttgtataatatatatatttgcacagagttaagatatttaacagacacgttttaccctttgttttcacagatgatttttataaacaaaagcccagggctgggcatggtggctcacacttgtaatcccagaactttgggaggctaaggggagtggattgcttgagctcaggagttcaagaccagcctgggcaacatgatgaaaccctgtttctacaaaaaaaaaaaaaaaaaaaaaaaaaagtcaggcacgatgatggcacaagcctgtggtgctgaggcaggagaatcacttgagcccaggaggctgaggcttcagtgagtctaaatcatgccactgcgctccagtctgggtaacacagtgagatcctgtcatacacacacacatacacacacacacacacacacacacacacacacacactggtacaaagatgaagggtatatgcttacttatgagtaaaacattaggtggtactggaaatatacaacatatgtttctggcttgtcagtgacactcccaagtaacacagggcaataaagagattcaagatggaaatgatagcatgagtttgatgtctggactataaatgaaagaggataagctggacttgcttagcacacttttgacacaatgatatgataaaaggccaatttttctgaaaagtatttattaggccagtgttatggactgaatcttgtttcccctataattcatatgttgaagccttaatcaccaatggttacatgaggttgaggttgaggttaaatctatcttgtttcccctagaattcatatgttaaacgaggccatatggatgaggccctaatccaatagtgctggtgttcttataagaacagagagagacacaagagcattctctcttcaccatgtgaggacagagtgagaaagcagccatctgtatgtaggaagagagccctcaacaggaaccaaatcagccaatcttggtcttggacttctcagcatccagaattgtgagaacatttctgtttaggccaccagtctagggtactttgttatgcggcctgagttgactaaggcaaccagaaagccccaaccaaaaattgttttacttgaagtttatacattactttttaatgactgttaagaaaaattttcttaactgaaactctctctaagaaagcatctcaaattattgccaagaccaatgccatgaaattttccccctaaattttcttctaggtttacagcttcaggtgttataattaagtcttgagtggattttttgtgtatgatttaagataaaggtttagtttcattcttttgcatgtgaatatctagtttccccaataccattttccaataccattcaagacttttcttcattgtatattctggacatccttgtcaaagatcagttgactgtgtatgtgtgagtttatttcttggctctattctgttctattggttttatgtctgtctttatgccagtaccacattgttttgattactgtcacttagtaatatgttttgaaatcaggaagtgtgagatctccagatattttgttctttttcaagattgttttgactattcagccttttgtggtttcttatgaagactgcttttctatttctataaaaaataccattgggattttgatggagattacattggacattgtggacattttaacaatattaagtttcctaatccacagcagcatcaaagcataagcaaaaaaagcaaaaataggcaagtgggactacatcaaaataaaatgtttctgcacagcaagggagaaaacacagtgaaaatacaacctacagattaggagaaaacatttgcaaaccatatatctgatatggtattaatatctacaatacataggagctcctacaactcaatagcaaaacccccccaaaacccaattgaaacccctcaaaattaaaaaaacccaatgaaagaaatggacgtttctccaaagaagacaaaaaatggcaaacagggatatgaaaagatgctcaacctcactaatcattaaggaaatgcaaaggaaaaccacaatgagatattgcttcactcctgttaggatggccattattaaaaaaaaaaacctgttggcaaggacatacagaaattggaatccttatgtactgatggtgggactgtaaagtgatgccactactataaaaaacagtatggaagttcctcaaaaaattaaaaacagaactaccatatgatctaccaattcaacttctgggtatttatccaaaaaattgagatcagcatgtcaaagagatatttatattcccatattcatttatgtatattcacaataccaagatgtggaaacaatctaaatatccatcaatgaacgaatggattaaaaaatgtggtatatacatacaatggaatattatttagccttaaaagaaggatatcctgtcatatgctacaacatggatgaattttgaggacattatgccaagtgaaataagtcagtcacagaaagataaatattgcatgatccctcttatatgagggatttaaagtagttgaactcatagaagcaggaagtagcatggtggttgctgggcctgggtggagggagaaatggagagttgttgttcaatgtgtatcatttaatcatgcaagatgaataaattctagagatatgctgtacaacattgtgctaacagctaataataatgtactatacacttaaaatgtaagagggtagatctcatattatgtgtctttgtttttagcacaataaagcaactttttcaaaaaggatctcaaatggccctaacatgaggccatggtatttggactcttgaggcaaagcctgcagtagcagtatgaggtccatatttgcagtaattacctagaaatcatgagaacttcaagtagtaaacatatacattcaatcagaatacgtgctgacaatgggaagcggaaagtgtctttttttttggtagtcattgggaggccttaatttctctggcaatttcatgcaggtgtcactgtgattgagaataaaacaagtagagatttatttcttcccttacatcctattatcatgtgctgaccactaactaagagtatggagggaagagcagaaaagcacatgctctccaggccaggctggacctgagagtcagctgtagtcccacaggaataactcagttttattttccttgtactgctcacagcaggttactaccaatctttcactttctaagatcacttctaagatgctatatttccaaaatgcactctttctcaaaatgtggcttcatcaagctaaagtccaaagaggaatagcgtcttgttaacaaagtggggctcaagatggattaaagacctaaatgtaaaagctaaaggtataaaaaccctggaagataaccaaataaataccactttgaacataggaactggcaaagatttcatgataaaaatgccaaaagcaattgcaacaaaagcaaaaattgacaaatggaacttaattaaactaaagagcttctgcacaggaaaaaaaaacacaactattaacagagagtaaacagataacctacagaatgggagaaaatgtttgtaaattgtattacctgacaaaagtctaatacccagaatctacaacgaaattaaacgaacattcaagcaaaaaccaaaccgccccattaaaaagtgggcaaaggacatgaacatttttcaaaagaaggcatacatatggccaataagtgtatgaaaaaatgctcaatatcactaatcattaaagaaatacaaatcaaaaccacagtgagataccatttcataccagtcagaatggctattactaaaaagtcaaaaaataacagatgctggcaaggttgcagagaaaaggaaacgcttatatactactggttagaatgtaaattattaatagttcaaccattgtggaaagcagtgtggtgattcctgaaagaactaaaaacagaactaccattcaactcagcaatcaaactacagggtatataccaaaaggaatataaatcattctaccataaagatacgtgcatgcatgtgttaattacagccctattcacaatcacaaagacatggaatcaaactaaatgtccatgaatgatagattggataaagaaaaatctggtacatatataccatggaaaactatgcagccataaaaaggaatgagatcatgttctttgtaggaacatggatggagctacaggctattatttttagcaaactaatgcaggaaaagaaaaccaaatactgcatgttttcacttataagtggtaaccaaataatgagaacacacagacagaaagagaggaacaatagacactggggccaacttgaggatggagggtgggaggagagaagaggatcagaaaaaaaatactaactgtcaggtactatgcttagcacctgggtgacaaaataatatgtataccaaacccccggggtcacaagtttacctatataacaaacctgcacatgtaaccctaaacctaaaataaaagttaaaatattaacaacaacaacaaaaaaaaaaaacaagcaagcaaagaaaaatacccaaggtagtgttgcggggtgtttctgtctttatttattgtttctatgacatagagcaagtaaaattgatttaataagccgactttgaaacattgatattttaatgatgtgccctgctacttctccagccacccacccacatttattctttatattgcagacagagcgatcctcctaaaatgtaagcccattctcggcaagttcctactcattatcccataatggtgtcctattttattcagagaaaatactacgttctcccaatggtttaaggccctcagtgacctggtccctggtgcctctctaatctcatctttacctacatctctccctcttgttcactctgctcagcctcttggtccctagctgtccttgaagcactgtgcatactccctccccagggcctttggatttgcagttctctttgcctggcatattctttctagagatatcagctcaatgttaccttcatgagatattcccatactggcctatttaaaactggcacccctaacctcctaaccttttttttttttgaacaaacaaacaaaaaaccttccttactcttaatttttctccatcgcatttaacagcttctgatgaactttgttttttacttattttatcatcttactcaccccattagaatataagctccacaagtgcagagatttttttttaaaaatctactttgttcgttaatgtgtcccccagcaggtacaacagtgcctcacacgtacgagttgctcaataaatatttgtatcgtgaatacatgggtatctttagacgcagcggtactttttctataccggttatcatttaccatggttatctgtgtagttctactttaaataaacttcataactattttttaatttagctaggagttggtcacttatttaaagaaataggttaatgagattgattagcacatttgaagaaataatctggaacatctctaagaaggcattttaacgggggttattttgaatatccttctgtttgaacagcagtcagccatgcaatcaggggtgggatcaaggttttgtggtacacgaagattatacaattataagggtctgctttcagaaaaataatacaaaaaaatcttagttttttgaattttacaaaacctaaaactacgtgcagctgctagtaccacttcttacaacttgaaagggaaccaggccagtgagaagctcttagcttgatcttcattagtttcacctcagatctgcatctgaggtaattacatatcaggaaagaataagaaaagaaactggatgggtgaaaataaaaatttagcaccttatatcattacttaattaattatgtgttttctgagatggagttttgctcttgttgtgcaggctggagtgcaatggtgcgatctcggctcactgcaacctccgcctcccgcgttcaagtgattctcctgcctcaggcccccgagtagctgggattacaggcaggcgccaccatgcctggctaattttgtatttggggtttctccatgttggtcaggctggtctcgaactcccgacctcaggcgatccgcctgcctcggcctcccaaagtgctgggattataggcgtgagccaccgtacccagctgcaccttctattttcttaagagataaattgttattagttttttcttcattcctttttattctttccctccctccctatcacctccctctctccctccctctctattttcagtacccaaattttcaaagcttactcataattctcaaaatttctcttgttagttgcacgtgtttatttttcccagatcagtgagtgtcacctagtcctggggaatggggagtgattccattaggtcagatattgaactcactttgaagaggggtgatcttcaaaccatacctgtctctcaagatattacaattttctttttgagggatgggttttaaaaatgtgatcctcaatcacattcctggctatttgggtatttaggcttactaaaaattaatctccaaaagattttattgactaaataagaatgattgaatgataaatcctttgtagaaatacttagccttaaaatattatgtgttaagtatgttaaataagtctaggtaagattataacagaaaacaaaaaagtaatagttctactataattgcctttaaaatataaccgaattctgattcttttagactaatggatacgaaaactcatataccatgtttttcctctgggtttgcactctgcatcaaacaggtcaggaaaccattcaccagccctactattaaatctattttggagaagtgatattattcagtttccaacctcaacaatccaaacagatgggttttctgccttaatggggcttgaatgaatggcgaagggcttcagagggttgtgtggcctgaattacagacaattttttcaatcttactgggcaaagcaatgataagaatattatcttacgatggccataaacaatcacttgcctcttcaattcttttaaaatatatagtggagaataaaaaaagatatgtctcattatgtgtctcattgtataataagtacactgagattagctttctctcatgatttcttatattgggtgaattatgtatggttacaaattatcttttaaaagttttaagatgttggatgggctaccacagaggtagcaggatctacttcaacaatgattttatagagtgaagaaacattttcatgtttccttgaaatggaatctggctgaagacaaaatgaccttgggaaagcatagaagtcaataatcaggactgtgagtataggaaattctgcttgttgtctgccatattccattctctgcctgttcctgggcataaaagaagttctcgttcccttgcaattagatttggccaagtgactagatgtgagcagaaatattgcatgccactttcaggactggctcatagctcctcccacatgcctatcttgatgttctttttctgccagctggatgctaaagatgctgatgcgtgaaggatggtagaaacagaaggtgggagaatcctggtccgtgactgagagcaaggagagctgccacatcctcctaaacaccatcctagaacgctacttgatgaagaatgagtttattttttaagtcatttaatttgggggcttatttgtcagcacaataacattcaacacagtgcgttccatcaaagtaaactggaaagtacgtactgaaagtacattagactttcaaatgtctcacattcaatctatctctggcccaagtgaaaccatctatgtctttacttctaccaccttcacacttcatttaggttttttgttttgttcccttgatcttcctcggttaacagatattttcattatgacatttctcattacctaagtgcttaagagatgttagagaataagtctataatcattacacacagttgtgattgttgtgtaaagtgaaagccagtctggttctgttctgtcttaacaacaatcagcaaagttacagaggatcagctcaagtgtgaacctgacacatgaatttgtctctggattacagaagacacacagaaccgagattaacaaacactcaggatttacacccgtgcttcacttgagccaatgagatttcagaagtaccagatcgaaataggcttcccttaagacgtcaaagcattgcaacaaaaacaaaaacaggcaaatgggactatattaaaaccaaaaatctctacatagcaaagaaaataatcaacagagtgaaaagacaacatgttaaatgggagaaaatatttgcaaaatatatatctgacaacggactaatatccagaatatgccaagaactcaagttaacagcaaaaacaaaaccaaaccaaacccaaataatcccatcaaaaagtggacaaaggacatgaagacatttctcaaaagaagatgtaaaatgaccaacaggtatgtaaaaagtactcaacattactaatcatcagggaactataaatcaaaaccacagtgaggtatcttaccttagaatggctattattaaaagaccaaaaaaaaaaaaaatagatgctggtgaggaagtggagaaaagggaattcttagttggtgggaatataaattaatatggccattatggaaaacagcatagagatttcccagaaaactaaaagtagaactattatacaatccagcaatccccctactgggtgtttatctaaaggaaaggaaaggaaatctgtatatcaaagggatacctgaacccctatgtttattgcagtactatctacaatagctaagatatggaatcaaccaaagtatccaccaacaaacaaaccgatagagaaaatacatatatatatatatatacacacacacatacacatacaatggaatactatgcagtcataaaaagagcaaaatcctgccatttgcagcaacatgaattgacctgaatgttaagtgaaataagccaggcatagaaacacaaatatggcatgttctcactcataagtgggtgctaaaaaaagttgatatcatgaaggtaatagaatgatagctaccaggaggaggggaatgaagagaggttggctaacgtatgcaaacatacagctggatagaagaaataagttacaatgtgtgatagcagaatagggagattatagttaagaataatgtatcatatatttcaaaatagccagaagaaagaaattgaaattattccactacatagaaatgataaatgcccaaggtgctggataccctaaataatttgtctcggtcattatacatcctatttatgtaacaaaatatcccattatcctatgtacaaatattgtgaattaattattttaaaattctgttaaaaaacaaaaattaggcttgccttattcaaaatgttattctgaagcaaaatgacattttgaatgtgcacacttctggggaaatggttcagagtctatagaaaaattctagaaatatttcacaatttatccaaacccagactagaaccactcttcactgttgcctagctcatttgcagtgggatcaggatgagttggttcagactggcaatgtcgtaggttgaatcagatgcctaagaccattcctgttctgaactcataggctaaatgcctttctagagccaaatgttcctctctagaagaaggaaaggatattacctggggcatcctcttgccagtatagcactctcctcaaatttgagccctctttctctgagtttcagtgtatttctggtgtaagaaatatttcattgccaccttagagatcaaactcaaaggattaatagatcctgagggtgatagagtaggtcatagaaaagagatacctatccattccacaaatgctcatcaactacctactctagccactctgggaggaataatgaagctcattgagaagacgtaaggatggtagtagttacactgatcttctgctccaaaattaatttggggttttccttcccctcaggatgaccaaattcatggtgaggctattcataaatcctgttgacttgccaggtccacagccaagataaatgcacagctgttttctaaaggcatttgacctcttctctaatcacctcaagttgagaagcaatgttcattgctgactttctttgttttgacattaactatgttctcaaataaaaaatcaagttttacttctccagccattaaaatttctctcatttttatgaagtaatatttctcaaacatttgaatatattcatccatttttgtgccacttcatctattttctagatagattatgatattcaattatgtgtattttgtctttcttttttctttttttgtagaatttattcgatataatcttggctcccattttatttcccacttatcctcttttaaaaaatgacttatgcttttttaatgaggagtccaaaatggcacacagaactctaagtacagtgtaaacaaggccatctgtaatgagaaagccattcaattcagcaaagatttttctaaccagctatacatagtcatgacagaatcctcagatttagtgtttcctagtagcaattgtaattcttttgattgctggcctgtaaaatacttagtactatactgtaccatgacagtggaaatatgtaaatagaacctccatctccagcctgcttatataaaatgaataccactggtaaataatttaatgttaaatgtagttacttttacagaaaaatatatgctgtaaaataacttctactcttttttcatacattcagatagcctaaaaaaaggatagatgtcagttttttaaacttgggggaaaaaagaacccaaacatgattatatactttgctgacctttgaaatttaatttgaccaaattttgaaaatagtctttgagaattacagagtgagcaaatgccagtacttcatgaaactcaaatcgagtttttttttaaataagcagtgtaggtatcgtctttgctttttccatgtctttaagacttttaaaaatcttaaaatatgactgtttcaccactctttttctttttttatagaattcagaacttaagttaaatttgacaagaggaaaaataaaatccaaaccacatctatgcttattctgctcttggcttcttcctacagagctgtcctttaaatttgcaatgtaattatgagtttccataccacatatgccactaatcccacgaaagtatgtggcccttcagaccacatgaaaaaaatctctcagggcaccttgggtgctttacccacttgccatgtccaaaaagagttccatctgtgcccctgatggtcagataacctgtcctgggtgagacaaaagaattattcccaaaggccttttcctcctgtgcttcttatgccctcacaagcaggttgtttctgagcaccttcacaggcattgttcagtggaattcacacagtgaccctgggcaataagtgatgggattgggagtgtagatttttatccttatttgctgaagaaaaatctgaggctcaggaaggagggcaatgatgtgcctagagtctcatagatttaaatggctggattacgactcaatcccaaatcttctgttctttggactaaagatttaaatgaaggattgaacaattggattacttttaatccttcataaagcttgaatgaaagacaaatgcttattttaatgtctcttatgagcactcactagaaatattctctagccgagcacaatgttcaaaacctttgtgtggaatgttacattttgctgaaatgaatggatgtgcttacatgtctgtaaatagtagaatgaaaaagctggaaaaggattttagcaagagtccttcattttggtactcttgttaatcatcctaacaatattgtaatgctttatagtgtatggtaaatgtttgttaatacttagagggagatacagaaaacaactatctggttaaatttacttaaacatatcagaccagctttgcaaaacaaagggattcccacttgatattctgaagaatatttcagaaaaatatgaatgtatttcttttgtattatttattgatttttaaattttagatccaggggtccatgcacagttttgttacatggctatattgcaggaagctgaggtttgggcttctaattatcttgtcacccaagtagagaacataggacctgatagctattttttgacccttgccaccctctcttcctccctgcttttgcaatccactgttgatgggcaggaatgtatttataacgcaaagataagaactgatgctgggcaatactactgggttgagaattgggagccttgagtttgagttctgaccccgctactacctcgttgtgattttggcaagcctcttgacttctctgggacttagctatttcatcaatgaagtaaagagattgtccttttcaattactgctacatatcactttggagaggcttttaaaaatacagattcttaggcctccttttggatactctgagtcggtaaagctgaagctggatccaggaatctctattttcaaaaggctgtcatagctatttgatgtgttgtcaggttgagaacaccggacttgctgaccttctagctttaacattcccaattccaactggacagcactgaactcagctcatattcctctatgctgtgcttactcgggagcgggagtggtgagaagagccaaagctgtcgtcaccaggctatattacaccaccttccttggtggtgtccctgcccacatgcccagctcttcaacaccactttctacgctgctgttgggattttgtgtgtggttaaacgggatggagaaagaagggaaaaaaggagagagggagagaaggaaggaaggaaagaaaggcaggaagaaaggaagaaggaatgaaggaagaaaaggaaggaaaaagagatagcttgcagtggctagaaaatgtaattattttacttccttgaataactacttttgcctataaaagtggattctttatcacggcacttaggttactttaaaatcttgtcctaattcccttcaaatcttgtctctagcccctccaaagatacttctggtcatactgttctcactctctggagtatgtgttacagataatgaagttttagacccaaccaatttctgcctcatgaaatcattctcacttttcaaagctcaacatgtagtaagaaatgtgtaatatgacctccagttcttccttccacaattccaaacatcttattcacactgtcaataaagcattatctcagggttaaaataataaagcaactggctttaaacacatttctccccttatcaactaccccttcccagctatttgaggttgggggtctccataccatttactttaatcatcataaaattaacattcatgttttgcttgaccatttgccaatttctttacatccattattttatttgcatttcataacatttctgttaaataaattttttgtcaacccattttattgataatgaaactgcaaacagggaggtttactggtttgctggttaatgatgaagctgagatatgaacctagatgctgtgatttcaaatcttatgattttcctgcactgatttacaagacatcgacaggtgctcagcaaatgcatattaagtgattaatattaagtgaatgaataactggtgagaaaaggcctcatggtctcaaataatggtctctggtctatgcttgcatcttgaatctgcttcttgctatctgaacaatgtcagacaatatatctaatctgtctgagcttccctttccttctttatcacatggggaaatcatactgccctcatataggtgtgtgtgtgtgtgtgtgtgtgtgtgtgtgtgtgtgtgaactcagtgatatgaaatgtgtaacgtgtcctcaccagtgtgtgcacagagtaagtcctcattatatgtttgcttcttaattttgtgggaggcagtcattttgttattcattgcatctgaattttatgcataagcctacctgtggaggttacatttattcctgagattttaatcctctctcatcttcagtgagaaacagtaagagagacactatatgatgatagttaagaacacagggtctaggcagccctgagttcaaaacctgattctctgcctttgtagccttgtgagtttggccaagttactcactctctccatgcctcagtctcttcttccataacatggagaacatgccatttagaattatgcctggtgtgtgataagtgccatgtatttggggctattacttatgttatgggggcacaaaactaataataggcatggttagcacaataatgagatatttgtcctttgtgtttctcaaccaaaattgatgactcttgtaatataggatcaacagtaaactgggaccttgtcatttgcatttggaatagtaggtaacagtaattagatgagcatttgaagaatacatgagaactcacatataggaaaacaaagtaggagtgtgcattttgtatttaaacataatgaagcatcagctcttatgtatttatgaatggagaaggaaaaaaggtcattcgacttttgttgagcaccgtggattactatctttgatgctgtcatttgaaataacaaaaactgcctctgcctttccccagccctactattgaacagaaagaactggaaggagaaagagtgccatcttttagaaatggttcctctgagtcatagttatcccttttgagtaccacatcaaaggctctatttcacctgagaaatctcatacgcatttcaaaagtcaaactgtaataacaaaacctacactacctataatgtcaaaacatcaagcaagatgtaacaatctctctcatatcctagtctcatacatattggtgtgagttaaggacaaaggtacttttgactttaagacagtaagaaatgtgaggtcagtgtccttgggaataactagaaaccagagatatttattgcctagagacaacgttaagatgatctcagaaaggttttctttggaatggtggagattaagtggcaaggccaggtattcttgttaccaaaataaatactgcttaagcaacagcaaacatgggagagggatgacagaagaagggtttctctatccctttgctggagctaaagtaaaacaggcaaatgattttgaaggctcagcatttaaatctaccatatagggtttaactattggtgctgtactgctgtctgttgatagaactatgccttctcctgaagcttcaaactttagttgatatctcaggtagaaagtgtgttcttcaacatctttcatagctttggcaacactgatcacgttgctgaaatgcctcctcaccggagatcttaccacctgtgaaattctcctcaaccctgctctctgcctctgaattcctggacagaattagagctgatatacaagaactcccaaaggcaagcctgcccagacagtttttaggttggtagttcactgtccaggggacccagctgccactattctacaggcctttttccaagggtaacacaataatcacaatagataataacaacagagaatgtactatttttagcatttcatatccattgtctcatttgatttttattactatgccggataaagcaatggtgctaagagaagtaacttgcctgaaatttgtatttttatccattataattcgttgcctctctaggatccaatggccccttagtaaaaaatactgatgctttaactctaggttcccaaatgccatttagctccccaagcatcgtactgtggcaaaaactacatgcactttgaaatcagatctgaatttgaataggttctgttacttgccagctaggggaccttaagcaaagcttcttaccctctctgagcctgcaacactcaaaaaggattacaaagcactcacatattaaaatgagttaatgaatgtgaaagcacctagaacagagttttgaaaatagtacatgctccgtaaatatgaaattcctttttcttctttcccctttgaatacatgggagtttcctatacaatgctttggtattttaataagatggtcttaattttactcattgcatgcatcttgaggccagtgaagcactaacgcaattatctctgtcaagccttccagttattaaaactaacagccatgacacaaccttctcagttcaggcagcccacctatatttttaatgggagtattggtatatttacagtctccatcagaacaaagttctgttattattttgactctaggaccattattttatgtgacagtgactttgtcagaggagagaaaggatgtgactttaaccctggtttttaaaaaagagcaattttcctattataaactagttaaaaactcttgttgaatagcatattgcaattgatgtttggggtaatatgccagttttagcaagaaataacacgaaatagaatgctccaaatttattatttatttgcacctgtgctcacccacttattttccttcagccttcatagttcttcagatatttgatgagtggtgtaggtgatgaatgaatggcacatgtctgtaaaacactaagctcagctcaagacctgcagatcttcctagtgaactaaccaagtggttcagttgataacacaagtatagtatcccaataggtttagaccctgctctggactctggagaacattgtatctgtttatgtcattctaaaacatagccaccctgttgcaaagagtttcaaattttggagaccagagacccctttgagaacgacatgacttataaatctttggaaatgtgagtcttcggaaaaattcacaaacacacacacacacacacacacacacacatcccttttggatgtaattccataaagttcagtatagcctagtgattaagctaagggctttggagttagataacctggcctaaaataatgaccctactgctatttagttttgtgaccttcttcaagtcatttagtctctttaaatttcattttaaaaatgggaatgaaaacagtacctatgtgatgagtctttatgagatttaaaggagataaagcatgtgaagtgctcagcacactgtatgacacttactaaatgctttgtacatttttgttattttaagggagttacagatctccaaagcttatttgtgggcagcagattaagaatttctgctatgaaaagaggacaaagttcaaaccaattaaggaccatctgcctaccataaaaacaagatcctattgaagttaaataactatcaataaaagggcattcaacaactaggtctgctaccctgcctggccctgagcaagtaggacaatgggtccagccatgtccctgttctttctgaggagtggcaactgtgcctcctactgcacccgcctgtaccagccatggctgagaacttggcagtcatggatgctctctacacttgactgaaaaagaaaacagcttcttggctgtctgagccttaaaaggtgattgtcctattcctgacatattctttacaaagttctaggtgtaagaaaaggctgtttcaggttttaatgagagaatatttgttagagagaatatttgttaagcgcccagcttaaggacacacacaaaactatcaacaaatgccatctctttccaaaggtcaagagagagggtaactttacttgacgaagtcacagctctgggagaaattccactgacactcaggggactaagttatgtagtttaactaaatttgacttgaaataagtaggcatttaagagggcttttctctggggattttacacatattttgctgatgttgtattttaaggtatcctattttggtcaaagtagattctttagccaaatcagtacattttgaaatgactaaaatatctagcagccagcaagttcagatacactgatctttaggaggaaatagccacaaattgaatagtacttaaagaattctgtatcattttgctttgtttcagaaagattatcacagggaaaagcttagttaagtgactttaatattaatatattcatttctgtatttccaatatctagcataattctcacaccaggtataggaaagtgataactatttattgaatgaattttctatatatgtatgtcaatatccatttttaagaactccatggtcaggcatggtggcccacacatgtagtcccagctactcaagaagctgacattggaggatcacttgagcccaggagtttgagtctgtagtgtgctatgatcagacctatgaataaactaggtgaggggaaatttactgtgcaaatacctgctatggctgatacaaggtgcagattatagctctatggtggcctggagaacctcacacttcttaatgggttctctaagcaggtgaccaggagaatcactattctatttttgataaagtttcactgatcttttttcaactagtcttaccaaattctctgagcaacacctgctgcatttgatctcaactcaatttcaactccactggggtgcatgggtgggaacaagagaaaaataagggaaatatttaagtaaatgaaatttagcaatgtcagaagagacagcaggacaaattgcaatcaataatccaccagcaatgctaatcacttaaaattgtacatttacattttccaatgcaggaataatgatatcaatatgaataccaatgacaacagtaacgataatgagttcacatttattgagtatttactgtgtgctgtagactgtgttaaatcatttgcatggcttatttcatttaatctcacaagaatcccaggtggaagagactggcatttcctttcctcctttatagataaggaaactgaggcagagaggagttaaataaattatggacagatgtagagccagtgtcagagcatcaacataagaattctccatcgttatactggcttttctcacaatatggccttagaattacctgggatgcttgctaaaaatgattagctctcagtgttatctaaagcaaatgaatcagggtcttagggatgaagatcaggactctacatttaagagacagcaggcacagtatttcttacgtacatcacagttggagaaccagtgtctgagcagtatgaatttcacagcctgatactgctacatgaaccagattgagtaaaatgattctcgtttttactatagagtcgtataagagagaaaatatatcacaacattaaagagaaacagtaaaatcacctcaactattgaaatcatttcaacagaggactcaacttctgaattgatcatagagatataactgcttttgaccagctttagaaggcagatttttgtatttgtctctcatatggaactggggcctcaatttcccatttgtaaaacaagagtgtcggactagacaaaattttataaaactgcaggtttaaatattaataaatatataaatgttttcccttttttaaaaaagagaattcactatacaatttcttaaaataaccttttttttttttttttttttttttttttgagacggagtttctctcttgttgcccaggctggagtgcagtggagtgatcttggctcactgcaacctctgcttcccaggttcaagtgattctcctgcctcagtctcctgagtagctgggattacaggtgcccaccgccatgcccagctgatttttgtatttttagtagagatggggtttctccatattggccaggctggtctcgaactcctgacctcaggtgatctgcctgcctcagcctcccaaagtgctggaattacaggcgtgagccaccggaactgtttttttatatgtaggcttaaaatttgttgtaaaaactatctggaagtatatttagtatgtcttgacaagtttagacaccatttaaactctttgacccagtaatagcatttccaaaaattttgccaaagtaattaaccagagatacagattaacatttcttctacaaagatgcttagtgaaccactacaataaagaaaaaagaggaaaatttaaaatgcccaacaatgaaagaatggctaaatattgaataaatcattttattacatgtaaaatggattcctatgtcaccattagaatatcagatttttctagaatcctaaatgacacgagaaaatacttcttaaaaatgtcaagcgaagaatgcagaataaaaaattatatatatatacaggctgggcatgttggctcatgcttgtaatcccagcacttcaggagttcaagaccaccctgggcaacatggtgacaccctgtctccactaaaaattcaaaaattagttgggtgtggtggggcaaaactaaaatcccagctactcaggaggctgaggtacaagaatcacttgaacccaggagacgtaggtttcagtgagccaagattgtgccactgcactccagcctgggcgatagggcgacttcatctcaaaaaataataaataaaaattttcaaaatttggaaataatatatgtatacacacacatatatatatatacatatacatacattttaatggtcatatatatcctattatgtgccagatgaatatcaggtaggtctctctctctatatacacacatatatgtatacgtgtacacacatatgtatacacatatatatatacatatatacacatatatacacatacatgtatgtacatttacatatatacatatatatgtatagatatatgtatgtatgtgtgtgtgtctgtgtgtgtgtgtgtgtgtgtgtgtgtgtgtgtgtgtgtgtgtatagagagaccgacctgatttcatctggcacataataggatatatatgaccataaaaatgtatatatatatatatatgtgtgtgtgtgagcatgtttgtggggtatgtgtgtatatgctttaaaggtttattcaggaaataaaccaacacgttttaatgatggctatccctggaagctgcaatgacaggttatgtgtattttataaaatattaataaatattggaatatttattgggaattttctgaagttcccaatttgtccacaatgaacatgtgtttattttgtagttagaaaaacatgttattacaaaataattcaataggaaactacttttagaaatgcatttatgatgcaaggtgaagcatatctgcaacatgcttcttgctgacaaagaggcctctgaagcaggcctcaccaatgttcccaacgatggtaaatttggcaataattgtgttgttaggggagctccaagcttaaatgctgcaattatgagctagggtacacaaggacatgttggaagtgacaggcaatatcagcttcctccaaaataatggtcaagcgaatatgtgcttttgcccaaaaaggaaagtagcacagctgtaactggatattgtaaataagtggtcaaaggttccctaaataagcaatatcatataagcctccttgaggcatattttttccttctgggagccgtgttaggctcacagacatgaaggcagccaggaaactgttatctgtttacttctaatttatttttataactgtccatgccagcaacaacaacaacaaaaatgtttctaggagaaaaataaatttggcaataaactctctgagttttcgaaaaatcttaccaaatcaaaaacttctacttatcatgttgctgtcaaacccagcctcataaaaactttacttataattgagtgtatgtatgtctatctgtactgtaaccttgatacttggcctcaaatcctggttctgccaggagcttcgtgcctttgggaagatttcctagcctctccacatcttgcttttctcatcttaaatgtagacaatattataccatgcagggctctgtgaggttgaatcagaaaatgccactaaactgcaaagcacaatcccaggcacattgtaaaaatggaaaaatcagcttgattccattcccctcttgccatacaaggatatttcaggtctctcaaaagcgtttcaaggaatagaggaagtagtcaaacaagtgtgtgtgtgtgtctgtggatgttggtgtgtgatgaaatatacatataaatattatatataaatgtatatattatatataaaatatttgtaaggatggaataactagtatctgcttaaacaacaactacacttcgaaaatcctttatttttcctgatgagttttgttcaggtgaagatgttcactggtaaaaagacaaggcaatccatttcttttctacagtgtcagctttgtttgaaggacacaatgacatctattcagaaaggtaccaaccattttgcttttaaaatactgaggcaaacctctctgaggtttcttcaaagccaatggcaacaaacatatttcagcatctgttttgcttcactgtaggtctgtgtgtgggtaggttataaaataaaaatgagcttgccattacagatactacttaaaaaccaaaaaaactatgatcatgatgttgataattctgtattcattatcctaataaaaacacataaatgtctagaaagaaatagacaattatgtattaggccttccgtctcttatttaataatagcagtgtcattgctctagttaaaacccgctctgatcttaataaatctgatgtaaaaacatatcaccagatggggactctgttaatcttatgcgatactttcaactatgatgactaatagttctataatttttatatggttgctcttattgaggaaagagtaaccatttaagggaatcttccaccactgttctttgttgaaaggaaggctggatctacatgcatgccaacatactactgaaaagtaaatatgcaatccaactattcaacaatttggaatcattgcaatttttatagttccagatggtgatctttatccagatgaagtgagactattttactactttgtcagaactctacaactaaatatttataaccctcaaatacacagatacattatcacagtgtgtgtgtgtatatgcacatgtgtgtacacacttttatagaatgagaatgaactaggttttgtaaaagtttcagttacaagccacatgcctatgttacacattctgtctgtaaactacctacacccacacacatatacattcatgcaccaatataatatggttttcaaaatcatgtcacatagttgatctcattttatctcaacaggaaccacagtctaattgaaataaatgcctctgccatgaaactaagtcagttagtaactgtaaaggagttgatttacaggaatatctattccatggcctagctaactgaactcattaatgacacatgttatgtaatgcttgttaaattagtgaatgctcttacattgaaagacacatagtaaagtgctgaatttcaggaggtgagctagtagtttcaatgtttgtgggcaccatttaatgcataggaagcctgcatttattgagtaaaatttagagaaaaaaagaggccctgcccattgtaactcaagattaagggcaacttcaatttcccagagcctccgtaatgggcactttaggagaggtgaatatggtttgactggatagagtacaatggctttttacattgataaaatttgctgtacaattgtttactggtgaactttttaaaaatggaaatagaatgtaggcttcatatgttactaaggatacccttgattatgtaataggcacttgcattacaaaaaatgaaaatggctgaataggtagcctgagccatagtttctgcaacctgttctcctttccagtgttattaatcacttgaacctcacctgctgctctggctcctcctccttgatctttacagatatgactttaggcagaaacagattcaggagcccagcaccacaccatcctgctgcagttaacttgaacatacgtcttatctctgattactactggcttctgctttaattccctgtgcttatcttccgtccctgagactccagtccacctggccttccaacataggcttaagatactctcttcctgtcccatccatgaactgcaagctggtgtatagagcttcctgaagtcacatgatccagacaagtgattaccaattttattggataccgtatctattagtaaaaaaaaaaaaaaaaaaaaaaaaaaaagtgcaagcacctccattacgtatatttattttcaataagttatgttcttgcactattatgtcaaaatattatctattttacaaaatacaagaaaaagaaaatttgtgagcggataagaaaaaatataagattttatttccatacctcaataagttgtcctgttcacgcctgggcatatgtctaggaattacctgttctgagccactttttaggagactgttatgttttgcccccaaagactagtcagggcacactattgccaatatgcctggctagatggagcttttcctagtgcctggtgagtggttcctgctcttgcatctatctgccaccttacccacctaccacccagtcccatcagcctctgcttcatcccagtgaaagggctcattgcggattccaatccttatcattttgtcttatgctactgtaattaaataatcaactccctgggacaagaaaaggtaaaagtttcttcaggagttagcaaatggctacaagcaataaaaaggtttagaaggcaaatagaaatttagttacatcattgttatagttgtaatgtagtatgtttctctcaatgggttgcaccagagttcttttttttctacttgtttctattgagatgttatttgtaaaatgtaatttatatctgaggtgtctacacatgatagatgatacataaaattttatctgtgacacaaagcaataagcaaagtagggcacatgtaacaaatggtcctgagacgtatagtgggaaaaaataaacttgtatccctaccttatattaagataaattccaaacagattaagagctaggttaaaaaatcacaaatacggaaaatgtagctaaacatttatctactcttaagataaaagccctcaaattattaaagcaaagaaagaagttacaaaagaaaaaaaatcaataaatttgactgtataaaacaccatgaacaaaagtaaaaaggggactaaaaattggaatatataattacaataaatgtgagctggagaaggttcatctatctaatacataaagaactcttgcaaaaagtaaaaaactatgcaaccccaatagaaaataagcgaagagacaaacagaaaattaacagaagataaatggctaataaaaatattaaaaccatttttattcacaccagtagtccaaaagtgttaagtaaaacaacactgaaataccactttaacctaatatgtggataaagattttttttaatgaaaaacatttcctgcagcagcacagtaagatgagaactctcaagcagtgtggcttggagtgtaacctggtataacctttagagaagtattttttgcaacatatattaatagtcttaaaatagtcatattctttgacatagttattttactaaggaaatattcagagataagccaatgtttcagttcaaagatgttccttgctgataattttaataattgggaaaagctagaaacagcctgaatatccaataattggcaaatacataagttacaaaatctttttagggtgaaacattttgtatccatataagtaatgtttgaaataatgttaagtgatatggaaaaatgctcatgataaaatgctaaattaaaaaaagaaattaaaactgtacaatccaggtaattgctattagtatcatacttgcttggaaaaagaatagaagaaaataactaagaattagcagtgattatttgggagtgtgttgaggttatgagaaatttatatttgtatttttattttttctatacgtgtgtcgtattgtgtgtgtgtgtatatgtgtgtgtgtatgtttaagagtcttgttccatcacccagggtggagtgcagtggtgcaatcatggctcactgcaccctgaacacaatcctcccacctcagcctcttgagagctggtactacagggacacaccataaaaaaataatttttattttttattttttgtagagacagggccttgctttgttgccaggctggtctctatttctaggcttcaagcagtcctctcactttggcctcccaaagtgctgggatttctggcattccaccatgcctggcctcttgctaggtttttaaagaaacctagaatgcacataaattgcctttataataaaaactattttaagggctgggcatggtggttcatacctgtaatccaagcactttgggaggctgaggcaggcagattgtttgaatccagcttgggcaacatagggagacactgtctctacaaaaaaaaaaacaaaaaaaattaaaaaaaacaagccaggagtggtggggcacgcctgttgttgcagctactcatgaggttgaggtgggagtatcgcttaagcatgggaggtcaaagctgcaatgagctgtgattgagctactgcactccagcttgggtaacagagcaagatcctgcctcgaaaaaaaaaaaaagaaagaaagaaaagaaaaaaagaatatgtaagggtcattgtgccttgaatataaatattttgtagattatatgacaagaattttaaattaatgttttcctatttggataaaatataaagatgtccaacaatagaatgtagttagaagctgtgaaatacagaactagaaaaaactttttaaaattcatatggaaccaaaaagagcccgaatagccaaggcaattctaataaaaaataacaaagctggaggcatcaccttgcccaacttcaaactataatacaaggatacagtaaccataacagcatggtactggtacaagaacagccagatagaccaatggatcagaatagagagctcagaaataaaactgcacacctaggaccatctgatcttcgacaaagctaaagaaaagcaatggagaaaacactccctattcaataaatggtgctgggataactggctacccatatgcagaagattgaagctggaccccttcctttcaccatacacacaaaaaaattcaagatggattaaagacttaaatataaaacccaaaactatagaaaccctggaagatgacctaggcaatcccatcctgaacatagcagcaggcaaagattcatgacaaagacaccaaaagcaatcacaataaaagcaaaaattgacaagtgggatctaaataaacttaaaagcttctgcacagccaaagaaactatcaacagagttaaacagacaacctacagaatgggagaaaatatttgcaaactatatatctggcaaaggtcaaatatcctgcatctataaggaacttaaacaaatttagaagaggaaaacaaacaaccccattaaaaggtgggcaaaagacatgaacagacacttttcaaaagaagacatacatgcggccaacaagcatatgaaaaaacccttaataacactgattattagagaaatgcaaatcaaaaccacaagataccatctcataccagtcataatggctattattaaaaagacaaaaaataacagatgctagcaaggttgtagagaaaagggaacacttacaaacttttggtgggagtgtaaattagttcaaccattgtggaaagcagtgtggcaattcctcaaagagctaagagcagaactaccgtttgaccatgcaatcctattactgggcatattcccagaggaatataaatcattctaccataaagatacaggcaaacgaatgttcattccagcactattaacaatagtaacgacatggaatcaacctagatacccatcagtcacagattagacaaagagaatgaggtaaatttacaccaaggaataccatgcagccataaaaaagaatgagatcatgtcttttaacatggatagacctggaggctattatccttagcaaattaacacagaaacagaaaaccaaatactgcatgttctcacttataagtgggagctaaatgatgagaactcaggcacacaaagaaggaaacaacagacattggggtctacttgatcagggagggtgggaagaaggagaggagcagaaaagataactattaggctttgggcttaatacccgggtgatgaaataatatgtacaaccaacccctgtgacatgagtctacccatataacaaaccttcacatgtacccccaaacctaaaataaaaattaaaaaaagaacctgtgaaatgtttacatatttcatatttgactgtggacaaactgctactctgctatactttatttttaaagttgtattgtaaagttgtactacgttccccataaagcaaactatccaagatacagtccagcagagtgcttaatggccataggctttggtgtccggaagtctaggttggagcactggctctgcaacagtgtgcaggtgattttatctctgcaagcctcagcccaactaaccaggtgtgtaattgttttcccctccatggatgccttgtaaatcttattttctaataactgaataatgactgaatatggttaaccatatcatctgggttttttttttccccgagatggggtcttgctgtcacccaggctggagtgtagtggcacaatcacagctcactgcagccttgacctcccagtctcaagcaatcctcccacctcagcctctcgagtaggtgggactacaggtgtgtgcaaccacgcctggagaatttttaaaaatatttttttgtagagacagggtcttcctatgttgcccaggctggtcttacattcctggactcaagtgatcctcccacctcggcctcccagagtgttaggattataggtgtgagctactgcacccacccagccatcatctagattttaaatgccaaagtgataatatggagcagatagaataagatccagaaataaacaaatacccaagtgatactttcattattgctttctttcctaggtacccttgctccccagcataacaacgtgcacacacagtcgtagcccagccatggttcttagcattgcaattagatcatcatcatcactgaagtcacattctctagtcacattatacataaaaatgtcaaagaatcttgccccctctttttttgatgagggagtaaactaggcaactgtgaggtttttacaacataaaattctttgttaactctgttgacatttggaaaaatggctttatgctggctttacagcagcataatctctatttgtttctttaaaaatgctgtgattagttactgtcttttcctttaaaataaacaatagtgctgccaaaggaaaaatgtataactgtttgaaaggaatacattttatgattaacatatctttatatataaacaaaataaaatatgacttctctctagttaaaatcatcttcataaacaaatacttcaggaatagattgttaattggcaagctaattggatgcggtacttgttctgggagcatctttattacttccattactcaaactccctccacctgcaaacacagtcactacacacagcgtactcctcattatcacgatgggatatagatgatgattgaagaaaatgtatgcatttttttcattaatgattttactcctctcaaagggacttttaactctaagtaaagtctgtttatgaatttctgataaaaccaaattattttacattattaaatttcattttcatagaatctcttttctatatctttcttaatgtacttttaggcaaagtcaagttatttttcaaaattgggtttggttagaattttgatcattaaaaaggatattaaattattcttcctccagctggaaatcaagccctctatggcaccctagaaggaatcatcactcagtgaggagtgatgtcataggagtgttgaataaataaatgcttaatgaatacatgagtgaatataagaatgaacaaatctataaggcaaacgaattttgattctttcctatcatttaataaggcaaactaatttaaccaaaggcagaaatcaaatctactggtgtgtttcatgtataaccactataggtaggttttgtcttaaaaaatagaaaagcccaaaataagacagctgattctcaagcaaagatgagaacaaacacaaagcccttccagagctacatgatggaaactgtgcggaaagtaaagactccctcttccagtcaccaacacatgatacttggagaagaatgtacaaaaaactgggaagcacttcagacagactgcccagctctatttgctaataccattaatgattagttcacataccaccctcctatttctcaatcccaaggttcactcagatgtctaccctagttttccctcctattttgcttttgatgtggattgatttgaataaaacatttaagaaacactaatttagagtaagagctaaatgtctgttttttaaatggtgtcttggcttaaagatagaaaagcagtcattaattttttgtcctaataactaaaaatgatgtcaagcagagcagatggcaagaagagtgcttgtacagcactaagcacctcatggtgccggatgactcaaacaaagcacaggtcaagaagcccctggcctgaccaacattggtcagaggagtccaggaaaatacatttcttcttcttcttcttttttattttttacatttcttcttctttacattaatgaatcaaattttcaattgaaaaattaattagcacacatagtaaaatttccccaagtttaaaatggtgagtactcagcccccttctacctcagattccaaacgtgtagccacctcttcctcaaagctagcaacttctaccatcaccttaagtgcatacgcagaaagatgcttttgagtgaaacatatttatgtatgtacagtcttagcatatttttccataactgggaacattgtgccttaacttttccacttaaaaatacaccttgactacatcaataatgatgcagccattcaagagaataactttctgctgtaagaaacatgagaatgcagatacactggaaaataaccaaaaggttaaacttagagctaccatttgtcccagcaattccactactaggaatatacccagaagaaaggaaaatatatgcacacacaaaatcttttgcataaatgttcattgcagcacatttcaaaatagccaaaaagtgaaacaacgcaagtgtctatcaactgatgaataaataagcaaaatgtggtatattcatataatggaatattattcggtcctaaaaaatgaaatctgatatatgctacaacatgaatgagacttgaaaacattatgctaagtgaaagaagcaagtcacaaaagacctcatattatataattccatttatatgaaacattcagagtaggcaaattatagaggaaaaaaacgtagattagccgttgcctagagctgtggggtggaagggaggcaggtgatatggagcaggtaatgggggagatggagggtgataactataaggtaaggggtttcttatagtggtagtaaaatgttctacattgattttggtgacggttgcaaaagtgtgtgaatatactaaaaatcacgaaattatacaccctgtattgatgaagagtagggtatgtgagttatatctcaacaaaggtcttccagaacaacacaagaagcttctctatgtattgacacactgtcaagtgcaaaatacaaactgcagaacaatgaatgtgcagattatacttctttttgtttaaaaagggaggaagagaatagaatttatgttttcattgcacttacataaactctaagagtatatacaaagaaaactagtgaaaatggatacatgggagtgtgcatatcttcttttcaaagtataaaaataatacaatagtaaatgtcatctggagatagtgtcatactagagaggtcttcctcatagatgcacagtattgtcttatagttgtgcatcagttgttcaatcagccatataccgattgacatttaggctttctccagtgttctgttacaaaaactccagcagaacatttttgtacatatattttttgcacctttacacaagtacatagagtaaatgttaaaaaatgaagttgctagataaaagatagacaagaaatccttaaagtaatgcagctaaagaatatcccttaaatttgttgacaagtatagtagctgtaaccccagtagtattttattgcaattactgagcaaaatacactttctttctgataagaataaatgaaaacaggatttccccattctctgtagttagagcattaaaaaggaagcacaataacttccttttaaaagaaagtcagacaaaaaccaaatggtttattctatgtaagctctggaagttgagaaagagaagcctccttttaataggcatgaatttgtttgaattcattatgtggcttctcgagtgctctgcagatttaaaatgacctttcagcctcaaagtgggagtctcagagcaaaaggatgaagagaatctgtttcaattaagataaacatcaactaccaagccccaattataccatttgaatttgaaaaaggcaaaactgttgtcaaaaaaaattggaaagcatcaggacagcagtaaacctggtaaaatttaattgcatcacgttttgatgatgttactgagtgttcatggaacgtagggctatgtttggatgcattcctccttttccttccctccactctccctggctcattttggagttgtttttgagtgattctatttagctgcattggcatctttacttaaatggacatatctgtgcagagaaaaccctgttattcattatggtcaaagaatggtagatattaactaacaactacgtaaatatactaaaaatcaatacattatataacctctatagatgaaaagtatggcatacgagttatatctcaataaagttcttccagagcaacacaagtagcttctctttgtatcaacatactgtcaagtgcaaaatacaaactgcagaacaatgaatgtgcagattatgctccattttgtataaagaggggggatgagcatagaataataaagtgatacatacatctttaataaatgttatgatgttgaaataattacaatgcaatacatttcatactaaataaaaatcgtatttagttacttttggttgttattgttgcttttgtcatgattttgctgttttgtgaccaaaaatatacttgagaacttgcatacatgaggaaaatgatcgtggcaatgatgtgtgatgggtttcagttcatacaggccaaactgtgtttgctgtttgaagctgatggaacccattcataaactccttaagggtggccaggaaaaagaacaccacatacatcctgagcagtctttccagtaagaatatcagtacctggcctttgatatgtgtggctgtcatgctcatccctactgcagtttggggaaccacggcttacatctgtcttttgcatcaaccatgtcattcatccagcaggcacatcctattaccagctgaaggccaatattacattctttgggaaaactattccaaccatttggtagaatttttttttactcacatatatctactatccaattacatttagaactcagatcagaggcaaatttagctcagagaggcattagaacactgaaatctatgcacttatggcaagagagaattcagcgagggttgcctggtgtgtcacttgctacttaaagtcaaagtgagatcttacacctaataaaaatgctcttgtagtttagcaagtcaaactcttgggagggtcttaaactttgtgtaaagagaagggatttacagcagcagaacattttcaagggcacttttatgtcagaagcctttccttttttcctaggtgaagtccactctctctgacctcggctcaccaaggcccctgggaagacaggctagcaacagaaatcaggtcagatatgtacagaaaacaccccagtcaaagacaaacactggagacttgtaggtaggaaacccatcatttcacgttgtccaacttttcactggaaatctatacatgagtgccatataaatttaagttcttaagacagcaatctttcacttcttttcctttttaagtgattgaaaaagatagcctttctgctcctcatatctgctggatattcaagacctttgtacctgctataatccccttctccccaatgtttgtttgactggttctttcagttctcaacttccctgaccactccaactaaagtacatctctaggacacacagccacaaagagacacacagacacagacacacacccatacacagacatacacaaacacactgtttaactcggtccctcctgtgttctcttcactggacttaaaacacaattaggaataattttatttagtgaatttgttttgcttggtaagctccaggaagggagggaggcaccattgcatctccagagcctagcacagaaaggagataaaatatgtattttttctgtatagaaactaccctaaataaaactgtagaaaattattctaaataagaatcttgctgttgaactattttatatataaaagtatatttatttcttatcttcttgtatcatctttgtaggctactattaaaatataatttacatatctctaagaactgagatacattgttatatcagttagaaatatatatcatatattatatatcatatagataacatatatataatcatatatcatatcatatatagatatatatatcagttagaaatatcagacatttcagtttagaaatagcatatttctaaataatatacaatttagaatataagatatatatattttaagaagactatgtcaaagaagtttcaaggccagatttagttagaagtgatactgatttttttccacattcatgtgactttaacagaataataaatttagattaaatctaattcatacttttattaattttcaaattaaggaaaaattaagttttacctagaactgttaagacattttcagtaaactttccattatcatttcacttgtgagagatcatatacatgtcatatcatacaccattttgtaaatggttaaaattctcacattctcaaacagtaacttgttttaagactaacatgaaaacacaaacataaacaagaaaatattaataggagtttttcccttctaataataaactggctagcattttttttggtttgctgtgtccctaccattacttcaagcactttccatgtattatttcacttaacattcacagaaaccctatgggtagcttttcccccttgtccaaaatcacccagcatgtaaaagaagatgagttccaaattcatttgacttcagaatccacccccatctctccagtacatattgttggcaattccaaactgccctggaattttaatagctcagctctatgttttcctacagcctaacaaaatagaaatactttgaatgaagttaagcacataaggtctgacttcgaaatgataccaaggtttaaaactagccattaacttttacatggaacaaaaaggaatatttataaagccatacagaacatggccatctggcctactcctgatgcaagaagctgaaacatgcttctgaaaactaagtgctttttatttctttctttagaattgttaaaagtttcttggataactgagaaaaaaaagaacctactttctcttgaggatgccagagtaagtatctttcatgtagcattaatgttctatttacccatcaaaaacaagggttaaaagcaacggttacacagagtccctccccaagcctctcatatataatcagaaatatcctaagggaccaattattttctattactcctattagtcagaaattcacatattgcaaataataatttcttctctccgtcggtctgaatgaatttattcaggatgttatactaaattagaaactgtgaggattatgaccaaacaagtttccatgaatttaacatttttttctacaaaactttataggatttcacaaattccagcatcagttgatacacaagggactcccctttctattatctgactacctgaatctaccctgtcttagccaaaatagattatctgttactcctttaaaaagattgtcctgagagtctttttttctttttctccccaagttggttcccattctgaatttggacactaacgaacatagaaatcaaagactgtaaagcaactatttattcagaaacatttcagaagacactaaggtttttatttagtattcaattaagacttgcctcgaaggctgggacttctttatgtgaatttgaaatttacagggtatgtcacacctacgctatatttaggatgcaactgagtgaagatgaaatgcctaaagcaattggcaccaagggaatttggtactttaaacattttggaaagcccaagattgcatgtgtagttacatttcctatattctttctctatctcttttatacacttaacacacaaatggcatgaattacgaaagcaaatgtgtttggcactttgaacaaattatccatcttattgaagtaagttagctaaaacttttctttgtgtattggaaatttagacaattgtttgactattaagaaatgatccatgggaaatttgaaagataaacttctgtactttattcaggaaattactaacaatttataagaaagtcaaatcgtcaatataacagaaacagtgaaaaaccaaaaaaaacaaagcttcaaaaaagctaattacttaaggagggatgaccaagcatataaagctaagagaagggagaggttcaaattagaaattaatttagaattcaattaaaatcttataagtaacgtttataaagcttacaaacaaaatcttacagtttttcccgattactggctaaagtttataaaaatcatttatggaatttcccacaatatacaccaaaaaaaaaaaaaaagcagaggatagtaaatgggatgggttttaaagtcagactaagttcaaaactagccatatagaactggagctgctgtaactgcacacaaatggtatagtagtccagatgtatgactggcagtcatagaataatgtggttcattgtgaaagtcagataataatttgatattttgttgtaaacaggttttccattcttgcatggtgcccttttatggcagttgtaatccttaagggcaggccttttaactgaactacactaggacataaatgccatttccttctgatttcctgcattgaatctggtctttgatagtccattcgaaagtttttgttagatccctatttgatgtaatggccttacttattaatgcagttatagccagggattatgcacagtaacaaaggaatatataacagcactcaagcatagtaatagtaaaatgagtttatttagagagctgacaaacaagctagtagcagttatttatagaaagaaaaagtttatttctcttattagtgaaatagagcctcaagcattcaaaaaatattttaactagggcctataaaaataaaggtctcccgaagattatctgtaaagacagattttggcaataagtgaaataatgccttatattcattttatgagttaattttgtataaaattcacttttttccaactattttttcctgatgtgccctttttgtgttccctctctacagatacattaaaatgttctactctgtatattttatctttgaaaactcaaaggctaaattcattaaaatgagaaagaaatctgttggttttaaaatttatttaaataaaaataaatttaaatatttaacttggctgacacagccttgttaggaggtgattaagtaaacaatttacctagaataaaaatatctcttattaaaatggcatggatttccaggccagtaagaaaagaaaatatctctctaacccagggaaagtattttggtctaaaaaatcaaatattccagatttattttatattactccaccccaaattcaagtagggaggttttaaaattatgttgtttaccactggatttctggaagcaactgaaacacttatataaatgcacactcctaccaggaaagtaaaaactattccaaggatatagtagaaggtgaaatagaagtctcctgccctatagaaatacttcagaaagtcactagaccataaattttatgaagccgagtgctgtatatttcaccattgtctctctaacagccagcagggtacctgtggcagaacaagcttaataaacacttaaataaagcaataaaaaatgcacctttacttttgtaactaatagacccacagaaataaaacttttctttaaggactatatattttaagctatagaactagactaaatgatcaggtagctagaaaatgtttctgtacaatactaaaacaaattacttcctcattattaaggattaagccttaatttccttctttttttttaagcctaatttcttgccattccaaatatttaagtctgggagtgtggtaaagctaaaagctggcttcacaatcggaaaagttcacaatacaagaaggtaagccaaccctaagttgttccctgactttgaaggtcgggggtcaatccctgtgttagggctccaggacaagcttgtcactttggttcagcatccctcctgtggaatctgctcatatgtgacaactgtgtggggtttcaagatgcacacaatgaggttagagtgagcctgaagtggtggtcttagtacttaccaccaacagatttcttggcttcatataaaaatcacccattgatagagtcagaaggtcagcatgtcagtcgggtgataaccatgtgcaacacatttatcagcatttctatatgcactactctttactagtttatgacacgagaagagtcattcgagcagtcagaaaatatagaggaaaacttggaagtatatattttagaatgggaaacacaggaggcaatggaaggtgtgcctagattagaattgccagtggtggtggcaaactaagggtgaaagaaagccacagggaagaggcaaaaatcctcccggatactatacaactcttgccataaagagtaactactgtgtctacaactcacccagtacaatctcctgaaaagtgccatctactaaaagaaaattaaaaataaaaattgactgtaatattctttgtaatatggaagaactcactgttctactttccatgcaaaggacagatgttgaatgcccatgatggagcaggcatggtgctgggaacaggggttcattgctctacaaagatgagcaaacccagtctactccaaaacatgctcacaggagaggtacgtgagacagaagacaataattgtaatccttcaagagttagagaaatgtacaaggtttcatgacagcacagagaagagagttttaattctaattggggaagtctaggaaggcccttcagaagaaatgtccactgagggtgaatctaagcaacagaatttggatattaaatcatactaaaataattattgtaaaatgacaacagtttaaaatgctcaaatagtcatatataccaaattattatttaaatagaaaatctgatttttaccctgaatttgtatctcaaacaaaagtttgcttaattacctatacttaagtgagaatgaatgaaccatatccgcatcaacaagggatcatctttcaaacataattttgcaagggggtgagggaaacagccaaacacaaaagagtacatgctatattattccttttatataaaattcaaaagcaggaaatttaaaaagtttgtgattttcaaaatcaggatcactattatttttagtaggtgggggcaggggcttaaaggggcataaaggtgacttttggctgctggtactatttttaatctgggtggtgattacaggggtgacctttgaaaattagaattacttatttttcttctttgcatttgcaacatccaaaaagagtttttctgtttacaatatttatatgttcttcataggtgacaaatagacaaaacatatcaaaaaatacacatgtatttgtatgtatgcataaaacctgtttctgctacaatgactttatttgcatgcaaatttaatggtgagattagatatatagagttatgatgagatcatcaaggccatttaaatggcaagcagccacactatgtccctcttctgtctggcagagatcaccaatggatcacagcacattttctctgagaccaacgcagctctcagtacattattccaggcagctactgctattcgtaattacaagttgcccatagattaaaaagactagctatcttggttttaaacaatgcagactgtctaattcttttgatatttacatgaaaaagatcttgcaataatggagggatttcacatatatttctaggtaaacataaaatttcattcctatgtacgtaaaatgattttttcagttacacgaatacctttaaaaagttgtctgctaacatcaaatttgcttttttgtgtgtgttttatattaccctagaagctcttactgattcatatactagtagactcttaacgaaacacagaaaagtaattgggctatctctttttaaagcaaaacactcagggaatctttaatggttaattttttttcccaagctggtgaactccaccctcaatcacacttaatccaatgtgcagttgttaattataacaaaataatgcttttacagtttgttttgttttgttttggtaactactcataataaaatagtagatatcagagacaggaatgctaaatgcctgctctaacgtattgcattcttgacatttctagcccctgtggctgttcagctcatcctaacacttcacgccacaagaacagacctaaccagatctctatttttgtctgttgttctttagaaatgatggagaaagcatcttaagccttctgcactgagctgggatggcgggacaaaggaaaaaggagtccttctcagtctggtctgatagagatgatgaggctcagctccagggagataataatctgtgaattacacaaccaggaatgcaccttaggactagaagagtaagggatttgtagaggtagagaatgcctggcagtgtgattaccgtaggaccaagccacagggtggcacccagtaggaaagatacatggagaaagtctttacaaaggtgcacctagagataatgctcaggtagctgaccattcctttcagatgaaacccctgcctagttgtgcttccttagagggttctcattgagttttaaataactaaatcagaggtggtttagcttcccactgaccacttcttattttgccacctccactaagtagtttacttctttgacccacctagatagcagtgtgtcttctttgaatcacactattaacgtgatttatctggaatacctagctctatataaatgcttaattctgactgtgttaaaaaagactaccttatggaaaagaaacccttacaaaatgaatcagctttcacatttagagttcttgattatttagaaagtcataccaatgtgtaaacttcaaaaatgcataatataagctaacagttcctggtcactcacaaggagccagccatgtgctaagcacttcaggtagatcaactcattgaacatattaacatatacatcattgctaaaggtaacattttataattaagaaaatatgcgaatcatgaaattatcttatttgccactcaaatttaggcaagccactttacttcattaggcctcagtctgaggaataagactaatgagtactgtctaggattcatcatgaggatctaatgagataattaggtcaagtgaacagcacagtgcctggcacatagttaagtacacaataaatacaaattgccacaatttttaattcagatgaagactatattgagaggaaagaagtaaatttaaaatttcaagatgcgaattacagctacttacttagctatatgacataagtttaggaattacattatagctcaatacaaattataatagaactgctttcacacatttgcctgacagactaatttttagctctctttttcagctcaaacttcatttttgaagttaaaaaaatatttctccagccaggcatggtggtgtatgcctgtagtcccagttactgggaaggctaaggcaggaggattgagactaggagttcaaggctgtagtgcatatgatcacacctgtaaatagccactgtacctcagcctgggaaacacagtgagaccctgtctctaaatatatatatatatatatattcttcaacaaatctttttaccacttaagcattgacattgtttttaacagtttttcttgaccctacttgactggaaatgttaaagactagcaaaatgtttccagctccacattggggttaggggtggggaaaatcagattataggttattctctgtggtctcttttatttcaaaggttttatggtgctactaactggtcaaatgccagagagaaggaaaactgcaatttatagtctgaccagaggaagagagtcaataagctgaacgagtcaggaactagctagatctccaaggaatggagccgtgtcaaagtccatgttctatttctcaatatatctctagggctcacggttggaggcttgtatacaaatcttggggggaaaggcagacaaataccataggcaaacatgttcttgatatacataagattaaaagaagaaacttgaacagtctaggacaggaaggaaaagtataagtagcagcttgttgactacttttctaataccatgaaacagaactatgtgtagccaaagcagtttagatagtgaggaaaagcaaacaaaacaataagaacaacaacaacaaatatgggatgtagtttcgacagaccaagatttttctgcagcactgtaattttataagctgtgcgacttcaagttttattcatacagtttattcatacagttgcttcaactgtatatagtactaagttcattgtctgtcaaagagtagatgcccaatacattgtagctatcattaatgaggttatgactccaactatgactatagacctagaagctgctttctccagctagctggtgatctagctgccaatcagttacttgctattctataacaaagttgcagtatcagagcaaaaatcacagcccgctgttgcctatcccatgttagaatgccattggttaaaagtggacacattttacagtaatttatcctgactaaaatagtatcagtcatataaattccttgatgcaaagaaaaaactctgtgccacattgcaatggaatgacatcctgaatgttaggaattattattttctgtattccatatgaatgtctcaagcaagttcactaaaaagagctcaatttctcatctttgatgtattttaaacaagaaagagaattagatacaacgggagcacttttctctaggaagtctgaaaacaattacatactgaaattatgtttaatgaaacatttattttaacaagtcacactggtgccatctattttacaatttagaatgaatattttgcaatatgaaatgaaaaaagaccaagaagtcactcactagcagttttcaaaggccataaagaagaattggtttatctattgattcactctcattatatctactgacaactaagaggaaatgggttagaatttaagcaaagaagatttgtattagatataaagaaaacttcctaactctgtgggtttaaaacaacaggactgcttcctataagggtactttggaagatgcaatccttggtgtgcatacattctacacctagtttctagttttctaatttcttattcttcctcatgtgtagtagggaaatggaagggcttgcaggtgaccccctttaccctatggcagaaattcttagggctgagatggggggcaaatgtcctctacactgagtttcattaatggcagcttttgcccagaggttgccagtgttattaaacagggtagggtgctagatggtggatgcttagttcaaactgggctggaattcttccatattggtctctgtataatctcttttttcttgccacacttccccagctcttctcttgaaatattcccttgtgtttttctaactcttattctgaagagcagttcacccttctgttagcttctctaattcgcatcctcagccatcacccaggatgctcattagggagccaatccccttagaaggcttaggacagataataaatacttacaatattgcccctgtcatgctaaaaaactgcatccataggttctggcattcttcctactttccatacttttgaaatgctttctaatttaggtcaaacttgacaaagaactaggcaatttgagagctgagacatatcactggcacgggctctcattagttagttacctgtacacagttatatttaacagtgtctcacccaggcttgctgtcattgtgccccatgtggtaccccagcccttcccataggcaccaatccctggagagatttggtgcttgtggctgaagtataccttacttctgtccattttctaatataccttcaacccctgtattatattttgagatattggatcacctctggaaaggcttccaagaaaatctatattgattttttattaagactgtgctttctttgtgactatcttccttaccaacctagctaatatccctcaggccctattctctatacctttatctaaactttgacaattctatatgtttagtattagtattattgggaatatttatacatatcgctcagcatctttccctaaaaagcttaaaaactccttaaaggcctcattaatattcttccccttcagtttcatcttagaatctacttttctcaatcttgctagtaatggttgggtggatccatgactaaccattcgtatactcatggttaccttcatgtcatcatcccttctgattcaatagaattcactacatgattggaatgattgacagaggaactactaagtgagctattcctttacctctcctaaaaggcaagttttaatgataaggccaaaaccatggtgtgcctcagatccgtggggaagaaaaaaaaaagagttgcagtcaggactaagtattattgcacacataaccacagccagttgacatgatagaaaaagagggtggagaaccccattttgaaataccaaaagaagcgtcttgcttctgaagaatttcataccaattcagcatttctttaccaacaaccatactcacttcctgaattatcagctatgcatcatacagtgtttagtgcatgattttctcattccagatgagcctaaaataaacttgtaaaaaataagatgctaaataaaatgaatagatcttaactattatagtgataactcttctgtgatatctcagaagtgggaaaagttacataacttcaaggtcttataaggcagaggtatttgaactgctacattacctacgagtttatcccaatccatatagagatacagaatacacaaatgactctcccgcggtaaggcagcactgcagagagtaaaactgtaagtgatcttaacagtcattagcttagtggttttcaaacaatattccttggaatcctaaagtctttagaggtattttaaggagagggtttgaatttggggtggggggtaaatgtacaaactcagtggctgttttattgttttatgtgtgcttatactttttacttatatatttcacacatatctatgtttttaaaaattatatctatatattgaatttatatatgattttatatctaaaaattacagtataaatattcatttatattaacttcaactcacatttcattaataaaaaatgtcccattgaaataaacgtgtttaaaatccattgacctgccttgccccttttattttacaggacagtagacttggcttcagagggactaggtgactcctccagggacacagagcatgttagaagtacagtggacaaatggctttttccagggaatctcatacttcatgactttaaagagtaaacctatctgtgatccactctgtgtctttctagttatgttttaaatacatcaaatatttcaaggtatcttaatcatttctaaaagctgtatatctttaagtatatttcataacagatacatcactaacttgggtaataggaccaaaaaaagtttacctcatgctcaaaaccctgaaccaactttgacagtagtcacatacctaaaccaaatcataatatatattgcacaggcagaaaatatgagaattccatttgtttgcgtatttacaagtttctaagatagaagaaataggaaggaagattgcatatttttttcaaagctgatcttagatgtcatacaaaatctgatatgtactacttgtttccaacctgaagccttacagagcttgcagagaacagaaaaacttggtaatagaattggaaagataatctattcaaaattgtgaggcattggccttttgttctttattgtctgttataaagaccagaggaccttatttgctaccagtagagaatataatggtctacaagctgcaagagcctttcacaaagctatttttcaacaaccaacagtctttcacaaagctatttttcaacaaccaacaacgtcaaccctgaatttcataggctaccatacttccgaaaagaaaactgccaaatactgtaatgcatctagaaatattcacaacatgaacacttttatggccattaaaaagataattatatccacagtagaggaaggcaacaagctgaagaaccagagcacgttctttgaggtagacagacttgggttaccccagcctatgaccttgctcaagttatttcatctcacggaatcattttctcacctgtaaaattaggattaacaactccttcttttcaatattgtaataagaactaaataatatatatgtaaaattcttgatagagctctttcataagacactcaataaaatgaaagctataagtattagaaaaatggattttttttttttttaaattgagacagagtcttgctctgtcacccaggctggagtgcagtggcacgatcttggctcactgtaacctccacctcctgggttgaagcaattctcatgcctcagcctcccaagaagctgagattacaggcatgttccaccactctggctaatttttggatttttagtagagacagggttgcgccattttggccaggctggtcttgaactcctggcctcaggcgatctgcctgcctcagcctcctaaattgcaggtattacaggagcaagctacgccgcctggccaaaaatagaaaaatattgatatgttaaatgaagaagcagagtacagaaatagtatttacagctatttaagatatgtaaggtaagttgaaaatgagaataactgaggatggaataatggggttaatgggttattttccttccaacatattaatgttattccatctttttgattctcaattataaaattggacattttagcttatatgaatgctttccactgtgatcatgaggccaaaataagaatgctaagccagtctagatttttacaaccttaagagaaaagagctaataaaaaaattataatcctccattggtcagagttgcaagaaaattcagaaaattgtatccaaccagtactgaaatactcatttgcatattatataacctgagcaaattgtggtttaatgtctaagtagatattggcatatataaagatgagcttgctaatacatatagtaggtatatttttaatattttaaactttcatatataatactttattgataaaaactacatacaatatgcaaatacagtgaagaaaagagaggcagtcccccttaccttcactcctaccatttttttttttactcctaaaaaataaccactaccaaaagcttggacagagtcttccagaattttttctgcatctacaaacctaagtattacatgtatacttattacataataatacttataatgaaaagtataagtactattacatatacaataaccaattttaaaatttgctttaaaaacaaccacagtcatattttgaacagtagcatctcttttattttcagattacataatgaatgatcttacatgtaacacataaatcctaaacactgttctgtcagcaggaaagaaaaaagtccacttccattgactaaacttctctttatatttatatttgtaagactaataatgttttacttacttaaactaaatcacaagtcttaattacattaatgagaagtatccctgggaaatgtttataaatgtttataaaagtgttaaagagatatcaaggaatatgtaaggtaatattttcatagtatataacaactgactaaatctgaatttaagatatgcaagaaaggcaaacaattctgcaatcaatgaatctgctaattttattagctttatgagcataagaaaatatataaagtttttctcaatttcatgcaggcacatttttttaaaataatgcttaagaataaatactataatcactttctgctagaacgtggcatataaataactgttccttaaataaaagcaacctagtatacacctttattaaataaaccctaaatttggacacctatgttacaaagagacaaatagattaattttaaggttatttgtattttgtcttgaaattaataaaattttaattataacaggctgacctttaataagaggaagggtataaaatacaagtttgccatgaaatcccatttaaaatgtgaatatctcatagcaatttaattaaggctgtaaggacaagttagtgtggactgctttttatgatacttggagagaaacaaatagaaaaaggtaaagaagtaatccaaaacattggattcttgcacaatacaacaaacttccaaacgtaatgtttggctttagggaatcccggaggacagtagacagatttggagaaagtagaccaatggaacacaaaatagatttatgtaatcagagtgaagatggtaaagccagaaagatgtgtcccaagaacaaagtattttggagatcaacctggaaacaaataaacatctgaaaaagagataaatggcaaagttttaggtctctctcatgggaagtcaactgaaaaggaatgagggtagggtggtggtggagaaatgcagacagcaacactggtgagaaaacattgtccctctgagcaatttgaggcctgtggcctttatgtgcagaggcacaagaagagaggccgtttgggtttttttaatgctcaagtaaacatgtgtgtgtgtatgtatgtgtatacatatatatacacacaaacatatattttctctatataccaaatctataatctatattgattttatacatgtaattaaataaataaatataatagatgtgtctaatatttgactgatagacggataataaaatggcaaaactgttactacagctgattataccctcaggccaaattttttggcagctgcagtgatatacccaagcggttatattattaagtcagatgtaagattaataactggagaggtttctatagtgtgtagttaaatctaagaatcatgcatatatagagagagatttatttcttacacagaaatcattctatccccaagtctatggagaatatttttagttaaatggaaaaatacacacattaacaaatcaaaatatttaaaaatgcattttaaattgtggcttgacttatgaaaatatcccatacaatttaaaacaaaaaatataataattgtggataaaaatagactatgataatctcagagaggtaaagggtgtcaatgttactcatctcctgaaatgaacaaattatttccaattgaaacctgaatttgaaaatacatctcctggcagtttagacaaaaagagaaatagtttggttaaacactatttttaaagtagtaacatcttttcacataggaatggtataaattataaatgagttaaattcatgtatattataaattctgtttactcatgttggtgatttatattagctatggtaattcatacaaggattttaaggattttccagtatttattgtttgaggaaaaaaaggacaggactctccaaatttgtttgcagatgcaatcttttctttaaataaactcaaggaataatttattgcacgtgttattttgtaagaaatggcaagtaacgttaagagacaaaatcttcatctataatttattaaaactcacagaaatactgcggatggggcaattcttgtttctggttgactgtaaaacactacaataacagcaaaggctaacctatccacaaaaacacaagctaaattcctgacgcaaataatttgagtatttacatgtgtgtttgcctgctcacatgataatgcatattttgctggcctgttttcctcccattctcaaccacctcacttcaatcattgcttttatttccccagtgtgaggtatgattatttccatttcaaagaggtgagcttagttatttataatcaatcactaagaaaaacaaaataagactaacccctaaaatagccataaaagtattttgtaaatacctattgtagaaaaaaaagttactttgttggaaaatactccttaagggccatgccatatgctgattagcatatcaaatcaccattggggaaataatagaacattagaatacattgaaactgacatattttttcatcagagtaaaagcattaaaataaccaaaaatataattactaggaatcatttctaataaaataaaacataagagatgaatgaatgataagcaacttgatatacatttagccacatagttaaattcaagtttgtttcatgtgtatgattaaatataaataacattattaatttctaacacatctgtgctaaaagtgagggtattgcttttaaagacaagggcaaagcctgtcaaccaccagcctgcttgcagcaagcaaagaagataagaaaacaagcaactgaatcaaacactgaaaaatgacaagttttcattttcaaaactcccaacatatctgcaagtttctttcctcctttaaaaattatcatcagataaattgttacagtccaagaggaattaaaaaaaaaatcagcacccatttggttaaagcacatgagtttgggaacaaaataaagaataaaagagccgccaatactgccttctttcacaaagcctcgacatcacacaacttactaaatactcaaggagtacgtcaatcttaaaagagaaaaggggaaaagcatgagagaaaagaacgttaccaaactgcctctgcagtccttagggaacttgtagatcgggatcttggcttcataataatgctcattttgaaaaaaaataaaaaggaaaataagtcttcaactattctgattaatacattctaactgtctttctgcaaagaagattttaaagatattccatttccaagggaggctgcttgaagaaatccaattttcctggagtccatctcctgtcctcggtccagctcatgggcaaggttctaacacgcaggagcgctttcttccttcatactgaatttactccagtactaggctgttaggaagtgacagtttcttctgtgtcttgcaatgccaagggaggaactgaattctgaattgattcttcatctgggtcacaagggaaaccagcatagtgaaagagtcacttgatctcttttttgcaattccatagtaacagctttaaaggtttctgacactcgaagagcgcaggtagagagagagaaaaagaaaatgaccgggaggtactgtaacacgggagagctgtcaaggaagttccatttcagggcaagcacaggaaaacactcctctccgtggagcaaagaagtcagccaaggaacaaatctctccacactttggctgggtgggctgatttacctgcgaaagtaatttctgtgtgtccctgcttagaatccagggttttgtgaatgagaactatcattcaatctcaccaggcagaaactattcctcaagggctgtatgacgtctgtaagaaggcagttcaaaacaccgcagggcagtgagaaaggaaaaaaaaaaaaaaaaaaaaagaaaagcccagcgcccagcctagcctcgtcaattgctgagacttacaaagcaaaggggcggatcagctccagagaccagcactgtaaaccggccaagcagacaagagacctcacaaaacttataaaaccatttccttctctgggaaatgagatgtctgtgttattctgggtaacattccgtgatcacctttacaaggaacacaccccttgccattaagttgtttatttaccataataaacaaatgaattttataaaagtcattctttcaaaaaagtatttcactgaagcactaaaactaaacttttctctttagaagcaaagttgagagaacttgatgacttagcagctgttcattttgagcggatgtaatgaaatgtcatgctttggagttggttgtagagatgtaaattacctcttaaaaattcagcagagtgtaacaggcacccttggatcagaacatactggaattttaaactgaaaaattgaatgtattattcctggacaagtggctgcacgtattaaggctgttcccttgcacaatgttttctaaaccttatttttttttaaaaaaaatgcaaatttcattcatctctacacacaaagacttgggtttgctaatccttaacagctcttcagtaaggaatgaagctttatatcttgtcaatatctcttattatttcgaaggccaaaacctttcccacctcctaaatataaaatattttctattacagtagatataatctaagctgattccaattgctcccaacagaaggaacagttgaccagcctgcctatctctctgaacatctacacagaggatatatactcctctgggtgtgccaacttcaattattttggatgtgaattaccaagtgaaaataatgtaagcattctgattgcttaaatggcattagctagtacgttggttctctagtctgacgtgaacttggtgtttatttagcatttgcagacaggatgttggagtgcagttgtgacccacccaaacaacttggaaaatgtagtacggcatccgccagaggctctggctgcttcttacaacaaacccttcatctgctcccctggtcacacttcaaggtgcatttgtgacttagtcttctttcaatgactctcaggcctcttacggtaaatgccaataaattgctttccacatagttatccccttaagcttttcagtttccttatgactgccaggggacattcacactttcttagcactgtcccatgtctagtatattgctggcattttaaagcaggttaattaatcatgtatttttttggaaacttaaaagttttgtgagactaattatttttaggggagaggggatttagaggaagaggtttaatttttttcttattggaatttaaatgtgggaaaagaaagaacaaaagcaaaccaagtaaaattaggcaactactatttatttgaaacactgttccctccatgtaaggtctaccaaatagcttccagttgccatttcagaaagcaaatgacaatgatcagagaatgtaatgtctgactgttgagttttcaactctccagaaataattagcctgtgttctaccgtcccccagatccatgttacaatgagcttatttagcctgatgctactcccttctctgtcacacacacacaagtttagtgcagccccatgtgctgttccttgcttacttgcccaacattctacatcttccaagaatctttctctgaaaacctaacacacttattgggcatctactaaagactgtataatagtaccataatgactaagaaatcgtccctctcccctggcaaaaacaaacttaagtggggaatctgacaatgtatggaactaaccagaatactcaaagtttttggattggtacatcaaggttgccattacagagaaagaaagatgcgctatgttgtaagaccattgagatttaaatttaagttttgcttctactcctaatatttaaggtagtgacagaataaaaaaaaagtatgtatttgatgttacagagttttatccacttgtaagaccatttctcacatgaacatttctgaaagaatgttttgttatctaagcatcctgtagttttccctctgaaaagcttccccaaatggaaaagatatggcatttccctcgaaattcctgttagcatgcaagcatatgatggcatgcaggctgatgaggaggcctgaatatggggagactggatttaggaaccatgtggcccatgcttttgatccagaagctgcgattatttctcagtatttccctgttgtactgaattgtataatgtatggaccttttactttctggttgttaccacatttcaatagactgtaccatagatgtatacatccattgggtcatccatctgtagatgttttgttgaatcaaatgactatgtcatttgatgtttctgaaacttcagtcataacaccaccttcataattctttccatattagcattccatctataccatgatttgatatttttcttaattgactcactttttaaaaaaacttaaactgaatataaaaggtaactttatatttattctgtaaatagatttaatatactggtataatttgcccccaaaatataagatatattaatagaaaaaaaggagtccaaaataactcctaaagtctgtctcataccactaatggtgccccgatacaacttggcaacacttacatggaaagcgtcaattgcatacaggtagattgtgcgcacctaaaatgtgatctccctttctcttatcatccaatggtgagcgtgacttgtgagacttatgacatttatccatggattaaacattaaacattaaatgaagccaactgaatgaggtgttacggagtaattttactatacaactcaggttttctcaagtattactattttcaaatactctgcctactatcaaatcttctgttctctaaattcctattttcagattacaatagatattctatactttccaatctatcatgagcatatttcttagagccatattatatatcaactaaatattcaggcctctcaaatatgctgaaattcagtactccagatatgtcaaactaactttttagaaaaaaagaccaggggactgcagtttttacagtttcctgctattctctattgtactctaacgttaatgagaataagacactgaactcctgtagcagttcctcattattgagaaatattgtgttattttccttatctggaggggaattttgaggcaatttctagaggtttcttttattttattacacttactaggaatacagttggattcaaggactttcctactggcatgaaccttgcttggagctacatttcttaattcccaaaggagaagtccggagtattatattttgaaggctttcctatcttcagatttcctacctctttcataaactgtcaggttaggataataataataactactaattattaattacctacatgctaagtagactatactttcttaattatacatcacaacatccctccaaagtagatgtgataataataatttcatacataaagaaagtcaacaatttgttcaaaatttttggacccaggtatatttcattccaaagcttgctcttcatgatgtgtatgtgtgcatgtatgtatgtgtatgtgtgtgtttgtgtgtgtgtgtgtgtgtggaagacagaaagaaaagaggaagagaaagagattaaaaaatgctaccaagtttttggaagtttttaaaattcatccatcctctttagttgtacagtggcaatgaattaatataataaaaatggtgcacgtacattactagtataatgataaacatatttaacagctagaaaatgttagatctttaagatatgcaggattaaacaatctaacttcactgtccttgtttctaatttttaggcactaacttttaggtatcataaacactgtgatgagggcatatatgacaacatcatgagtttgttagccataaaatatgataaggtctttgaccatctcacaacatgagtaatggtagtttcctgttacctatgcaacagatgacattttgattgcctcattaggcaatactggttaataaatgatcattttaaaaggtaacaatacgtgagacctctggtaacgtataaatttcaatatttgtcaacaaattacattggctattaaaaggtacagaatactagtttttaaaactagaataaacatttgtgcatggagtcagtaatgttgacataaaatgaattttgtaattgactttcagaattttgcactaattcaatactggatttcagaagaaaaactatctaatttaaaattttctaagtgctgctgtatttcctttgcattctgcctctcctcttgtccctctttcacatttcttgttcttctttattctaaacttaaatgaatctctgcaaatttaacattattttgaattaaatatttaaattttattaaagaaatacatgtaaataatgtaaacaaagagcaatgagtgtaatatcctcaaactccagcattgattcctgatcccaattcatacacaagaatgagaccctagaaaggtgacagtaagttctaagtgcatgggtgaggcttgtgtactgggagttttactgcagtatcatcaagtgcccagtggggattttttttgcctcttccaaatgttactatttgtaagagattttttcctctggggtatctctatttttctagagaaggatataaatatgcttcctagcattctggtgtgggtaggagaaggacgctgaaggtcttactgacacattgcagacattcatttaattgtcctaaataaagttaaacatacagccatccttctcctactctttgcttagtatcccaaagtctctgtcttccatggagagggatgcaaaatatgttgactacactgaaaaagagtgagggcttatggagaagtgtatataatatacatgttcatacacctgctatatttagaactcttccatcttccaaagtatgttttgggcgactggggcagctcagtttgcttcactttagtattgttctctgatttggttaagtcattgaccttttctcttcctacttctatctttatgtattgtggcttagagtcacagacatctcccagtttcctcaaagatgaaatgtacctttctgttttttgtactaattattggtttgagtgactttttaaagaaaaaaatggcataggaagattgtttctccacagttttaaagctagaaatctataagttctactttaaaacaattttctatgtttatctaagcatacgcatttacaaattttatttatcaaatgactatatgtcaactctctctaagcataggtaaatattaagtattttttattatggtaaaatacacatcacgtaaaattgacattttaaccctttctaagtatactgatcagtggtgtaatgtatattccccctgttgcacaacgattatctccatccatctccagaactttttcatccttccaaatcgacaaccctgtactcattaatagtaacttcctattctcctcttctcccagcccctgacaagcaccatttggctttctgtccgtatgaatttgactactctagatatcttatataggggaatcacaaagattaagttgtaaaggtagattcagaatcacatagccagttatggtctagatgtctcattattaaagaaaaaacaattatggaagcacaaagtttgaagataacaattcacaccttgagaaatcaatgtacttgccttatccatcatcaattctttcaaagtattcacttgactttcatagacaaagtcaagagcaaaaatatctttgcctttaccaacatctggtgtgtgtttttaaaaattattcttctaactattttttttctgtttaaatatatacaaatgttatcagtgcttacccagtctggtcacattataactttagttcttatttcaaatttatagtagcttcctgtatttaatcaagtagttcctaactctatataccaatctcaagggataaagcaaaaatttaaaattaacttacttcaataattcttaaaagacttttgaaagagatgaaacaactggaaagaccacattgccaaatgaagccctagtttctaacactgagataaattgagattttcattaaaataagattggaggctgcgcgcggtggctcatgcctataatcccagcactttgggaggccgagacgggtggatcacctgaggtcaggagtttgagaccagcctggcaaacatggtgaaaccccgtctctactaaaaaaatacaaaacttagctgggtgtggtggcgagcacctgtaatcccagctacttgggaggctgaggcaggagaattgcttcaacttgggaggaggaggttgcagtgagccgagatcgtgtcattggactccaacctgggcgacaagagtgaaactccagctcaaaaaaaaaaaaaaaaaaaaaaaaagatgtgaaaagcagcctgtcaaaaataaatgaacacaagatgtgttttaataataatttagtttctgatgtaatgggaaatgttgaaaattgttttattagaaagtaaactctcatcaggacctttaaatttacatttatttgataacatttttcttgtacatattaaaaatgccaaaataatccaggcaactcaggcagtttctccttgatcacagattacaaataagttttctctaatgtaaaacagctgctctgagaaaaacgcctactatttaggaagggtatgtaggatcaagttaagaagaggcctttggagtcagactgcctggttgcaaatccaaattccaccaatcactagttgtttgattgcaaacaaattatttaaccttccctggcttcagtttcctcagctataaaatggagatagaagagaattttctgaggactaaaaaagacatgtaaaaccttagcaaagtatctagaaaatggtaaggaatcaataaataatatctgctattaaaaataagttttaaaagagtaatcaataagctatggagaaaagcagctttaaaacttaaaaatatatgttactgcactagtatttgatttaaaataattggtttgtgcttttgtcttcctttggatcctgtccccttgactccctttacacatagcttgtgtagttttcctgacttctattttacacatctaaggtttttttctcttatctttggattatctttcaaagatacaaaccttaaaatgtcaaagcctgtgatgaaaaaccttctatagcttcatattccttacaggatcaatttcagccttttttgtgtgttaaataaaaacttctaccatttgggttcaatctgctattcagctttgcccttgataactaatttttcccaccctatattgccaaccacacaatctcacacaccttgccccaaatctgctcactttgtttcccctgcctggggaacctctcacctttctcccacttccctgctaagtatatttcctactctgccttcaagatctagcataagtagcagtaaagcccaactaactccaagacaaactcagaagttcagtctccttggattgattcaatctgggaatatctcaggttaattttgtttattataattattattttataacacatttgcagtatatggcaacacacagtgaacatcacagggggattcaaatcccacagacactgtttagctatcgatttggactctgtaagctttgaaaacacattatctctttaagattcagtaccttcttctacaaaataaggacaatatgcacacctagaatcctcccagggttcctctgggattaaatgagaaaacatgctgtccaatctgcaatcccttgctcttgatcactttcagatctttgcacacgcatttctggcaggattatctttcttttcttttacccctctttttgatcaagagttaaatcaggactacgcctcccatcctgctgctctgcaatctgaattaggtgtctggccatgcaaatctctagatgttcatcctaatttctttcaatttatcagcaccatatggtcatcctctcttcatttggttaactataagccactaactaggaactcctactggaaaggattgttttaccattcttggtagagcacaaggcattatggaggcccaaatagaaacctgggcctccataatgctgtgagtttctttgaaaacagggaatgatgatgagcattttttcatgtgttttttggctgcataaatgtcttcttttgagaagtgtctgttcatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaaaaaaaagaaaacagggaatgaggcttctgcatctttgtattcagaatacctagcacaatatctggcttacaaggtatttgcttaacagcagaataaatctttggtcaacggtggtagataagccctttacagattttcttcctgtgcccttttgtggcatttgcttcatggctggaattagatttcaaaaactgagtcttgcctctttcttgtttttcataagcctctatctctaaaagttactttagatgccttctgtgccaaaaaggagttcctacaatagtgttataattaaaaaaaaaattctcccaaagaaaaaggaactggttgccagggtaaagaaatacactggaagaagtcttatgcaggcactgaaccaacgccagcatcattgataagaagcgaaaaattttttgttaaatatttaggaaaaatggccttaatctggagaaactattatgcaatgtgatattcaacccagacagagtatttgaattctaataggaaccttttggaagctcaattcaaagaaataacttttccaggaagagtttccccacattttggcaggacaatggggagggtgtttgtgtcatcttataaaatctgccaatcagtcaccactgtctatgaatgagatggctgtttctctggatgaaaaggctgcatcctggccagtctttaagaaccttatctggagccactactaagtgttgtccaatctgcaacccctcactctcgattactttcagatctttgcatatgtatctctggcaggattatccttcctttcttttacctctctttttggtaaagatgcattagcacattcgtatttgtatcaaccacatgaagactgtatatccatgtactggatgagaggaccgaagggcactaagtgcttcccctacaagttcagtggatgaaccaggtcagaactcaagcctggctggctccagaagagaaatctgaagatgacaggatgaactcccatttattgattgctcaccatgtgccaggcactgggtaagatgttccacatgttctctcatttaacatttaaaacaaactcacaagctaggtactattatttcttccaccacacagtcaagaaaactgaggtctacaggaagttaagtaccatgccctaggtcttacattaggacttaaacttagattacccaaatgaagcataacctggggaaagcataaccttgagaactaaacaaatcgtattttaagtaacatctcaataggaaattttttaaaacttatttaagcaattctttgaaaagaatggtagaatgggtaaacttattactctggacatggtttttttgtgcacatgacattgaaatcattaaaagttagtcactgtttttattctaggaatcacgactttcaaatatttcaattatttagataccagactgcaagtgtactcaaaagtaactcttgaaaacagtgccattaagcaatgactcctcattctgcacactcacattccctggcaactactaacctgttttgtattctctatggacttacctattctagatatttcattaaaataaaatacaatatgtgatcaaacaagtaacttttggaaaaaatgcatttttactttactatgttggttctttccttggaattaagaccatttattttttatttcaaaaacactttctttggatgtatattttcatttaaagttttctttttggatggagagggaggtggagccatatggctaaatagcagcctcccaaaggaacaacaaattgaacaactctccacacaaaaaagcaccttcatgcaccttcataagaaccaaaaatcagcttaggtaccagcttagccacagcagggtaaagcaccaaaggggttctaggggttcctgattccagggcttggctttagatggtatttctggaccttccctggcttacaggtgggcccactgccccaaaatagattcctaggcctggcagcattcaccacaagctgattgaagagcccctgggccttgaatgaacatcagcagtagccagacagtacttgtcgcaggcctggggcagtggtggccacagggagagactcctctgcttgtggaaaggagaaggaagagtgggaaggactttgtcttgtgacttgggtgccagctcacccaccgtagaatagagtaccggtagattcctaagatttctgactccaggccctggctcctggacgtcatctctagacctgcccaggactaggaggaactagttgtcttgaagggaaggatacaagcctggctggctttaccacctgctgattatagagccctagtgccttgagcaaacataggcaggagccaagcagtggttactgcaggctttgggcaagacccagtgctatgctggcttcaggtctgaccctatgcagtcccagtggtggtggccacaggggtatttgtgttacccctcccccagatccaggaaacagagacacacacagagagagagagagagagacagacagacagacagacagactgagactgaatctgtttgtttgggagaaagtaagagaagagaaaaaagagtctctgcctggtaatccagagaatgactctggatattatccaagactactaaggtggtacctctgcaagagccacagtgttactgggcttggagtgctccctaatgcagatattcctgcagtgacccaaaactcagaccacaacacccaagtttcttcaagcatctggaaagcctcaccaagaaggacaggtacaaacaagcccagactgcaaggctacaataaatacccaactcttcaatgcccagacaacaacgaacatccacaagcataaagcctatccaggaaaacatgacatcaccaaacaaactaaataaggcatcagtgaccagtcctggagagacagagatatgtgaccttttagacagaggaaactcaatggaattcaagataacacacagaaggaattcagaatcctatcagataaattcaacaaagagattaaaataatttaaaagaatcaagcggaaattctggagttaaaacacgcaactgacatactgaaaaatgtctcagagtctcttaacagcacaaaacaatcaagcagaagaaagaactgtgagcttgaagacagcctacttgaaaatacaaagagaagacaaaagaaaaaataataaaaaagaaagaggcattcctagaagacttagaaaatagtctcaaaagggcaaatctaagagttattgaccttaaaaaaaagttagaaagagagatgggggtagaaaatttattcaaagggaaaataacagagaccttcctaaacctagagaaatataacaatattcaagtataataaggttatagaacaccaagcagatataacccaaagaagactagctcaaggcattcaatactcaaactcacaaaggtcaaagataagaaagaatctgaaaagcggcaagaaaaaataaagaaaaaacatacactggagttccaatatatctggcagcagacttctcagtggaaaccttatagggcaggagacatattcacagtgctaaagggaaaaaaacttttatctcaggctagtatatcctgtaaaaatattctccaaacatggagaaatcaagactttcccaaacaaacaaaagctgagggatgtcatcaacaccagacctatcctgtaagaaatgctaaagaattctcttcaatctgaaagaaaagcatattaatgagcaataagaaatcatctggaggaacaaagctcactagcattagtaaatacacagaaaaacacagaatattataacactgttattatagtatgtaaacaactcatatcttaaatagaaagaataaaagataaactgatcaaaaataataactacaactattttttgaaatacagacaatacaataagatataaagacaacagaaagttttaaagcgggggacaaagttaaaatgtagagtttttattggttttccctttgcttgttagtttgtttatgcaatcagtgttaagttgttatcagtttaaaataatgagttacaatatattatttacaagcctcctggtaatcgcaaatcaaaaaatatacaacaggttctcaaaaaataaaaagcaaaaaattaaaacacgccaccagagaaaatcacttttactaaaaggaagacaggaaggacaaaaaccatatgaccatttcaacagatgctgaataagcatttgataaaattcaacatcccttcatgataaaaatcctcaaaaaatcgggtataaaaggaaatacctcaacacaataaaagtcatatataacagactcacagctggtatcatactgaatagggtataactgaagactcttcttccaagaggtgggacaagataaggatgcccactttcaccactagtattcaatatattaataatactggaagtccttgctagaacaatcagaccaaagaaagaaatttgaaaggaagaaggcaaattatcccatttgcagaaaatatgatcttaaatttggaaaaacctgaagattccaccaaaacactattagaactgataaataaattcagcaaagttgtaggatacaaaacaaacatacaaaaattagtagcatttctacatgccaacagtgaacaatctgaaaaagaaatggagaaagtaatcccatttgcaataggtacaaataaaattaagtacctagggttaactaaaccaaaaaagtctacaatgatctatcaactatcaaatactaatggaaaaaaagagaacacaaaaaaatggaaagatattccacattcatgaattggaaggatcaatattgttaaaacgttcatactacccaaagcaatctacagattcaatgtagtccctataaaaataccaaggacattcttcccagaaatagaaaaaaaatcctaaaatttatatgaaactataaaagactcaaaatagccaaaggtatcccgagcaaaaagaacaaaactggaataccagttttgaacccagaaatgaatccatacatctacagcgaactcattttcaacaaaggcgccaagtatatactttgggaaaagacagtctccttaataaatggtgctgggaaaactggatatccacatgcagaagaaggaaactagacttctatcttttgccatatacaaaaatcaagtcaaaatggatgaaagacttaagtctaagactctgaactatgaaactactaaaagaaaacattgaagaaagtctctagaacattggactgggtaacaatttcttaagtaataccctacaagcataggcaaccaaagcaaaaatggacaaatgggacaaataggatcacatcaaattaaaaagcttctgcacagcaaaggaacaattgacaaagtgaagagacaacccacataatgggaggaaatatttgcaaactatccatctgacaagggattaataatcagaatatataagaagctcaaacaactctacaggaaaaaattaatctgatttaaaaataggcaaaacatctgaacacacatttctcaaaagaagacataaaaatggtaaacaagtatatgaaaaggtgctcaacatcattgatcgtcagagaaatgcaaatcaaaactattgtgagatgtcatctcactccagctaaaatggcttttatgcaaaagacaaataataagaaatgctggtgaggatgtaaagaaaagggaaccctggtacacttttgatgggaatgtaaattagtacaaccactatggagaacagtttgaagactcctcaaaagactaaaaatagagctaccatatgatctagcaatcccactgctaagtacatacccaaaagaaagaaagtcaaaatatcaaagagttatctatactcccatgtttattgcagcactattaacaatagccaggatttggaagcaatctaaatttctatcaacaggcaaatagataaagaaaatatggtgcatatatataatgtagtactatttagccataaaaaagaatgaggtcctgtcatctgcaacaatacggatggaagtggagataattatgttaggtgaaataagttactcacagaaacacaaacttcacatgttctccctttttgtgggagctaaaaattaaaacaaacgaaggagatagagagcagaagacagtttccggaggttaggtagggtagcgtggagggaagggtgggatacttagcgggtataaaaaaatgtaattagatagaatcaataagagctaatatttgatagtacaacagggtgactatagttaacaatttattgtatgttttttaagcaattatagggtaaaattggattgtttgtaacataaaaaaaggataaatgcttgaggtgatgcatacccatttaccatgatgtgattattatgcattgtatgtttgtatgtattccacaaatatatacacctactatgtatgcaccaaaattaaaaattaaaaaaagtaaaaagaagttttttttttttttttttgaatggatagcttctgtataagggataggaaagcagacttaactatttaacctgaccttgtatattaatttgtgctcttttggggagaaacacagcctattcattccaggcatgcagtgaatgctaaaaaaatatccacaaacaacatagaacagtgattttcagaagaagggatctagtgtgttctctgtgttcttaaagacagtgctttgtctgatatttttgcaaaaaagttgagtcttaagtatggtgcttggcaaaagttgctttatggaaaatggaaggcaaataagcaaaaagagatcatgccaaaatactccctgttttcagggcagattgttattccatatggggaaagaatatgaaaaagttctcccacccaagaccatgaaatttaagccttcattcagttgacagtcttcagtgagtcagattcctgcaggatttaagttactccctggctgactctcaggcatctctgcagatagttaacctttttcttgttatcttacagcaactataaattcttattagagtgataaaaagcaataacaatttaaaacataagctatttttaaaataacaatcttgcaaataggtagtaccttaagcaaagatgttttaatacctttttaggcctcactacttatatctaacatattaacatggacccactttccacaacgtagattatttttgctatcaacagtctgggaagggtctttataattttgcttttgaaattatgtggctactattaaactcatttaaccaatgactggccttgattttctttgcaatcatccagcatacttggagatacttgtaaaataaaaaactcagcacataagtttttttaatttagtaaaatgttaagaatactcatttgacaattattgaagtcgacataatcttatgctttgaacatttaattaaatgttagtcctcattttgcagttttctgtttgtattcaattacttcattttccaggtctcaaatggtttcatagccccatgagacgctcataggctgtagcccctgaggaatgtagtgcctggtatggaccacagaaccctggaggtgggatctggaaagaaagggaattctggtaagaagtgattcatgcaaggagatgtatttagcatttccagatagtgccctatttcctgtagtaccttgataattatgagttaccttcccttgctaatgagatgaagtaagtcatcaagcatttattgttacaagggttttattcatgatccagctcatacttagtatcatagatgatttttagaaagcataaattgtggttgccagctttgaggacctaaaatttagctgggaagaagaatacaattctccttaatgttttctctggaataactgaacacatgagattgcaagatgatgagtccaaggtttggatatatgaatgaccaaactaaagcaataatatggctttcttaaaaaatacagttatttaaatgattctagttgtgttaaatcattcttttaaatacctggtgagtggcttaggaactaagatagagtctgagaagaatagcattgctggtggccccaccaggatgagagtcattattatgatccaacaaaataggaggatcattaatttttcactcattcccagagatgtagttttgaacagggttaggttcttatttcaattagagaaactagaaccatgaaaagaagatttcagccctaaggaaaacagatatatcagagtttaaaactccgattcccattctgctcaattgctcagtggatatggtcattatttttgttctttgaaatggactttgttttttaagattatgtagaatgcattgtttggcaaaaagcacaggatattcaaacagaggcccaataaccaaatgcattttttctccattgcgttcttacctaaataggaactataataataacaaggcctcagtaatgcagagttcttgcccttctgtaagtgggcagggtgcgtgtgcaggtaggtaggccattaggtcaaatttcaatgtctgagatactctcctgaccccatgggagtcacataccactgaaggcaaaatctggctgcagggtcacctgtgttgcattggaggactgtgagtcatctcttcatactcagctctgcaacagtatgaaaaggtcaccacgaccacgctcacctattctggtgaattagacgtataagcagcctgctcccaactccttggagatcatttctgagaacatttgtcttctcaacctgttgctgggcatgactggaagcagaataaatgactacagaatgtttagtttacccagataaactgcttggcagtctttggattatgtaaaattaattgtggaaacttaatgttgaccagtgatcatagtatgcggacagacctacttagaaactgttttgtgtgtgtgtcagccagtgttactaagaatcatttaagggaatgaagagtaaaactcttttatgtaaggcattagtttagcagggccactgcatctctgtgtgagctgtccattgcccaactctagggagtaccatttttacaaaccacagcatgaattgtgctttcagaattgtgcaaaatggtggccctgtctttctgcatctcaaatggtgacataatgtaactatattttccatctttaaatagatcctgaaagctcaagttgaagcactgaggctgacactctgggctacacagagaaagcagtgtcagatggtggtgaggaacaccttgtaggcagaccgccaaggtataagtcccaacctggcccttactccagccaaattgctttagttttctatgcctcagtctcctcaattgtaaaatgagtgaaatcagagtggctgggagaattacattaaatagtgcaggtaaaatacttgaaagaacaatgcacgcagtcacggactcaatagatgttaactcttaagactgtctctcttttgttcaatcattaggattctggaatgaataaaacattatcacagctgttttactatgattctgctttaggaatatttgtggctgtagaggaaacattttctgtgtgcctttatgaaagctaataactaggaacagtttaatagaatgctcttagagaaaatgaaaaatagaattttgtgacagccattaagagtttaaaagagactgtggtaaggattgtctcttctggatgctttcaaatgtaattattggtgaaggctaatagaaatccatggagtttcagatactgatagaaaatgataggcatttcaaaaataaacattaagcaaaggctacaaaattaacattatacctccccatttatctttttttctctcaggtggcacaaaagcttgacaaagcgtccatgaaccatttgaagatttttgttgggataatcagatatctataaatgccattgtttaagaaagctaaccaaataacgttttactattgactaataaacttttctaataatcttcaattttattttaataaaatattagatgtagttcagtttctcaactctggaatagtgacccaggaaaaatatgagggaaacttgaagtctatggaagttgtatttggtgttaactgaggcctttgtgtcagcccagcacaaactgtaaagtcaaaagtgtgactttctctttctggtcttgacaggcttttgttttgatagacttgtcctcatctttaacctcctactgttcttctaggttatccaggtagctcttcaggtgcccaggttgcctgttgcctctgctagcctgcctagttcgtaacatcaggcagagatgaggcaggaacttcggccctcaggcttgattagtggttataaggccaaggatcataggaaaaaggtatcaccttcagattaccttccctgtgtattctgtttttgtagttttcatcagagagtaagcaaccgtcatgtgaatatcgtgtctttaatgatctgttaaaatggcggctctcagagaaagtgctctccattctcctcctcctacctcaggccccctcagaaatcaggctggtggtgttagggagtgaagtaggctaagtgtaagaaaaaaaaaacaaaaaaaaaaacagctttggaatgctgatggacagcaactcatatttgtcctcagtgtcaggataataaggactcatgggggtgggaaatattgtaaatacaaaccttgaaaggaggtagctgctattcagagagccaacatagccaacgtttctcaattgtacagagaaatgtgaagttatatgtgagatctttccactttcaatcgtgatgctaattcaaaatgaaaaaaaaaaatctgactggcctaacaaaacaagtttggggtcggggtggttactaggtttccttttagccattgtttgggacatactgatgtactgctttattaatctccaagaaactcatttatgttgagtggctaatgcatcagtagggtaatatttactttatattttaatattttataagttaatagatataataaataatagtaaccatacagtgggattagtttccaatggtaaacatttcaggccttcaggccttcaggaggaattttgaattgtgatgaaatggcaagtgcctattccatccaggcataaaaccaatcctagccaatttattaaaaaaaaaatcctgcattgttactctttagctaatgattaactaaagtctgagtgactagtagaatgagtaattttgttacataagccagagaaggtggaaggaaactaacatttattcaatacctactgtccactgggtacttcatctatatattctcttctaatcttcaaaacaacactgtaaggtagttgttacaaataaggaataattacaacttattccttattttgcagctgtaagttgatgtttagagaggtcacatccaagtctcttggaccatgcttcttcattatacaaggaatattgatgttgccaaatattaattcaggagctggtacagttagaaattagtaacacacacacacacacacacacacacgcgtgcatgcacgtaaaaagcaaggttaaactcgcaaggttaggcaaggttagctaccatatgatagcttaaagggaagaattctgtgctgataaatggagtatttttctccttaactgagtcatcctgtgtcattgttaggcactgtagacagtacataagttaactgagatctgatacttccttttatcccttaaaaatccaacacagggctcactgtaattaggtataaataggtgacttaacccttcagatctttctggaggagagataagtgtcttatgagattgaaataggagggatcaacaaagattgcagaagaattaagggctagcaaaatctgtcatgattccaaaaggatcaagttgaaagtgaaactagttcacacattttcacgacagcttcagagttaacatcctataaaggaatctatcaacattgtgacatttgtttaggcttctataagtgagaaaatgtgtccttccatgcaatactaaatgtaattatcatgttatctatttaatccaacttcacataaatcccaatgattaaatctactatctatttagaatattatcacatacttaggaagatatatcaataaatacttatgggtccttgtggtaaataaatactaatgtatagatgaggttatacttgccttagagagtttacaacaaaaagagggacgggtagtgaaagacataatgtccatgaaaaccaccacattattgctttatttgcttcacaggcctcatatgtgaatttttttttaaactatagattcttacctactaaagtaaagtttcagtgagtgcaaaatttgactggcttctatcctcctatgtccccagtacctagaacagtgcctgaacttaggaagcactcaagaaatattgggcaaatgaatgaatgaatgaatgacacagatcatgaatgttataatgagaaagcagagaaaaaaaattatctgggctggatagtcagagaatgtttccaggagaggggatcccaaatatggacttttaaagctgataaaggaaggcaatttccttgagaagaatggcatagacacaaaggctaggtaagggcaaagagacacctggagtaatgtggatttactgttattctatcagtaaatcttgatgaaaagacttgaggccatgtaaagaagaactctctaataaaaatggaatgggttcccttggggttggtaggagaggtgatttctgtgaggggaggtactggagcttggggtagaagaacacaacaaaaatatgatagcaggcagccaaccccaaggcacaagtgaaactttttttttttttttttttttgagacagagtgtcactctgttgtctaggttggagtgcagtgggatgatctcactcactgcagcctctgtctcctgggtgcaagtgattctcatgtctcagcctgccaagtggctgggattacaggtatgcaccaccacaccaggctaatttttgtatttttagtagagatggggtttcaccatgttgaccaggctggtcctgaactcctggcctcaagtgatccacccatttcagtctcccaaagtgctggaattacggtgtgagccaccgtgcctggccataagtgtaacttttaaagtttcctctcaccttgggattccaggcctctcttttggcctggttgctgaaacaatttaggagaatttctgaaaattttcaaagtattcataaatggaactttgctttcctcctcctaaatcaagacaaagctcacactgaccacagattatcttaaatttggtgaaaacatatttcagttggtggaaacacaattgttttgcaagttagctccagaagtggtaattgaaagtgacatttaagaaacattttctatggatctcagaagatgattactcattttgttttgaaggtttatgatatgctaaagtgtttttaaagcacattataattaaacaacttgtaaaaaaaatttaaatttccccctatggaagctcctatttcaaatgtagtctagagagaatttcaagtaaacatgtaactgcacatctgattttgtgataatttgctttatactttttaatatcatctttgatgttacatattcagatgtttaaataccaatacaaaaacaataataattttgtttaaattttccaaacacacaaaacaaagagaagcattcattcaaaatacttgtatacacatgcaaacaaaattaactttgtgtttatgactcacataagggaagttattggtgcccatagcctctgaatacccgcctctcaaagcttattattacaaagaccagtagctccttgcctgaaggtttttaattcctgtgagtcttggcaagggctattttctggctgcagttacatgcctggcctgagcataaataacctgggagtggtggattgttaatgacccccggaagcaggtgatggatgaagagttggtgaaaagcaccccagcttcctcatctcacagttgggataactctggggtctgttccacactgtcttccagaacccaacaatggggactgagctcctgtttccctctgtgggaacggacttgatgatgtgtattttttcagagatccttccatttcctgtctcacttccctactcctttacttaggtttcttgaatttcctaaataaacaactaatattccttatattggggtctactgctgcaggagcctaaaccaatacatgtctcttccattattttgtgacaccaaagaagattttgattaggcctagaaaatatacatgaaagctgatcaaaatgagaggaatgattaggtttgtttgtctgtttttggtaaatatggaaacaatgccatttcattttagtaaattgccaagttttctcaagtccctcctatctttctccatatacttgctcttctgtcatttgccttttttcatctctggcatacatacaacctgaaataaaacgccatggggtagattaacgagaaacactggaataaaaaaaaatgctcgcccaggcgcagtggctcacgcctttaatcccagcactttgggaggccgaggtgggcagatcacctgaggtcaggagtttcagaccagtctggccaacatggcgaaaccctgtctctacaaaaaatacaaaaaaattagccaggcgtggtgtcccgtgcctgtagtcccggctacttgggaggctgaggcaggagaatcgcttgaactcaggaggtggaggttgcagtgagcagagatcacaccactgcactccagcctgggcgacagaaaaagggtctgtctcaaaaaaaaaaaaaaaaaaaaaaaaaaggcttacagtgtcacgtgaatcacatgcttattaaatgaatgaaaaatacactttattatttcatgtgtgtattaagaggtcatatggatagatcagatgttggcaaatgaatgtgttatttctagaagaaatagaaatgtttccttatttgccagggcctaaatcagtgtttctttgaaatgagtatattttctgacagtatacttcatgcagacactcccacacactccccatacatgtgtgtgtgtacctgacttatatcacttaataatatgaacagactgaagataatgtcaattaatcaataataaatcctaaattccgagttaatgtctgtgctgttttgaacaaggtttgaccgtcttaaataaaaagatttttgtgtttgtttgtttttcacaaggtttgaatgtcttaaataaaaagcatctaggagctatagggtgtagagaaaactctccctgatggcatttttcctctactctcacaccacaaaaatcatcaacacagatgaagccttctacgaacaaacatgtgaggtttcccccccacaccaagcagccaacactagctgggtgtcctgtaattcagttccaacgctgtctacctggagataatgtcagatcccaccggttgaaggttcagttcccaagactgccccccaccacaccagtcacaagtgtgggcctctggagcttctaaccggccacctccaagttggcatactcataatcctctctttgggttcaattaatttgctggagtggctcacagaacccaggggaacacttacttatgtttgctagtttattataaaggatattgcaaatgttaccgattaagagatgcatatagggtgaggtatgggggaaggggtgtggagcttccatgccttacctggctgtgccaacctccatgaaagtccaagtgttcagctatgtggaagctcactgaaccctgtccttctgggattttatggaggcttcatgacatcagcattccttcccccagggtatagggcagtactctctctggggaaggtcttaaaagccacaatcagaaaggcaggaacaggtgaaaggagagaaggagaaggtcaggggcctgcccctgaggcctaacacacccaacattataacaaaagactgtaacaagggctgtgggagttatgagctagacctcagatgaaaactaatatatatcataacaccacacatagattcaaagatctaagttaagttggtcattagtcaacactatttaaaagccagatatgtccaaatggctcttgaatctacacttattatagcaaatattttaacgtgtagagatgaaaaggacagattttctttaagtgtctgaagccggtaaagagaatttctgccttttttcctctgtaaatctaaatctgtttgaagaaagaagtgcgctgtgaaatgggaaggcaggggtgggcaaagacacattttagtgaggttttaatctccattttgctgagtagaaatagaaaggagttttgaggtggtttgaagggaaagtgggggagagagagagagaagaaatgggagaaccactgagaaggtttaaaatgtcttcatgttacttaggcagataggcagatatgagcagggtaggagagtgccccaaggaatgtcaggcaacagtcaggtgactgtcatgcaattgtcaggggcctccttgggaatgacagatggtcatggctggcaccaagaaggggaaaatttcctcccaaacaggaaacatcttgagcttatgagcaacaacttcctcataagatcccaggaactaagcaaacatgaccaggcatctgcagtaaggggcaaaatggcggagtttggccttccttcggggatatgtccaggcatgctcaagaaggggcaaaacgtcagagtttgcctgatatgtgaccttcctttgggggcactagaccagtaacgaaaaattgtcatggagagcatacacacaacttcagccaccaaacggcacatgcagcccctgacagatattagcaagttactgcgcatgcaaggattagccaacagttcccccaagaaggatgaggggaggagatcaggaagaatcaggatacagtaactctataaaagccttgaaccaatgatcaagcggggcactcaatcttttaaattttccacttggtcccttccgaatgtactttactttgcttcaataaacttctgacttaaatctattactttttataaaatttttttccataagttattagggtacaggtggtatatttagttatataagtaagttctttagtggtgatttgtgagattttggtgcacccatcacccaagcagtatacactgcaccatatttgtaatcttttatccctcacccccctcccactcttccccccaagtccccaaagtccattgtatcattcttatatctttgtgtcctcatagcttagatcccacatatcagtgagaacatatgatgtttgcttttctattcctgagttacttcacttagaataatagtctccaatctcatccaggtcactgcaaatgctgttaattcattccttttcatagctgtgtagtatttcattgtatatatatctgtacaccacagtttctttatccacttattgactgatggacatttgggttagttccacagttttgcaattgtgaattgtgctgctataaacatacgtgtacaagtgtctttttcaaataatgacttcttttcctctgggtagatacctagtagtgggactgctggatcaagtggtagttctacttttagttctttaaggaatccccacactgtttcccataatggctgtactagtttgcattcccaccagcagtgtagaagtgtttcctgatcaccccttccatgccaacatctactgttttttaaaatttttttattatggccattcttgcagaagtacggtggtatcacattttgtgtttttgatttgcatttccttgatcattagtgatgttgagcattttttcatatgtttgcttgccatttgtatatcttcttttgtgaattgcctactcatgcccttagcctactttttgatgggattgtttgtttttttcttactgatttgtttggggtccttgtagattctggatactaccctttgtcagaggtatagattgtgaagatttttctcccactctgtgggttgtctgtttactctgctgactgttccttttgccctgcaaaagctcgtaaagtttaatgaggtcccagctatttatctttgtttttattgcatttgcttttgggttcttggtcatgaaatccttgcctaagccaatgtctagaagggtttttccaaagttatcttctaaaatttcatagtttcacgtcttaggtttaagcccttaatccatcttgagttgatttttgtatacggtgagagataggatctagtttcattctcctatgtgtggctagccaattatctcagcaccatttgttgaaaaggttatccttttccccactttatgtttttgtttgctttgttgaagatcagttggctgtaagtatttgggtttatctccgggttctctattctgttccattggtctatatgtctatttttataccagtaccatgccattttggtgactatggccttatagtataatttgaaatcaggtagtgtgatgcctccagatttgtactttttgcttggtcttgctttggctatgcaggctcttttttggttccatctgagttttagaattgttttttctaattctgtgaagaatgatggtgttattttgatggggattgtgttgaatttgtaggttgcttttggcagtatgggcattttcacaatattgattctacccatccatgatcacgggatgtgttcccatttgtttgtattgtctatgattcctttcagcagtgttttgtagttttccttgtagaagtctctcgactcctttgttaggtatattcttaagtattttattttattttttttacagctattgtaaaatgggttgagttcttgatttgattctccccttggtcactgttggtatatagaagagctactgatttgtgtacattaatcttgtatccagaaactttcttgaattcatttatcagttctaggagcttgctggaggagttcttagagttttcaaggtaaataatcatatcatcagcaaacagtgacagtttgacttcctctttaccgatttggatgccctttatttctccctcttgtctgattgctcttgctaggacttccattactatgttgaagaagagtggtgagagtgggcatcattgtcttgttccagttctcagagggaattctttcaacttttccccattcagtattacgttggctgtgggtttgtcatagatagtttttattacattaatgtatgtcccttgtatgctgattttgctgagagctttaatcataaagggatgctggattttgttgaatgctttttctgcatctattgagatgatcatggaatttttgtttttaattctgtttatgtggtgtatcacatttattgacttgtgtacattaaaccatctctgcacccctggtatgaaacccacttgatcatggtggattatctttttgatatgttgttggattcagtcagctagtattttgttaaggattttaccatctatgtttatcaaggatattgatctgtagttttcttttttggttatgtcctttcctggttttggtactagggtgatgctggcttcatagaacgaattagggaaggttccttctttctctatcttgtggaatagtgtcaaaaggattggtaccaattctttgaatgtctggtagaatgctgctgtgaatctgtcgggtcttggacttctttttgttgataattttttaagtaccatttcaatctctctgcttgttattgatctgttcagtgtatctaattcttcctgatttaagctaggagtgttgtatttttccaggaatttatccatctcttctaggttttctagtttatgtgcataaaggtgttcatagtagccttgaatatcttttgtatttcagtggtgtcagttgtaatatctcctgtttcatttcttagtgaagttatttggattttctctcttcttttcttggttaatcttgctaatggtctatcaattttatttattttctcaaagaaccaggttttgtttcatttatttatttatttttttgtatggtttttttttgtttcaatttcatttagttctgctctgatcttgattatttcctttcttctgctgggtttgggtttggtttgttcttgtttctagatccctgaggtgtgactgtagattgtcttttttgctctttcagtctttttgatgtaggcatttagggctatgaactttcctcttagcaccacctttgctgtatcccagaggttttgataagttgtgtcattattgttgttcagttcaaataattgtataatttccatcttgatttcatttttgacacaatgctcattcaggagcaggttatttaatttccatgtatttgcatggttttgaagattccatttggagttgatttccagttttattccactgtggtctgacagagtgcttgatataattcaattttcttaaattcactaaggctcattttatggcctatcatatggtctatcttggagaaagttccatgcactgttgaatagaatgtatattttgcagttgttctgtatatatctgttaagtccatttgttccaaggtacagtttaaatccattgtttctttgttgactttttgtcttgatgacctgtctagtgctgtcagtgaagtactgaagtcccccactattgttgtgttgctgtctatctcatttcttaggtctgttagtaattgttttataaatttgggggctccattgttaagtgaatatatgtttagcattgtgacatattcctgttggagaaggccttttaccattatataatatccctctttgtctcttttaactgctattgctttaaagtttgttttgtgtgacacaagaatagctacctctgctggcttttggtgtccatttgcatggaaagtcttttccacccctttactttaagtttatgttggtccttatgtgttaggtgagtctcctgaaggcagcagatagttggttggtgagttcttatccattctgcagttctgcatcttttaagtggagcatttaggccatttacattcaatgtcagtatcgaaatgtgaggtaccattgcattcatcatgctctttgttgcctgtatacttttgttttgttttgttttcgctttttagcttgtatttttgttttacaggtcctttgtgatttacgctttaaagaggttctgtgcaaaaatcacaagcattcttatacaccaataacagacaaacagagagccaaatcatcagtaaactcccattcacaattgcttcaaagagaataaaatacctatgaatccaacttacaagcaacatgaaggacttcttcaaggagaactgcaaaccactgctcaatgaaataaaagaggatacaaacaaatggaagaacattccatgctcatgggtaggaagaatcaatatcgtgaaaatggccgtattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacccaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctacaaaatgggagaaaattttcgcaacctactcatctgacaaagggctaacatccagaatctacaatgaactcaaacaaattcacaagaaaaaaacaaacaaccccatcagaaagtgggcgaaggatatgaacagacacttctcaaaagaagacatttatgcagccaaaaaacacatgaaaaaatgctcaccatcactggccatcagagaaatgcaaatcaaaaccacaatgagataccatctcacatcagttagaatggcaatcattcaaaagtcaggaaacaacaggtgctggagaggatgtggagaaataggaatacttttacactgttggtgggactgtcaactagttcaaccattgtggaagtcagtgtggcgattcctcagggatctagaactagaaataccatttgacccagccatcccattaccgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaaagctatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaagggggagggatagcattaggagatatacctaatgctaaatgacgagttaatgggtgcagcacaccggcatggcacatgtaccctaaaacttaaagtataataataataatttaaaaaaaaaagaggttctgttttgttgtgtttccaggatttgtttcaagatttagagctccttctagcagttcttgtagtggtggcttggtaatggcaaattttctcagcatttgtttttctgaaaaagactgtatctttccttcatatatgatgcttaatttcactgggtacaaaattcttggctgataattgttttgtttgaggaggctgaagatagggccccagtcccttctagcttgtaggctttctgctgagaaatctgctgttaatctcacagattttcctttataggttaccagtgcctgttctggtgcagggggtaggggttggggggcgcaatgggctctgtgggggttcttagctttcgtggtttaatgctctatttttgtgctggctggtctcctgccaggaggtgttgccttccagagagcatcagctgtggtagtatggggaggaaccctagaactcccaagattatatgccctttgtcttccactcccagggtagatagggaaggaccatcaggtgggggcaaggctaggtgtgtctgagctcagactctccttgggtgagtcttgctagggctgctatgggggatgggggtgagattcccaggtcactggagttgtgcacctaggaggattatggcttcctctgctgagtcatgcaggttgtcagggaagtgggggaaagccagcagtcacaggcctcactctgcttccacgcaaacccaaaccaaatggctagtctcactctcactgtgtctcccaccctctaacagcctgagtccattttcagttggagggcaagatgagcttgaaaatctgccccaggctacccacctcccagctgtgaatgaaagggattggttctactccacctgtggagtctgcacgccagatgtgtgccctcccctgagttctggccaggaggcttctcaccccattcaaattgttacaaacttcagctagagattttcttctccctgtagagttttaccccttgcacctctggctctggctgccctctggatggatccctgtgatgccaggcatggatggcctgctaggggactcagagagcttccagggcctttctgctactttctttgcctctgtatttcactcagctctccacattgactcagctccaggtaaagtcagaaacttctcttgcaaacagaccttcagcttctccagtgggggtgtgtgttcaggagaggagggtctccctttcccacttccacagttggggtactcacagtatttggggtgtttcccaggtcctgcaagagcagtctgcttccttcagagggtgtgtgggtcctctcaaggttgctggtttgttcttgcagtcaatctggagctataattcacaatgcgagcctccacatgctgctctgtccagagctgcaatctagtcctgcctcctgtctgccatcttaaatctacttctgtctcttggatgtattttttcttctcagacaataagaaccaaagactgtgtatcctgcccaaacccgctgccagtaacattttggtgtcatgaatcagattgcagcttctcggtaagaccctctgtgccttgccatctttggctggaggcacccaactctgcttacgtgaggtcttctttctcttgctgtctcactcaccagcccatctccagaaaaattctctttggtcactcttccctctagcagattcctcagttcatcctggtgggcgacagcagaggtggaggacttcagagtctgtactgagtagacctaagtcactgtggcccttttggacaggtggctcacaagggtgatagggcttgagcctaggccattcaaagactggagaccttcatttccttaaccaaagtggacttttccccaataagtctacaccctattatgcttcctttttttctgtggactttgagatggccttatatgctggccacactgtctgtcttgggggcaagtcaacctcttccctgcttctattctgcatatcatgcaacttctttctctgcttaatattgggaagactctgtctccaccaattctttatttcctatcatgaatttttaaatcctgctacacattgagaccaggttttccagtggctcttgaggtcatttgtttgtctccatagggcatctgtatgtggtccattaagagcaactcctacttcctttctagagctatctgcactttggggagaggacaattctttctctgccttttgtggtctctcatcccaaactccctggccctgacagttcttcctctacactgagaagactgataggcaatgtcctcttaggtctaagggctgctgtttgtgagactgtacaaaagcagccttccatgaatatcccttattttctaccattcccacgggtggcagatggattgtcctgtcattttaaatacttgttttccatgcttccccaggaatccacaggagggatgacaaggggactcagatgcaggttttcctctgttcctctgaccatctacattcttaacatatactgggacctacagtgctatgtccagagaaaggaaggcccagttcccttacagctgctggctagggataagatcctcacctacctaaagggatatggagaatgggaatttgagagaaaggaaaaccatttcattgctggaatgctccaaacaaaggtcactgtaagatcacagtgtcaaaggtacaggtcagccagaggccacaggtgcaggacagattaccattagcagagagatgaaggctggtcctggagggaaatgtgggaccagggttagtggtacctggtaatcactggtttattccagaactccaggatgaatgggggatgccctactcactactctgatccaaggtataaggggatcaggaaggaatgctttcagctgggcgtggtggctcatgcttataattccagcactttatgaggccaaggcgggtggatcacctgagttcaggacaaaaccccgtctctactaaaaatacaaaaattagctgggcttggtggtatgcatctgtagtcccagctcctcggaaggctgaggcacaagcatcacttgaacccaggaagtagaggttgcaatgagctgagattgcaccactgcactccagctgagcaacagagagagactctgtctcaaaaaaaaaaaaaaaaaaaaaaaaaaacagaaaaagaaaaaagatgaagaagaagggactctttcctcttccttactcttccctgttctgtcttgcagatagataacggtgtctccatactctgggactgaccccttggatgcatccttaaaatctgcgataaatccaaccaccaaaccctaaaatgaaaaaactaatttttcattgcagaggaagtctggctagagaatggaagtacaaattttaataccattctccggctagaccttttctgccattatcagggcaaaaagccagaggtcccctatttacaaacctttatggcctaaagggaagaccctaatcctcgtaaagcttgtaaggcaaacctcacatcctagctatgcttagccatctcctccagggccctgcatcggccctggagactcctctgctgattcctctccaacatttcttcctccagaagccaaaaggaaaaactacctcctcctttggaggtgaaagagggagaaacagccacccctggatcctccccctatttatcccactcccagacctttggaattggccccactttacaccgggctccttagttctcctctccaagcttgtaggaggtaagtgagccaactgaactcgtccaggtccagatccccttttccatgtacgacttttgacaacttaggaaaaacctaaaaaagttctcagatgaccccaaaaggctcatagagggcttccccaaattggctcttacatttagattaatttggaaggacataaatgtactcctgggacaagcccttttacaagaggaaagacagaccatctgcggagcagcaatccactgtcgaaatgacttacacctggaaaatgccaactaccctggaggggctacagctgttccccagctggaccccaatcaggactacaatgccaaagcgggaatatgggccaggaaccataggctcttgtgtctaatagaggtaataaaatgaagtaagatcaagcctctaaactacaataattagccaccataaaccaggggccaaatggaaatcctatagcctttctgaaaagtctacaggaaacttattaagcacaccaaacttaaacccagaatctcctgagggactagtcctaaaggacaatttacccaagctgctccagacattaggaaaatttacaaaagtcagccttagaacccagtgcccctatgccacaaatcctcaaattagcctcctcagtcttttataactgagatctggacaaggaggacagggctaaggaaaaggagaaatgcagggacaagatgcaggctcaactattggctgctttacaagcccaccagccccctccagggtctcctaaggaccctcctccaggtaactgccactgatgcagaagaccaggctactggagaaggaattttccaaatgggccaaatgggaggaagccccacacagcctgccctctttgtgataagctggagataagtcccactggaagagggactgccctgggatccaaaaggtcccccagttgaacccccatccaataatggccttgagctgaaggggccctccactctggccagcttccaaatcagacatcatcattaaaggaacagagccaagggaaactctggaaatgacaggtagtgctataaatatccttttaaatacaagaactgcctactttgtgctaacctttttctctaggcaacttacccccaaattctgttgggtaacaggagcaagtagcaaccccttcctctaaagattcacatcccctttatttatattgcttatgggactaattactattctcccactagtccctggcaatgtctaaatgcctcacactgcttttgagtaggaatatactttccaaaatgggtatccacttaatatttacccaacatctggactgatatttccccctaatatcccagtttctcccaggaaagccagcagtcctacctcagggttttagagatgccccacacttatttggacaagacccagcaaagaaatctaaccaagctatatcttgagtggggacaacttctgctgtatgtagatggcttactcatctgctccccctccataaagcttgcacaacaatatgcagtacaaaccttaaccttcctagcaaaatgtaaggtacaaagtatccaaatccaagacagagaatttcatacctagaaccaaatatatatacagagagtactgctggctccagaccctctaacaaccaacttgtgtacccacccaggtccttattaaaacctaaagtgatggatctacaaaatctcaactaatcccctcatggaaaggcccttttactgttttcctttccactgcaacagctatcaaagttcctggcacctctagttggatacatcattcctaaataaaaccttgagaggcttctgaacaatcaacaataggaccagcacctgagtattcctgtgagtcattggaagatctataatatctctttcaatgaaattataagtaatgccttcttttctttcaaactaatgctagctcagcataaggtagccccagtactctggatcttattcatggtgggattgcttatgcttacacttggttcaaaaccaacattcccgagtgggcctacacccctccaggctatgtatttttatatggacctaaacaaaataaactgccctgtgagggaagttctaaaagaacttattcaaccccctcacttgtaaacctttttatctgcatagataacacccaacatacaggggatgtgccctaggactcctggggccacaaggaacaggtgtaaccatctataacattacaaattcttaaaaaaggagagctcttggccttataatggtagggctaggggctgccataggattagctgccccatacagaggattcagttatcataaagtcaccctccaaaacctctctacacaaattggagacctaggtcagagaactgggaacagaatctctaaactcaaggcttcactgaattcagtagctaatgcagtcatggacaacagactagctctagattacctccttgcagaacagagtcgtctgtgctgtcatcaataaaccctattgcacttgtgtcaacaatagtgggcaagtagaggaacatataaagagaatctgtgaccacgctaagtggcttcatgactctgggaaagaaaatccctcagcagattccatctggaactctgtaaaatctgctctcccattgctcacatggttcctcccctgctcgaaccagctgtctccatacgtctacttctttttggcccctgccttttaacctactagataaatttgtcttctccaggatataacaatttcaaaccaagttcccaataatgcaggtgatagatgcaggaggcagataagagggaggatccctggagaatctcccgcccgcctgtgcactgcgacgatggggtaaagctaccaggaagttcatgccttgttggggggaaagagcctgggaactttagctcgtgtgtgggggcttggaatccaatctgtgagatgggagcctgctggcagaaacccctctcactttgctgaaagtttttcttttcttgttttccttttcgcccaataaataataaattccattcccctcacccttccacgtgtctgcatgcctaacttttcctggtcgtgacacagaacctggatttagctgaactgaggagcagaaattctgcaatacaggaatatctacctccctacccaaatgtgaagaaaacatacacctgtttcccctggacctggctggacaccaattctacctaccgatgggaccattctgttctgacaattagcaagagattgagacccagaggacaaatacagcccttatttcagcaggaagcagccacagaggactgaccttcatccactagccccaaataattgagtctcacactcttgaggggggaatatgttagggtaggtagataggtggatatgagcagggcaggatagggccccaaggaatgtcaggagacagtcaaatgactgtcattgtgactgtcaggtggcctcttcaggaatgatagatggtcatggctggcaccagggagggggaaatttcctaacaggaaacatcttaagcttgtaggcaacaactttgcgataaaaccctaggaattgagcaggcatgcacagtaaggggcaaaatggcaaagtttgactggtatatgaccttcctctgggggcactagaccagtaaaggaaaattgcccaaagagtacatgtgcataactacaaccaccaaatggcgcatgcagcccctcccagattactggcaagtcactgagcacgcggcgattagccaacagctggcccaaaaggaagtatgatgggaggagatcaggaagaatcaggaaatagtaactttataagagtcctgagccaataatcaggcgggacactcaatctttccagttgcccacttggtcccttccaaatgtactttgcttcaataaacttttgcttctgtctgaaatctacatctgtctctcagctgaatttttttcttccaggaagacaaaaactgagggccgtagaccctgcctggactcacctcccgtaacatttagactctttatttcacttaaatacttgatcaagaggtacatgaagataacaagctatggggctttgcaataataaaggcagattgccagtctgagtttggaattggaatcggtatagacataagattcatgaaatttcaaaaatgacatatttctttacatgtttatgatcatgaaaactagtctttctgtttaaaagaaactacctgggttcctttagtctttgaacatagaactttttttttaatgttacattgatagctgaaacagttgataatcatgttctagagcaggtgagtgttgctatatactggggttgagatggggaaaatgaaataaatgtataaaggatcagaactacagcatcttaaagtgaaaacatcacaaagctcagagtaaatttccatcttgctgttgatttatatataaactgtactcacatgttcagaaggagaagtggaaatattatcttggcttacatggaagaggaaaagactatatctagttatttaaaactacctgttaacttacccacagacacagctctatgtaatgaactctagaatgtggttagtgtcaatgttccagttgtggacggaggaaacagttttcaccaaatgtagttgacaatggctgtgaaacatggcacagtgactagaatgaggtaaacagatgtcataataaccacgggacacctgccttcttcacctctatgaaaatattgctgccttacacatgggcagaggtggagaaatgagaaattctgtccttagacacttcactccaaaacctgccaggttcaagtgctgccttcctgtctcaatggagaatttccagttctactctagggatgaggctgtggtctctccagaggtgggtcatggcctcagtactataggcaggcactacatcctgcagctgtcaatccaggctgataatttgagacctagcagctgatgacattccttctctgcatggcagttgtctctaacaggccagtgcacatctgagccaaagatgacatttttggcatttgcctagacgttgagagcatccactggcttggtgggcaccagttggcaagaagggaaaaccccagccaaggaaagttttaagaaggccacgtgctggcccttcagaagcagctgcattcatagtacacactaggggaggcaaacgtgtgcctgtgtaatctgccttcttcactcagtgggagggaggccagttaacaatgatttcaactctttattaaaatcaactaacacattgctgcacttagatagtagtaaccaggcaggacaccagcaggcttccctaactgcctttttattacaagacctatttcaggcccatcccactttacatctctgcagcatgacttcccaaattacaggcataataaactaacaaaggccacaacccctgcaggcatacagagtcagattacgtctgactgaatctgctttctctattcataaacaacttaaaacagctctttccctcgcgtaagaacctgacttgccaggcacacagtgaaccagcagaagactacatgaggacaatggagatatgggtgagacaagggcaggagatgccttgttcataggaaatgaaaagctctaaagcccaaagaatttcccttaattttttccacgcagttcccttgaggttatgcagctggatgttctcagagctgagagtggactggcttactataaactattcattctaccttcagatactttcaggccctctgttacgatggttgactcaattgttcctcaaaccaaagcttatgcatgtctaagttctctgatcttaaccttttgaaaggcagtaaaatgaaagaccttatgaacttttgtttgtccgtgatcttacttcctccttttaagatagttttccttatgtaaaagaagcatggagtaattgactttggacaagtgacagagaaagggatggatttctaacttaactgttggcatataccttgagaatgaatacataatacacgttttagtataagccacagattcctctggtctgggtacactggaggcatttttataaatgtaacatggtttattgacaaattcagggaattgtttcacattggtcttttctgtcataccagaggaagttttagactaaaaataatattatccatgttttacagataagcaaattgaggtggagtacagttaaagagcttgcttaggtcacatagctagggacaaatccctattaaatggaaaggatatgagactgaattagtttgccatgcagtaattaaaatcacaaagttctgtacaatctccttgatttttaaaagaaaaagttgtctgtttcatgaaggacagctacttacagaatatatgcaatagggttaagttgaaattgtttcaaatacacaaaagaagccattttttaaaaaaagggttctgaaaggggtgaaaatattctgttagtcaacgaagcagaccacaatagtacatttatagacagattagaatttatggaaagagaaaataaattaaaaatatgaaaaatgttaaacataattgtgttacggtggtagaataataggcaagattttttttaacttcttttttcacaatctctggatgcatgctgtttttgtaattagcaactgtgtgttaaagaaataaactacgtaagcagcccctttctgcacaagatggctgctatgttatagaagtctagttcaatttatacacaggtgaatttttctaatcttttattttataaacaacgatttggaaaattcttttatcttaataaaaaaaagaccatagcccttctgttcattgcaggcagtctttagttaagacaatacacacaggaaaaggaacaggttatcaaacatgaaaggtatttagttaaaaaatcaagtccctgctttcaaaatgctcataatctaaggagattcaagttaagctcatcatagagctgtgtgcagtatccttaaactacatgctaatttcaaatatgagagagtacatatatatgtgtgtgtgtgtgtgtgtgtgtgtgtgtgtgtgttttcccaagacctttctccttccctatttaaaacaataacattttgtcaagggaaaataaacaaaataaaatagtttgaggttgacccaaaactctgaatatttgaattctaatttgattctaaagtcagaaaaaaagtctactctcctggtataatacttttaaagcaaatggaatccatcatgcatgaaaaactaatctctgacctttaatggtaattttactgattgaaaaaagtttcaaacactcagttgtgggaaggaaacagacatttgctcacagtctgcagactttggctcagctgacagtaattttccattgattgggagaaaatcatggaaattacatagctatggctggctttagactggtcttatgtaaatttcaaccttaattctgtgtttattcttttgtgtgagtgaaataacaacagagtctctataaaaagatgttactaatatatctgaggtgacctataactactatgcatgatatagttatgtcttttggattaactatatattttatgcatttataatacttatacatgcacagttaaaattcttttaggaaaagcaataaggtactctgttctgaaattgtttctacaaatgctgcagtatgagtttttcaatgacttaaaaatttccatatgaggagaagtgttagaaatgtatttttccaaatgcaggtgggaggacatcttctaagcctcaagccagttctacaggaaccaagacaaacaccgaaaagtgaaataagattaagtctctgcaccatttctaaagcagtgaagcaaaactaccttcaagggtcagtggagaagacacccagtccacagccatagatgctaggatagtcttggtcacatccccagccataccttattgagtcttggtggttgaccctgagctctcatgttctagagttccataatagccaggcttccaaatgcaaaaagtgtgtgtgtgtgcacgcgcatgcatgtgcgtgtgcaggtgtgtttaggcaaattcacttaataaaaatgggatgctgataaggtgagaaaaacactagccagacagcctaaatgaacagtaaaacacttagaatcgtgcctaacttagaatagtgcctggcacttagtctggaaacacaggctatacataatatcaggaaggacatcttcggtccgttaagatatataataactatgttttcagactttatagaaccctgtattttcataggtataagttaccatttatgagaaacccatacacaggaggaaaataaagtgaacaattttaatcataacaacttactgagttttaacttcaaagcgtgtacttatatttatacttatttgatgtaattcattacccatattttgtcagcagcaacttgtaaaaactttaaatgaactactatattgtcaatcattgctttaaaatctcaaaatcatttcatgaatacagcacattaatatatgacaagattgaaaaaagttatataaaatctgattgagggcataatttgttaataactctaggcttttaaaaattgtgaacttagagcaccgctatttccctttcaaatctccctctctcacctcctttcctcctctactccttcttttcttttcttccttctttccttctcattattcaccaacgaacccaccaaccaatcagcaacaattatttgttgaagctttttgttgttttctcattaagataaaccaattaagtaatctattttttctattgataaatttgtttatagaaaataattttaaagtattcaatttctaaagtcggttgctctaaagacccatccttggagaaatccaatgatttcctgcacttaacactgggatgaaacacagggcccagggacattcatattaaacttgaactgactccatctgtactttgttcagtctgtttattgtgcttctattgagttttcattctctcagtctgatttcctttctgctcctgttccaccaacatggcaccctgagggcttttctccatacatcagacatgttacctggcctatgtctttccctcgctccctgagatggcattcttggaacctggcattgaacagggccttcctcctataatgtgtaatgataatcctccaatctactgccctgcctagacaagatttttatgcttagggttggaatcaagtttttcaagcacaacccctgtgacagctaatatttaagggtctcagcagaatttaatttgtaaagaactaaatataaatatacttcttaaatctggcatcttgctcatcttcttgcctttgtgttctccctgttcttttttcctttctttcaaattatctcctgcaacattaagaaaagtgtggaatggaaaagtagtcataaaaagaaagctagagtttggctctgaaatgtctatgagatggtgtgaaaaggcgcctcaggactgaactgtgcctggaaaggcaactttttcttcactatatgcagccttcctgagtcactggtcactgctagcagcacagaagccacagaatgaaaggagagcaagtgctgagtgtaatatgggaattatagagaaacagggagtgagttcttctgttgtactgtatgaccatgtcaccggtccctcttaaaagataatctaaaaatagagtacacgcatgcgcacttgtgcacacacactataaggtctgctcaagtactaggattatttgggcttgaggatttttggattgattgaatacaactttatttatgtatccttgattcaggaataaaaaaatggctaaaatcttttgctacatagcaattagagatttagggataacataatctgaggatgtcttcaagtctcagatatgtaacttagctgtgcaatcttaggaaaattatgcctctttcatgggccacataaattctcaggactaattaagacacactattggcacaataaccagcaaaatgccttagtttggtttttataagtgtgctggatttttggaagaagtccaataactacatactaaggaaaatagttcaatcattttttattgctttagttcttatcattcactcagtattgctggtgattgagggaacataaacctctagaggaatgaactgataccactgcatgagaccaaaggcaactaatcatgaaatgagacagtcctgaagtaactggttctgattctgaccaagcaacccaatgagtagtttatgggctcatgtcatccctttgaaaagcacaaataaagagcaaagaaaggaggtcacacaaatggaggttactctcctgagtttgtcaagaagctcattgggcactccatagttgggaacactggtattctagaatctttatggcttatgggtcaaatccaatgctatctatatttacattatgttttaggcattgcagcatatattcaccatccttttcttcctcatgctctcctccctcagtgatattgggtttagtcacattatgtgctgtggctaacagaatgtgggcacaaatgatactgctttataaactgaggccttacaaagtattgaacatttctacttgccacattgggagttgtaaactgtgccacaaggacacgccctgggagatcactggtccaagaaggagaaacatgaagaacaagcatgaaggcaacctgcagcctgaagcagcactattctgacccattagtaggactatgagcaagaagcaaatgtcattggtattttgtagttgattgttcggtagcattactgtagcaatagctgactaatgcaccttgcaataatagatcaacacagaaaatgtgaattttgtttttctcttggaatctcaacagttctgactaattcaactaatccctaacctttctattttattttgcctattcaagcttgctagcaatctagactgttatcattccttaaatatgcttcatgtagtgtacagtgcctccaccctcgacaattcccatctgtctaatctttttatgcaagattcaactaaaatttttttctttcatgaagaacatcagattctcccactaattctttctgagagagaggcaatttcttctttaagctcttttatctctctctcttgctttattgatgaccatctgtgataaattatagtacccctagtattgttctataccacttattggttaatatatcccttggcatttgaaaatgctttaaggactggaatacttctcttgaatttcatacagaataagcccttcattagttacaatttaaattaattcactccccttgcccccagtctgcttcttctttggatatcctaactcagtaaatgtcattcccatcctcctagttgtccaagccagaaatgtgagtgattattaatccctatttctcttacctattaaccaagtcctgtttagtcaaaacccctaaacatcaatcaaacctattcacctctctccagccccactgacattatcttaaagcccttcaccactctttcctggaatattgtaattgattctcacatgttctacctacttttggtcttgaagatttgcaatccaatttcccacagcagccaaagacattttttttttgaagtgcatatttaattatgtcatttgctgcttaaaatatttcactggctccccactgcagcagaataaagtagaaatttctatgtgacttatcagatcttttatgatctacagtttacctctatagccctatttctgactgactccccaacttatgctctataccttaggccaactaatttttctgcatctccccaaacctaccacattttatcttattcccagtcatttgcacatgatactgtgtctacctgataccctctctctccttccaccaccctttccttggctatctcctcttgagctttatatctcagatcagataacattttcattaaaagcccactctggcattcctctctccctcttgctcaagcaagcatggccaggggcccttcttgcgtgttcctacagcatcctgcatttacatgtttccctgtagcacttatgatactatagtttctgatttacttgtagttgactctatgggtagcctacccaagagccattccttcctactaggcccccagtgaaattcaaatatccacctacccttgcagccacatacttacagggaggtgggcctcagccccagccaccatgagggaaacctgattgtctcagctaatcatgaaagtacgatttccaaggcagtgatttgttaagacatcggcatgtgaaaccattttggccaataagacattgaagggaagtgggacaaggggagaccatctggaaatgattttttttctttcttaaaagaagacgtaaaaagaagatcctcttttctgactggccatagttatctgcatgtaataggtggacctgtgacagacatctcgagtttacaggaacaaaccagaaaactcaccaacacttgaggctggcagaagagaaagatgaaaaagactcaggccgcctttgataatgtcactgagtgacttggagcctcccacctcaggatggctttggtttaagccagttaagttacaactttctggcagttacagctgcaagcattctcactgactgacacatgtctatcttcctcactgtactgattattaatgagaatttatgcttggagatggaactgcaaaggaactaagaactaaagaaaacatcttagaaggctgcatggcatcatggtaattaatagggaaaactttattaatgtggcatcatatagagaatcagaatcagcttttgaggaaaaggatgtagaagtcttctgatttattttctgggccagagaataaaatggaacagtaatagccttttgaaaagctaggtttaagatgatcacagaaatcctactgtaccaaattcagaagcctctagaaaagtgacctaattcagtttctgctgtgctctgccccttgctgttcactttcctatctcagctctggttttacttcaaaagctcaggaacttaaaagggggaaacctaacaacatatttacctaaactctgatcaaagatccaagaaaaggtcaaggtgatagctgaacccacaattatattaaccttttgtggaaacattgaacaatgcagtagtatctttgcttctgcagaatatcttgttagaaacaggaatttcaagaatagccagaaagataaatcttcttgctacctacgtttttacgctttaaatagtaaatgcatagcaaaaggacctacacagtagtgtattaaacagtgacacctttgtatttatcaataacagaactctcaatattcataaggaaatgtaagataatatggataaccaagattattgcttgagcatattctttaaaaattggcagacagttcaagctcctatagtgctgcaaatggaacttattgtatacttatagttacttgtaaaatgagataattcgtataaggtagaagttacccctcccttgaaagtttggtagaacttgtatgtagaattatttgagccagtactattgacagtctgcttattcactaatttctatgtgtggaggggtaggggtgtctaaaattgtaactattgatgcaatctgtcaaattgtataggtctactctagattttttttttaaatgtgttgagtcacaatgataaactagattaagaaaatgtggcacatatacaccatggaatgctatgcagccataaaaaatgatgagttcatgtcctttgtagggacatggatgaagctggaaactatcattctcagcaaactatcgcaaggacagaaaaccaaacaccgcatgttctcactcataggtgggaattgaacaatgagaacacatggacacaggaaggggaacatcacacaccggggactgttgtggggtgggaggagggggaagggatagcattaggagatatacctaatgctagatgacgagttaatgggtgcagcacaccaatatggcacatgtatacatatgtaacaaacctgcacgttgtgcacatgtaccctaaaacttaaagtataataataaaaaaaagaaaaaaaatgtgttgagtcagtttgtttcatttttgtacttttgtgttacaatcaaacttaaaaatataacccatggtaaaaatactgcagctttaaaaatacattattatttttccctctctgtgattctggagccatatagtctatagagtagccccccccaagacacatataactattaaatacttaaaatatggctagtccaaattgagatgtgtcaaaaatataatacacactctggattttgaagacttagtatgaaaaaaataatttcactgacttttaaacttttaaaaatctggctattaataaaaatctaaaattgtatatggggtgtgcattatatttccactgggtagcactgttctaaagcattcaacagctctcctcacattatgccctgcactacagacattgacatatgtgtaatctctaaaacacatgttacaatgaaaaaaagcatattatttcgaaatagatgtgtgatcttgcttggaaaagacacataactttcttgcatttccattgcttcatctttaaagtaaaagggctgcataagatgattcctaaattcctttccaattcgcatatatttaatgacttcatcatttccccaatagattccaaagccagagaatacaattcatgtaatagctcatttcagtttgataaatatttctgaagcatttgtcatgtgccaggtcctgtgagaggaggtaattttacacctaaccatcttccacctttttttagcactattctttattcttggcaactctttgagaaatatctatggaatgaatggacacattattattctgctgtctcatatgttaatacagaaacagaaatacacacacacacacacacacacacacacacacacacactccagactggctgtgaatgaaataccaaaaaaaaaaaaaattaaattgagttgtgattctttagcagaaactcaagtgcccatataactgaatggtctctggatctggtagctaaaagtgctttactctttctgaaaaatggaaaatgcattataagtctaagtaaagagcactccaattttagctgccttggccccttctgaggctttcctgggtcaataattagcaacagagcccaggagactgggggaaggaacaggatgatgaacaagtgcaaatgagctaccttaagaaagcgatagcacaaagcatgagagcactcagaattgtactgcaaagtgttcagattaggcaggcccaaaaatgaaaaaattgaaaattaataaaccagaacctagctgtatgcactgacttaatgagatccgttgttaatgtaacacatttttgcctactacttttgtgaagacttcttaaattattttaaatatttctcaagaaatgcctctccaattttactggggttcttaacgttcttctcaattttctttccaaaagcataagggagagaaatgaaaagatgatttgaaatactagaaagaatgtaggactaagagccaggaaatttggtttctagtcacagaactgctacaaactggtgatatggagttgaacaaattgtttagtcttctttggtccatttcttcgtctgaaaaatgaggataaagctctgtatattctagaggtggataagggggatcaaatgagataatggtaagaaaaattacatttacaagatacaaatgttctataagtgtattttatacaaaattatcagagaagtctcttatgagctaaaatatgataatagcacatgtggtccaagatccaaaagtgaagactaagaagaaaaatatataacaaaaattatatccttttattagaaatagcacaatatccattaaactaacctttaaaagcacagggagcagtggttaattatatagactctgaagacagactagtggaatttgaggtctgacactgccatttactagctgtgtgatttggggcctctcacttcaccttgtgtactgcagttttcacatctgtaaaaagggggtaataatactacatccctcctatgtttgttgtgaggattaaagcacttcacatatatgaaacactggcacaatgtaggtattatataagtatagctgttatatgggagtacattctagaatgctttaaactctaggcacacttcctagctagcatttgatttatcttgtttgaaaaacagcctgtatttaacatatacatatcagaggttggaagtgtcacaagtgtatgttgggagaacaaagaaaagcaacttcagtacacaatccacaaaataatagcctcgatggactctacacttcagagggctaaattagatggtgaaaccaagtacactcatgtagtgccttggtacatgtgtggctttgtgtttttacattttcctcaggtactgaaataatgactaaaaacaccctgtatttgcattgcatttaaaaaaatcactttcacatatattacctcattagaagttgagggtcattaaaagtggacaatgaacttgctttcaccctcacaaatctctctgaggaatcaagtcaattgaatacgtgtacttgagaaaaaaggtgggctttttgccaaatactttctggcagctcataagcctgagcttttcatctgagccaactgcaagcctggaagggtccagaaaagcgactcatctgctcagcagacctcactgcccctttgttgtggtgggcacggtgcctttcacacacagctgttggtcagtatgtggatcaccgactgcatcctccttgcaagaaggccattttggatgtttcgctaaggaatccaagagtgcaaggcagagaggggaggctgactagttggggacttcctccaggattttcccataggctccacccagttgcttcattccattgatggattcaagggtgattttccatgagactacacctaatggaaaaggaagtctcgggctgttcttatctaatttgccaactgttacatcagcattattgattcagagcccccaaatcagggaaatatagaacagatgggaattccctgcaaatgttttcatggaatcatttgctaggaaacccccaactagcaaaaagcataaacatatacctttttattgaagccctgtaaaatctaaccagaatgcttgctccaggaagagtctgttctcagaaatcatgttgtctgatcaagtttacttcttttgtctactcactgaagtccttaaatacattataagagaatatgctaaacatatgtcaaccttcaatcaataagcatagtgtaatgtctaaaggtcatgatttggattatcacaatactttaggtatcaaaatttataaaactgagcatatctatattatctgccaaatggaaccagattattttaaaaatttcttcatcatcttgtgttatttgaatgtaaaaaacctgaaggcaggctgtccttgtctacttattcaacacttagatcagtgcctgaaacatagtaggtattcaaaaatatttatagaataaatgaatatctgagaagctgagtcattctcaccacattgacattttacatttatctatagtcaaaacagtctcaaatttatgaagggaaattaatattagcaacataaaagtgttttcttttgcagatatatgacattaaattataattgtgcaaagtcaaaaagtaatttacaaattaattatggagcattattaagtgagtcaaagccattctataaataaacaatgcagtacttttctaaaggttgttactattatatgtaagcccttgggatgaaaactgggagtcctatctttaatatgttcatcacgttaattaatgaatgatataaacaattcatgcaaacacctcagtcaagcattactcttggggatcagggggctatttcagtaacaagagttaaaagcagggaacacaatcttggatttggtaaactcatctaaatttcttgatattctccaaagagtagcatttaagcaaaacctggtacagaagtgaaatatatagttgaagccaactttcccttggtaaggtaactatgatcctttcacattagtgagatcgtttggaccccatcgctaaactagccccaggcaacctgttcttggtggcattctccccacctcctcctgcacaattctctcctgcagagagaagggtaaaagtcttcatgctctcccactctccaatgatgctcatgaaaatttgttctcaggtaagattctaatctcacgtattcacactcacatacattcaaatcaccaagctaccttcccctgaagtatctgacttactggtttgcctctatgttaaaagagaaaaccattttttttatttctcaaaagaaattttaagacttagctgtcaggaaaataatgtcttttagtttatttcgttttgagattaaaggcctttctctgacattgaaatttcatatgtagactaaattgaacaatttggttatgttgtttcagctacttacaagaaactacacaactcattggctggttgtctcgctgtggcacttctctgtttatgttgccatggcttcctcgacagcctcattcctgccttcgtgtctgacacacatttctgacatcgtgatggatgcctctaccctgagcaccagcacctcctcaagggaaacgcagcctcaaccacactcatcattttctttcatcaaccgcctgtccttctggatcgcccagtttccagtcttgagagctccgttatcactgaccctctgtctcctgatcccattgtagtagttgatagtgtcaactatgttacacctatacaatgttttcagaaatgacctctttttctattttcccctccatgaatttagtttataatattatttcttaaaatacaaataatacttgctcattgtagtttttccctagggctgccattacaaaataccacagacttaggtggctttaacaatagaaacttatgttttaaaacagttccggaggccagaggactgaggtcaagatgtcagtggggttggtttcttcgggagacctctcctcttggcttgtagatggccatcttctcctcatctccacgtagtcttctctgcgtgtgcgcgtgcatcttaatctccttttcttataaagacaccagccttgttggattcgggtctaccctaatgatctcattttatcaaaatcacctatttacaggctcaatcttcaaataaagccacattctgaggtcctaggttaggacttcagcatatgactttgggtgtgacacaattcagcccataagcctcatgttttccctatggtatgtgctctcagtccagaatgacatttcttttccagaatcattttgataatctatagaaaaactgttccacagccacagagccatccttaaacaaagtccctctgttcagaatccaaggcctgttgccccatgttaaatttatgttttcaagttccctttcttgcaattctaataaaacacagtcactctgaatctctcaaacacaggcttctatttcctacttcttttgcttctacttaggttttctgtctccaagaatgaaattatccttcaacattctaatcaaatgctagcttactttagcgccagcttttctcagtctgagatatgttcttccaaacaatcatgattcctggttcttagatccatggcccatttacctggctctcctatttcatttacctttctctgtgggtttcccagttcaccaaatcataagtatctatgaatagagagctccttagagcatggctactgataaatcattcactgagttgactaaatccaggcagtatgacatcaatcatttcagaggcaatatgatgaaaatatttcaaacaattattatttattcttgtttttatcttgtaaacatggcataaatcagattttgatgaccaatggtcagtgatggttttttttggttatttttcttcccaaaacagcataaaatttttactttaaacaattacaatatgtatgtatatactttattgaatttttggtgacatttttaaaaactgagagaaacactgttatttttatccacattatgagatggaaagccctggggtccattatgagtgacatgcttgcctaatgttttgcaagatctggcttcaaggcactcttagataatgtctagtttattttccactctaattcaccctttccaagatttactctgtatttgatataaaaaatcttagttcttctccattttcctgtccttaagacaccttaacaaattgacattaggctttaaaaactatacattaatacaggccaaatgtggtcgacaatttgattggctagcccacagtcttttccaaacttcttcatccttgctatctttattaaaaagaccagaaaaccaaatgttaacttccatctttctgcactcaagatgaccatgtgtcatagttctggctaaagggctgtaagctctggggaagggctttgtgtttcttataagtggggtagatacaactttagctggccatcctctctcatccttcctccttccctctcactatctgtgacacagacatgatcatctggacgtgcagtagccatttgccatcaagaggaacaggccaagaaaattgtggagatgctgcctctttgcaaatggtgataacatcatgcaacagctgaaacacctccggtgccacctacttaaaagtaattcctatttgttcaagctattgtgagtccaggtttctgttatttacaattgaaagcattgaaaactgatataccaagcatatctgttggcagtttgagttttcctcaaaggaaaactcttttgtagccatagaacatactctataatcaaaatccagttacaaatccgcgaatccagttctctaggtcaaaaggaggcaaaagagaatgagttggctgttttcactataaatcactcaccactaaggggatctctgttatcttcttttttttaatatgaagggcagcatttttcttttccctcagggattgttattaactattttctggatatatcgagaagggggaagttacattaaaaattagacagaaaggggagacttttcacttaaagttgtgacaaccttcacttaaagttattgtaacatgcttcttgggaaggaagaaggcataggatggcatagcatgtcaaggtccatctgctttcttttgattttccctgtgcagaatacctcataactgtgatccatagttggcaagaatcccattcatttccaacagaaatccaggaagcttagtgtgtctctctccagttcattatcagagcaattaaaatcagcagttttaatgctgcttaaagggcttcagattttgtaatttatgtagcctaaggcaagattcattttttatggagagattttgattccatcctaaagagttctaattaaagactccttggggagtttttcttgatctgctggatttaagattctttagtaaataacctgctaagattatttctggtggggataatttatctttaattttcatatcctaattatatttcatacatatcttgaaacccaggtcagtaatctcattaagtaaatataaaatagtatataatatactataataaaaatgatgcattgttaaaagatgtatgcaaatctttaaacctgcaggtcttgtttatgaggatccaaagctgaaaagtctttactgctacttatttgaataatagctaccttcatatgcttaatgttaagttatagggttttcttttaggtactaagtttcctcataaaaggcatacaatcattatatctctgagtgtttttaaatttaatagtttttttaaattggagtctgatagcctttataggattggccacttgtttgataatatcagtgctaagggaagaaattaggggaaaaaagttggaagagaggatccagtggagttttttttttttttttttttttttttttggagatggagcctagctctgtcacccaggctggagtgcaatggcatgatcttggctcactgcaacctctgcctcctgagttcaagcaattttcctgcctcagcctccctagtagctgggactacaggaacctgccattatgcctggctaatttttgtatttttatagagatggggtttcaccaccttggtcaggctggtctcaaactcctgacctcaggtgatctgcccgcctcagcctcccaaagtgctaggattacaggtgtgaggcactgtgcccggttgatctagtgaattttatttgaagttgtgtttgtagtgtaagcatgttgattatacgtatttagcttttatgttagttgtgagtatgtacactgggaaaactagtgcctcccaaccaacccttggtaccaccattgttttacttaggtttgtagagaaagcaaaaccatattaatattggaacagaacttgaagcgggtcttctcctcacctccccattcctaaaaaaaaaaatcatttttatattctataaattaattacattctgtgtgtctcttccatggaagagatcaacctaataagaataacagaaatcatctaatccttcccatttcttcttgaaatgttactggtacatatgtttttccttttcctgaaacccatttgcctctgcttttcacttggctaattcctattcactcctcatttttcagcttatacactacttccttccagcagccttgatttcccatccatcatattaattggttctctcctttcctgggatctttacttcttcaatgcattttatctaattatgcatttaatcatgggctgatatgtttaatgtttttcttcgctattcctttggaaggctcatgacagcaggaaccatgtcggtatgtttaccactgtgacctcagagcacagtccagtcctggcatagtataggtgctcaataaatactagtagtgaagatctcagattgctttcctgtgcccagagcatgggaaccaactccaagaagcaatagcaataggagacttctgacagtaaaatctccattttgcagaggaaacagctatgaaggcagaaagtgcccataactcaggaaaagggaggatggcaaagaactgcatctatttcacagtcttgctcagggtcatggctgtggttatcaatctttgcctctaaaaatacatagtttttgcccctatgggtggtcactgcttagtcactgcaatggatttgaactacacaacctacatttatcacttttacccatttaagaccaacttaaaggcaaaaagaagtaaaagaatgatgaagactttttttttaagattctgcagtaccttcataagtgtctccctctcagggatgaagtaagaattgctcctttaaaaagtgtctttctgtgaaaggaccggaaaattcctaaagatagaaactaaaaagctagatggcagcagactgcctttcatgtccctatcaatgaatagattgctaactaacaatcaggggcattgttcatatcaataatataaatagttcaaaagactccagaaataagttcctaaggcactcccagccatttggaataactatggcttggaaattttcccatctttgtaattttgcaaaaaatgatctagactagaggtctataactatattcagatgattcctattcataaactgagaataaagaacagaccaacttcagtaacagtgacattgctgggagaataaattggctcaagaagtaacaacagcagcaaaacggttaaggcacttcaaggtaatcaatttagctctatcgctttttgctgtgactctgaaggaagttaattgaatctctgaaagtagtatcttgctgcctggaattggtacccacaagcttcaaataaactattccatgaagtttaagctgtccttgacagaaagaagggcacaatcagctccaagccattagggaaggtataatttcacaaggcaagacagccaaggaaagtgatcctcaaagggaaactttcgtagaaaaaattttgtactttcctgtccccatccatcagtaacctcaacagagctatttttggattgtttccctttattcctattgatgactattattatatttttgaaaatgtttttgttaatgttgttagaaactggtaggttaatgaaactttagccatggttgttgttgttagaagcaggtgtaattaataaaagtttagctgtgaaggccaggcatctcagggttcaaactttagcttattgactactttttaagctatgcaacccttagcaaactgcttactcacatgacctctgttctcacagctgctaacagaagtggtggcagtgataataatgttgagaattgttttgaggtataaccaaattaccatggaaaatgcctagcaaaagtccaggcttatagtatgagctaattaatatatcaaaatctcattcctttctttttttggctttcctttcttctacggccttctccatcttccaagacccagccttagtagcagatgatgacttgggtctcctgcctaccaagaagcccagtgcgctggcttcctgacacaagacatagccctgttagggagtcaggaatctatttactcaatgttcagttcatattagaatgcaaatgctcttgcaaataaaaaacattaactcatgtctaattgcttatctacactttcagcacttcttcatttttttaaaattttactgtgagcaggctctaaaaagagaatatagcaagaacaaaggttttggctttgatgaggaaaagtgtgtggagagaacacaaaaagaggagaaggatgaaggaagaagacaggaaggtctcaaaacctgagctcctgcagcagtcactccactgaactagcccattctgagcttgtccagttcttttgtaaaccaagcttgcatgcttcttaaattgtcaatggttagcttttcatggttcttaaaaaacttaaatttttaatgatgctggtataagtgaaaggcattcataagttcccccccccccaccttttttttttttttgacacggagtctcgctgtcgcccaggctggagggcagtggtgtgatctcggctcactgcaggctccgtcccccggggttcacgccattctcctgcgtcagcctaagttcccctttttaataatgaaggtcataaataggagcagtcaacagctaacatttttgcagtatttaccatgcagtagacactgtgctgggcactgtacatgattatctcacttaatccccacaaagccttatgagctattattattatttcaatttacagataaggacactaaacagagagagaatatacagctaccaagtggcagaatcagctaataggccatgtgttgatatgttctgattgcagagtttgatgcctctcctgggtgaactcaataggaccagaacacagttctactagaacatctggtatgatttcacaatgtcacgttgtttttgcctttgaagtgaattggggtattctgaatgggcatggggacattttaagaggtcatggggcacgagattaaacctacaaatgtcatgggagcctctccatcttgtgaaccctcttactaaccaccttcattcccatttaggcttttacaaaacacatgactgtaaactgattttctttggtagaagagaggaatgttgtggagaaaacacttgaaaaagttcataggttaaaaaaacacaagaactacttgtttcatacatggttttatgtaaatgtcaaagataacctctcaaatattctttaagtttccactaatatgtgatatcccaaaaatgttgcctcccgtgataatatcttgcattcttctgttattccatgaagcatatcttacttggttctcacagccaacaatcaactgaggtaataaggaaagataaccatagccctgctttatagaggcaaaagtgggatctcatgctatatggcacagcagaaacagaatctcaaactagtatttaggcccctagtcccagccaataacaagtttcattagcgcaaaagttctttacctacacacagtctatggctttcttggtgaaaatagtattcttggtgaactgaattttgcacaggaaacaatggactcagcatctcatattcttgtttagtgtatcttaggaatcatgtgcatgtccagtctaaagcagcaggttgtctaaagagtgttcggctaggcagtgccgaaagactgcacgtcattagcttttgaaagtcattaccattaagtccatgtccctaaattgtttctttctgtgaggaaggcagaggatcatatttgaatccaagatcatcgaagtatggtagacatgaaaggcgtgtggttagggcactagcagaactcaagagcaagtatgcactttccaagttcccagggggcaggctgatggcagaaatgtctaatttgaacaaaactgctaaataacttgcttttttacttaaattcctacaaaaatttcccactgctatagcaactattaatgaaagtctgtttttatgcttctcgatgacatttttagcataatttagagaaaaaacctcagaaaataaaaaaagtaattgtaagacatatgttatgaaaatatcttatgaaatatgttatgaaacttttgttcattatgtaaccagtgccaaatttgcaaccatttaggtctctgatggtgataacttatttatcttgtcattacttttccaaatcccaagtcctacagaactgtagcttcaactagaagccaagccctacctttgtcctacacaaaaagagacctagactgtgagcagcctcgctacagatttctttgactccctttggatcacacactatgaatataagaataaccaagacatgcatccaagtttatttttaaattctagttttgctttttctgatgtagcaaaaagtgagttatctgagcatcaaattacatattttcctgaaatattttatattttctcaaagccattttccttagtaactaataatgagagatgatagaaggcaatttaaggcatctcagcatttccaaatagcattctgtctaaggttagtttcagcatgcaactggtgataaatggcatatagatgcatgtgcaggggaggaggtgttctgtggcaaaagaagtttgagaaaaagattttaaaaagttaaacagttttttagcaattctcagtgcctttaatatgcaaatcaatgaatcatgtttaagacggtaacgatacatgcaacatttcttaaaatgatttaagtatagaaccattatttgcagagcagttgcagggaccagtgttccatgggcacacgttcggtcatgtgggctcaggagtcacacagacctgaattcctattacagctcagaggagctgtgcgtccttgagagaatgattgaagcacatggtaaatgttggtgtcttagcctcagtctcttgaggttaacaaaaggtcactgaattcaaaaatactaagaaaactacattatattcttgacattcaaatgcatcttcacaaatcccctaattcactaatatcactctagcatttacttttcccctagaaaaatttagtgggtttttttgttgttttgttttgttttgtttaaaaaaaaaaaagcaattctcattggtgcattaatccctgttgctttacaggaatgtgttcagtcttctcaccctctctggaatctcattttcatcaacagcccctatttgctaatgttttaattctctcttgatgagcacttttgcattgactggcacactctacagaaagttccaattttttttccctagaaacaagcacagagtgaactacgatggacttgctcataaaatttgatctcatttatcactttaaattttatccttttaaagaattaataattttcttagctgtttttgcgtagtgtctactgtctagatcaacgctgttcagtagaaacataatgtgaaccatgaatgatggccacaacatgtaattttaaatttttaaaaagccatattacaaaaagttatttttacaaccaggtgaaattaatgtatttactttttacttttgtgggtacatagtaggtatatttatggggtacatgagatattttgatataaggcatacaatgcctaataatcacatcagggtaaatgaggtatccatcacctcaataatttatcctttgtgttacaaacaatccaattatactctttaattaaaaaatgtacaataaattattgtgactgcaatcagtcttttgtgctatcaaatactagatcttaatcattctatctaaatatatttttgtacccattaaccatctccactcccacacccctgccactcactacccttcctaggttctgataaccatctttccactctatctccatgagatcaattgtcttcatttttacctcccacaaatgagaacatacaaagtttgtctttctgtgtgtggcttatttcacttaatataatgacctccagttccatccatattgttgcagatgacaggatctcattcctttttgtggctgaatagtactccattgtgtgtatgtaccatattttctttatccgttaattggctgatggacacttagatacaaccaggtgaaattaatttaaatatgttttatttaaccctatacacagtattagtatttaaacatgtaatcattatgaaaattacaaatgagaaaatttttactttttttcacactattatttgaaatcctttgtgcatgttacattaccagcacatctgatttggattagccacagctcaagtgctctatggctactagctctcttgttggacagcacaggcctagattagcagtcagcttccttctgggtggcatttttctacacaggtacaatgtgtttatcagttcagagttattacatttgcaagggagggtagagaataatgaaattatattgtgatttgaatacttggtggtgcatgggtcccttcaatagtttggtaacttaaatccacacgagagctccgttgtactttggatcaaattactccctgtcatgaagcatcagagtcccttataatagtccacaccacaaaagccaagggatttttgtaattgttttacaagtaggaaaagcaataacagtgatttgaaatttttacaaagttaaattctgtaaatatatgttgaatacaaattgtgtacttgacacttggctagttcttaacactgaaagttttttagatatgagacatccaattttcttggcaaaggtatgtatgtatatataatgcgtatgcaaacacacacataatatatccatatatatccaaaatacatatatatgcatgtatgtatgcatggcgtaactcctatctattttacagggtcacttggttggtgattatttccttcttttcctttgaatcatgggcactatagaaaagcataaaatcagtcttgtttcataaattaatttttctattcaaacttgcacttatctttgatggaaagaaatgtatagcctattcttgtgaataacgctagctgatgtgagctgactgtttactctatgccaggcgctagtttaacggctatatatgtattatctcatttaatacttgaataactctaatgatgtaggcgcagaggcacctgaaacagagcacacttaaggaatttcataaatgtcatacaagctgcaagtggaagagccatgatttgaactcaggaatttctgctcaatcatgaagtgaactactcactttaaatgcatagtattctaacactctctttttagataatgatttgttagctaacctgaattaggtccttaaaagcaattctcaaattatgattttacatatctttgaaggtcttaacggaaaggaactttgtaaagatagttttatacttagcataacctctcattttattttccttcaagacaaatccatgaaaaaattcagcttcattccttatctctgacaaataccagaatgcacaacacatggtgcctctgatctgtatcgtttcccctagcgcttgcattcatctttgatgttgatattttgtggtctagtggctcttgagagaagacaattacctatctcctttgaaccataaattaccatatttggagttgcttcttcatataatttttactagtcctttttatttctctcatatataaattgaaatgttgaaatgatgagatctatttttaaagtacataaattttggggaggaatgggacagagtttaaattgttgacaattatacataaaccagctgaatcaactgggcaagtaaacatgggcaagtaaactgggcaagtaaaccttcagtttcacattaatccatttgtgtgtaggcatcagggaggtctcattcttgtaaccccagaatataaaatataaagtcagaagtagtcttcattttcacacccctcctcttttcaaaaaattcatttaaaaatatttaactgacaaacattgcatacatttatagtgcgcaagatgatgttctgaaatacgtacacattacggaagagctaaatcaagctaattaacatatgcattaactcacatacttttttgtggtgagaacatttaaaatctactctcttagaaattttcttttttttttttggttttgttattatttaaagttcagggatatatgtgcaggtttgttacaatggtaaattcgtgtcatgggggtattaagcctagtatccattagttatttttcctgattctctcccttctcccaccctcccctctctggtatgctcctgtgtctgttgttcccccctatgtatccatgtggtctcattatttaggtcacacttataagtgaccacatataatatttggtttacaatacattgttcttaatgatagtcaccatgttgtacagtagatctcttgaacttattcctcttgtctaactgaaattttatatcctctgaccaccatttccccaatccctcctgttcccatcaccccctggtaacccccttctattatctgcctctgtgagtttgacttttttagattccacatagaagtgagatcatatacatctctccttttgcttatacttactagctttcagccagaagaacaatgttagcaaaagggtcacttttgaaagctgaccaacccctggttaaaacaacatatatcagaatgtacagcataaagtttaaggcttcataagtctagcagattatatactcaatatacatttgttggatgaattattgaattggatataagttcacagggacattgagctattctttgatatttcctgggcttggtgttgatttcatgaatgcatgcttgatgtatgaagaaatatttaggcacatatcttggatcatttacaattttctcatacctccataatgttatttctgtaagcttaaaaggatattgtaatatacagtccatacactcaatttcgaatgagaaggttgaggacccatgaagttaaggtaacttgtccattgttgtttaatgagccaagacaaaagtggaaatctagttcagccggctgctgcccttccatgcaaaaactggtataggtcatattatgattaccatttgaatgcaacctaacaaaatgttgtggtctgagacttcatttatgataataatgaaaatttatattaaaagcaagaaattacattttgcgtggtggattacacagtacatagcacataaatgaaatctggaattggatttgaatatttaaaagtacattatgccttcatacaagatactaaacgttttatgggggaagaggtttttcacaagggttataataaaaatactttttatctatgtagttgttccttagcagttcctcagtagttcttagtataaccaagaaatactaaaagatgtattggcccatgccttcccctttccccaaagtttactgtcataatggtaaagggtgagcgaaaaatgcttgaaaagcagcccatgatcactgaatgattccatttttagcacaagcttcatgatatgaatcgagtgactcttacgtaaaaattacatactttttctttttttcagagatgaggtctcactctgttgcccaggctggagtacactcctgtgatcacattcactgcagccttgacctcccaggctcaagcaatcctccctcagcccccagagtagctgagactacaggcaggcaccatcacaccctactaatttttaaattttttgtagaaatggggtctcactctgtagcacaggctggtgtcaaactcttggactcaggcgatcctcccacctcaccctcccaaagcactaggattatagggtaaaccactgtgccccacctcgtatgctttttcaaatttcacgatgtgaagtatctgtctggtaataaagtgatatattgtttcacatcatgaaacccttagaatacgtttgatattgctctaatgtttacttatgttccctcatatgccacaaagtagagagccttaagattggattttgaaagctttaagaaatgggacccacagttatcacacatactaaatttttcctgacatcatctaataattaatgatcacattttgacatggtacaaactgaaccaggtcaacaaactttatatgccagaagccggattgatatcatcaatcagttatggggagctttggagatgacataaaaatgaggaatatatattaccggaatcttaacattaaaaagacataatgactataatgacaaaaaagaaagaaaataaagggaaaaaaaccttctttaaatgcatgggtaaacaaaatcttgaaaaagcaatacacatttattttagcgtgacttacactgcctatgcatttactagtgtttttcaacaggttaaggtggtttaggaaaagtccaaaacatattttccaagaaataatgtacgggaaggaaaacctgatttaaagtgagcacgggatatatagcaagaactcaaagtacgacatggaaattttaaaacagaataaaagattatttattggtttttgctaacaatgattactattggtttgaaaaatgaatctggataaaatgtagaataacatcacatatttaagctgcatatggatcaaacagggaaaactctatttctgcatatcagatcgtttcttattttagtcacttaattcacagttacatagtattcatcatgaggagaaacagacagagtgtgaatggctcactgttacccacactattcctggaaaaacaggtcctaaagattaaaagactcaactgcataaataaaaggcatgatgacattgttattacaggcaaacattttttaagatgccatcactgaaaatggatgacctatactttggtaagaatgcagagaactgaaacatcactttgggggcgacataaatgtggcaaccagtatagaaacacatttggcaatatctaaagacaaaggcataacctatgacccagaaatcctacctcttgggatatacccaacctacgtgtatgcacaaaacactgcaacactacatgtacatttgtttactaagtgatatatccaataatgttcataatggctctaattcataatggcctaaaactggaatacttaactatccatcaacactagaataagtaaattgtagcatattcatttggtgcaatactaacaaaatgagaataaagaatgcacaaaacactatgaatgaatcccataaacacaatattgactgaaataaaataagagtttatattgtataatttcattcatataaaattcaaaagtagtcaaatctatgctattggaagtcagttagtggttatcttcgggtgcatagtgactggaaagaagaataaaggggtccccttgggagctggtaatattttgattttgacctagatgttggttatatgagtaaatatggctaagcatttttttctctcttactggcacattcacacccatcattttataccaaatagatccttgcagagtgctaagggttatctataaatagcaaagaaagagaatcctttccattttaaccaacatgaggaaggcaagactgcgagacttttttttttaagtcatgtagtgctaaaacaaacaataagccttttaaattcactccaaaatacaggataatttgtttcccccaccgataataatttcttctttccctttcttggcattttggtgtgtcagatctccctaaggtttatgttgtctcagtttacacggatttgctttaggaaaaaaacctgacgttccttgtatgagtatctcatccaaggggttgaaaagcagcgcatacaacagaagttgcacaaagccgtccttgtcatcttccacacaggaggacagagaacaaaaacgtcccaaccagtgagtggcagtgccactgaggacctcctgaacaactctactcaaagcattttgaactttataccaagaaactgaggaaagttaggagggaaaatatatagtccttttctagaaccagtaagatgtgagataaacaattatttgagcgatgaaatgttttcatcttttagttcatctgagatcagggcagtgatacttcatagaacccacaaataaaagcttttcgtcaggtacaacctgaagatggcagaaggagttttgttgcttgtttttttcctccactaaagtggccactctttcactagagaatgtactaacgtcatcaaattaatgtgattcttaaacaggacataaatcttccctttggatgggaacacaaatctgattcattaactttccattctttatctaaacactgccattatgtgaaaagaaaaattcctgaaaatcaaggatattttgcagttaaatccctcctcccagccagtctattttgttaccctatataaacaaactctgccattacattcctttatccatagcaacttccagtgggtaatccacaaatcaattaaaggcaagttaattgccaaaaagggatcaagtgacaagcattggaagcatatttatgggtgctattctcaaaatctgtgtgtcagaaaagtttcgtccagctagctttccttttaatgcaagatttaaaatttgtattatttctttgaaaataaaaaattaatctcacagttattcttagcttaaggtgtttatgttttgtaggcagacacagacacatatttcaaacaaaacaaggttcctactataggactattactactgctaccgatttttaacttccatttttctttgctttagtattttctacgtataaaaagttttgagatagtgtgaaacaatgtaatagaaagtatattgtaaactgctcctcttccccctacatcttcttttcatcttcctccttgttttactttccctcactgtatttttataataacaaagaagcaaaggtaaattcactcaagagactggagactgaaaacaagtcagtaatgaggtcaatatttatatggttccattgaccttgtgcagttctgagtttcaggcctagaactacaaatgtactcacagatgtatggaatggatatgcttgaacttatatgcaaataaattatcaatttctttgtaaaggtttccctggcttccccaagcagaacctctcatctcagtctctatttattttatttattgttaacttgtttattttctgtctttctctaccagaatgtaaacttgatgaaagcagagaccgcatccattttgtccctcactacattctgttacatttttaggagtatttataagtcagttgttaatacccaacagttattaaaaattaaattacataaaaatttttaactataattaaacaaattatattaaaaacaatggaaataagtattcaaaactcataacttctgaatgatttggctacattttgtattattatgtttttggggcaacttatatctactgtatctatatgatagaaacactgtatagagtactatgtctatgtatctcttgccaactccacatttagtgacctctgctgtttgaaatgggcaggtgagagaattttttggcacagaaatcagcaaatactacaaatagtgcccttcccctcccccatagagagctggttgtgaacatttaccacctgaaggaataatcttttacattctgttctgttcatttttgaatgtttaattcattgtcataacaattttagggttttgtttttatagagtttatttctttagctcaacacaaagcttatctttttaaagcttcacttcaaagctttttttttttttttggaatgtggcttacatacttgtcccctttgaactgtcctttgcatttgattggcttaacataattacagtaatatatatttactctattcacaatccatctttcctctttatcattttagtttttctcttccaaatttacactattaccagctaatgaattatataatttgagccatgtgccatggctcatgcctgtaatcccagcactttaggaggctgaggtgggaggataacttgaggccaagtatttgagacaaacccgggcaaaacagactctaaaatatatattttttaagccaggaatggtagggtgcacctgtagtcctagctacccaggaggctgtggctggaggatcccttgagcctaggagtttgaggctgcaatgagtgatgatcatgccactgtactccagcctagatgacagagtgagaccctgcctctaaaataagtaaataaaataatacattcagacaagttttaaagtagcatatagtattcttcctttgccaatggatttttcctttgctctgattcaactctgtgtgcttatataacccagccttacggaaaatcagacacctctcttcagacccttgttgaaattaaaaaggcttgtcaattatagtttgaaagtagaaaaaataatggaagttaggaggagggagagccaaggtagaaggtgggtatatgactgtggcaaagaacatgatagaagctgaggcctccagaacaaggagtaccaaggtaaagtgtatagaattgaatgcttcctcttttgtaagaagtattccttatttgctctgcccagatcagacaggctttgatccagctgctcagtcaaggtactgtctcttaaaatcacttgatgggggctcatccacttcatgacttaaggacaaatggcactcgttgaaaatcataaaatcaacattatgaaaataaatagtataaattttataaactactaattaagcataaatattcatacctattacccattcaaaaatggtatagttttaactatagtgaaaaccattaacacactgatgatcagaaatatccacagcatgattataaacccttggcagtttggagtgtcttttcttcttttgtcaccttgatttttttgtacatctcctggcattccacatttgccagagctctgtgctggtccgtagcctgcaggccaccttataaaaccaatacctttatatttattgcagagtttgtaatctttctgcctgtggttgttccatgtgctgtcatgataatacagaaaacactcaaactgtatctcccctctctatctctgtttctagtctacattgataattgagcagattcttttgaatgtttgagatggggctttccttcaattttgaaaaaaatgcatataatgcattctacaaaaatgttgtttacaaagtggtacttccttacaaaaaccctattgtagctgttgtagcaagtgatttttagacttgtaagtaaaatgtctgaacataattttacttggataagtctttctcttattcagaaacctgtccttccatggtcattgcccaattatggctcttatacactctcctgtctgcaagaagtgtgctctgaatcattcattcattttgctgccttactgaaagcactgaattagatggcatatgtattgaagtgaggggtgggacattggaacaaagattttcacagaagcacacagagccagggttctagctctgaccaggccgctatcaagttgcatgaccctggggcctttcaaggtcttcaagctcttcaatgtaagacaaatgagtttgaacaaatgaaccatcaggttccttcagctctaaccccctcttcccatgaatgtggcaaaaggaagcagagtatcctcacacttgccatgaatcggaacacatttgctaataggttcattcattcaatacacaaacgccaagcacctaatatgtaccacacactcttccaggcactggccatacaaaggtggaaaaaaggacaaaaattgctgccatgtggagcttacattctattattaataatagctgacatttattttagtgttgtctatgtgccaggcactttacatggctaacacacttaatcctcataatactccattttacaaatgaggaaactgaggcacatgaagtaacttgcccaaagtctcatagctataagtgataatgtgaaaatgtgaacctcagcagcagtgtggctgtagagctagccagctgtcaatcattcctgcacactacatttccaaggtgagcctgggttgtatgtgcaagttgcttataaggtaaccatttataagccagctctattgtactattctgtgaccaagagtggtaccaatgatgatagtttatctgaaaatgtatttcacaaaagaagcttcacaaaatttgtgaaatgttagtgaagacttggaaaatgctatgaaagagttggcaggtagtcctgcattcacgtacatgctttcatctaatctgcacaacgaccttatgaagtagatattttaattttctatttatgtacatggaaatggctcagagaggttaggaaacctgcccaatcaagaaagcagcagagttggcactgaagctgggtctgtttggctctagagccaaagttctcctcctataccatgctacctcttcctacaatgtgcaatggttgttagtagtattgttattcttagatataaatgttgtctataatttctttttgtcaatttagccaacattactcacaatttgaaatatcattaagaaacctagtttaatagtcaagactatgccagtagaataaatagacatgacacaggatggagttgacctctcgagctcagagaatcttctggctcctctgaacagctggccaaggagtaatatttggcagtaaaatacaaccacatgaccaatgtttttggccagatgaaatgagccagatggaagcccatgaagcaaaagccaggagggggcagaagcagacaatataaaataacggattcattttcctttttcttctttttaatataaaaatacctctattttgatgcttttgcttagcatttctttaaaccaacatcaattaggttagaggacagtttagatattatttaacaagtttatattttaactgattactaagccctattctataacaaattacgtggtgttctgtcttcagagaaaaattcagagttaagtagaggaagatagtacatctgttagaacaatacctctcattatggaatttttttccttgtgtgctgataataggatctggtgaggaagctggaggtgggagagggaccaggagtcctggttctaacacagacttccagaattcacacctgtgcaggtttcttaaacttgctctgcctggtttcctcatttgtaagataaaggtaatgctagatccacctcccgaggctgttttggaggatgacatgcatgagctaatgcatgtatgggattgggaatggttcctggtgcatagtaagtgtccaatacaaactagctctactgttcttactttggactttctaaccacatatatgtgtggtctctagtccctgaaccttcaattcttcttctcttatttgatactaattacactcatctttttcacttaccctaaagaattaagtgagatgagctgtggcacactaaaaacaacagctgtcacatctgttacatctgaaaagctttgaaaactaaaaagtgctatgcaacaggaggtattcttggggtatgcagaaagttacatcccagtgtattgattcactggtggcattcacttcctttctaagatgtgggtttgagacagctttttctaatgggaattgtgcagtttggttgggcaatcactgatgtgctaccactcaggttttggtagtagcaaagagtagctatgagaccacactctcctatgatccctgttcatatcagctactatacaatttccagatcaaagttgtagatttggtctttacttcctaataatataggaggtaatttagggatatctagatcttcttgtttgggcaaatattgctttatcttttcatagcccagataccatttgtacttttgtttgttgatctgactgtcattaatccttccttctactgttcagtctatgtcatatcaaataaatttactcattagaccttctacacgaggtacaagcatgcacatatgtatttaattaatcacctgtttggcagctctgctaaaatgctgggaaggaaaagatgttgaaacaattggcaaaaatgagatttggagattttctgagaatttctatcccatgacccctattactataaagggcaagaaaactagaagacactttctgtttctggcctgtggaatgctatggaataatctctgccctacattcaaatgtaccttgagtgactttctcttctatttacatagtacctaccccaaacttgtcacataaaatgttccttttaacatccttgtgatttgttctctttggaagacagaatcatctcaagaagagtaattttctatttaaagtttccttgaacactactgtagttttaagcaataatatattttaaatcacaaaattccctagtgttctcttattggagttgtcagggtccacaggcttgctaaatctttgctccttgattctttctttacttcccagatcgtttttccccatttttttttttttaggtactatgtttaaacaaccaatataaacttctccacattgttttcttgagcacatcattctcctctttcttctctataatacttgggaggggcgttgctctaaagtaattaggtgaatctttaaacatgtgtgccagaacctaggcagataaatcagcaccttgccctcaaaattagtactcatctttgtaagtggtgccctaatgctaacactgatcccattactgaaaacatggttggcaatctcttctgggctcacagagaaaaagtaccttccttattatgtaaccctctgctttctctctttttctcttcctcactcctccttccacggccctgctcccctcctctcccctgcctttccttccctctccctcttcttttctctttcaatccttctttctgcctcaatcaaacttaataagctatatattaatcttttcttataaaaatgtattttacccacataagataaaaaattgtcacagctgaaaaactttcacatctattttgagcattgtaaaactgtttcagattgtatttctcaagagtcaacactcattaaatgtatatgatttgctattactttaacaaatcagacactaattgaatttcatatcttgtacacctggctttcctttagcctgaatattaccaggcagcaaaagccatgccaaggaaaaatattccagttaaagctaagtgtacccccagtagcatgcattattatccattcaatagccaaagaaaaatgacactacaataggcacatttgaagattttacaagataaaaaatattgctcataaaaaaaattataagggagaaattcaatgaagaaatgttgtccaatgtccagttctttcagttgcttcaataatggaatcagatccaaagcctcttaaaggtcaagataagcttaagttactttcaccgcgtaaggattttgtatattttttaaaaaataagaaatgcaaaaacaaggctgtgacattatgagatattttacatgtttacatcaaatagtttaacacctttaattccaagaatgctatgcaataaaactatgctcttcagaagataattatagcatttaactgtgcgtgcatgtgcctgtgtgtggtgtgtatatgtgtctgtatatatatagagtgactcatggtgcatttgaggtattatggtatgataaaaattttaagttatatgatatgtaccttttttcattattgtcagtacattgtcgtggctgaatgcgtaatctcctttggatacatgagggacctgcagaaatgcaagagccagtggccaactgccttcctacctccctaacccttccactcaattcaacttatgatagatatgatcatatcaagttggctatgccaataaaacattatcgggtgatgccaaataagaaagggtaacagaatactttatcaaataggcattactggcatttttgctgtatgtaaggaaacttctaacctcaaagagtttgcagtgcaactggaaagataaactagaacctccaaacagtgaaagcagcacatataaaaaaattaattattctgtgggaaattgtatattcaaattaagaggaagtaaaggaaggactgagcctctcaagcttccgaaggaaactgactcatgatggatatttgagatgtcattctcacctcttaaacttgttacaaatgaaacttgttaaaattacagatgtgaggtattcaaatacatgaaaaagtcattcttagctgctaatgcttatattttggaaagggtcagaacttgaccaaaggaaccttgaaaaaatatatttatcatatagctttaaattgttacaataccataacacctcaaaataaaaatatctttgccaaattgagaaggcaaggtttataatatatttgcaaactacacagaagagcttaaactctgcatttcgtgagatttctcaaattcattagtcaatcaagctattgcttttactttattcagcagctggagatttatgatattaaggagcttgttatcagatctagtgatgaagagagcctagaagccaccatatgttggaaatatgcacagtaatgttagcaaatcattgatgttaagttctaaatgtacaatttagcatacaataagcatgagaatcacatttaacaaaatgcaaagcacataggaagcatataatttaaaattttcaactaaattttatagctgtaacaaacataacaaataaatcattattttattttgaaataaaaataaatggagttaatacctatacctttagctggcaaattatatttacctcttgccaaagtttgcttatgcattgttatacaaaatttttaaatttgatttctctgattttatagttccctaaaaattccaaggacattatcttctttagtgtctaaagcaaataattaatccttataaattattttaattcaaactttgaatgttttatatgcaggcaaatcagaacacattttaattcagtgttaatatatatttctacataggcttggcagcttccagatgtgctgcatttggtctaaataagaaagaccttatatccaaaattttgcaaacaatgtcacttctatttactattgattaaatagatacctttcagtgctatagattgtaatcaatcaaaaacagaaaaggttttctttctaaacaataataaagaataatcaatcttctctttattaacacctagaatactcaaatgaagaaggaaatccaatattttttaagtgttttctttctttccagttatttggttaaaataagctgattttgttgtaaaacagtcattgacagtttagtgaagtcatgaggtcaagatttttaatatgacttccagaaacaaaagattattaaaatatttagtttgaattcatgacatgtaattctgctgggcaagatgaacactgaattactacctgaaacagcattagtttccattttttcatgtgcatgtgccctgaaacacttatgaagaataatgtagtgttttttttgttggtcaaacaagaacccttccctaacatttagagttgactgtattaagccattagacaagttaatacactgtttttcaggtggcagtaatatgaatgctttgttaagtttgccatttaactctcagaattagcttttaaagttagtcaacttccttcaacttctgcacgtacctacatacccctatttcaaggtttacatcatcttcttggctcttatttaatatattgtcaatttaacaagcattaggagttagaaggtcaacatagggcaaaggcttatttgcaaggggcctaaggcagttaaacaattcttcctagctacaaaaggaaaagagtaatacctgtaggactttgagaaacgcaatcttgatttggctcttgtagatggtcctggcaccgtggctcccagaggatcccaaacaaaagccatttttaaggacgatgccaagatccccaggaaccacgagaagtcagagctggtgcgg

SEQ ID NO: 269 - DNA, 86346 bp, Homo sapiens
tcccatttttttaaacgtttattacttcaagagtgaattatttttcaaagatgataaaactcatttctattccagtagaaaagggtcacaggtttgccccagggtccaggagcgcccggaaggcagggcccccaggcctcttcacctcagcctgggcacctataatctgagggaccctgtgagggggtgggggcagctcgggggcacagcctgcggccacttcggccagagagtggccggctcagtccataggatgatgtcagtttaggctggaggaaaagggcgccagacaacccgatgcagtgcctgtgaagacttcggggggatcaaagtccggccggggtgggcggagaccctcgggcagctgcacagggcatcttgtgctcactccattgttttccgaggcctgtgtaaaggcgctttgcctggcctggcaggtagaccaaggccaaagctcgtggccagggcctgggcactgagtccccactgaatttggcacaggaaggcggcactcccagcctggcccgtcctgcatggggagccaccacaccgggactgcagtgtttcaccttggaggggaggaagcctgggcccaacggctgaacgggacaggccaggctcacccgaggaaggggacgcaggacccacagcccctgtggtcaggcctgtgggccacgtggagagaaggttccagaacagtgcttgttgacgagcctctccctacaagtcccttcagcagcagctccatccctgagtgtctgcacaagcctgcacgcatgtgtgtatgtgtgccagggcgtgtgtgcaggtgtgcaacaggcacatggcagctgggaggctcaggctgtggggctggggggctgtccgctgggagagtccgggagaagcggggtgtaggggctggggggccggtcaggcccagcggccaggcctggctggctcacggtgtcctcaggaccctgtggagaaaggcaaagctgggtgaccacccacgccctgtcaccaaaccccaccctcatccccgcccaccacagccctgtacccacatccccagcagagactccacccccgccaccaggctgtcagaagtgagaagagactggagtcacctatagactcctggaatgactccaagggcctcttcatctcactcaacacccgcctggcctccccgacctcctttagagatggagaaactgaggcccaaagagacttaatacagtgaggggcagagcaaggggggcggcctgtgtgcagcacagtcaacatggaacaaccggggcaagctctgtccctcaggaggagaacgtatgtttatgtgttgatttattttttattttttagagacggtctctctctgtcgcccaggctggagtacggtggtgccatcatggctcaccacggccttgaactcctgggctcaagtgatcctcccacctcggcctcccaagtggccgggacaatgacacgtgccaccaccacgcccggctcattttttaattttttgtagagatcaggtctatgttgcccaggctggtctcgaactcctgggctcaggcgatcctctcacctcagcctcccaaagcgctgggattccaggcgtgagacaccatgcctggcctgtgtttttaaacccatgtcacaggacggtattcagcctgaacagtattcctgaacagaagacagggaggaaagccagccacacagcaatacacgcagcaggatgcagcttcggtcacattcaaaaagtgacctcatgctcatggctgcgcacatgcagattcagaaaaaacaaacccacgtgccaagttcctggccatggctgctcagggtatgcggggcgcaggacgtggggagggggacgagggccacccagggaacgagtgaaaccaagggcatgagatgctggccatcttcaacactgacagctgtcagcaatggctgcgtctgggtgaggggaactggatactgtcatttgtctagtttgacagttgtagaaaatttctcaacttaaaaattaaaaatacagataatgctaatgataagagtgtggggtgagccttcgtcccactaagccccctgcctcccttgccctgagcaacagaggcctccctgccccggtggctggggctggaaaccgctgcccacctccgcccacctgtgcttgcttcaccacggggtaggaaaatcaaactcctgctcagggcagagagcgggcacaggggccagggtctgctgcactgagccaggcgcgggggaggtcagccccgcccccacaccacccactgaggcagcacaggacacccacaggtggctagaccttagccatgtgggcccaaagagccgtgacttgagaaggtctcactcagaagtagaaaggggaaaccacccctaggctgtaaaagaaccccttgtctttcccaaggaagacacgtggaacaaaacccgcaggtgccagagggtgaagcaggttcctcctccttcccctcctcctcctcctctttgccacttgtttgactgaggaacatggacttggcgtggaagaaagatcggtgagaagctaagaaaggtccaggaacatatccctgaagggccacctggacagttgtccaggctgttcactgcacaaaaggacccagctgaagggttacagaccagtggacacacagtttaccaagccccctgccctacagcaggcctcatctgcccagaggggctgtctttttcttatttatataaaaatatctgttttccccccttctcccaagcaaggcagcccctcagggccatccccatacccaggtacagggcaaaggtgtggggccttccccagggactcaggcctgagactcagaacaggacccaagagggggcagcagtggcctgcagggggaccaccagccaccacccaggtgcccaccccaagctgcagccagccactggaggacactgcattccccgtttcacatgcctaggggatccggggcgctgggctgggctccagaccttccaggaggcagggcaggagggtcttttcaagtcaaacacttgtctcatcacctaaaaattggattctgttggcaaaataaaggggagaccccagttttgtttggggggcagatgacaggacatcctggttatgtccagggaggtgcagccatggggccctggccactctatctatgctaaaagtgaaaagctccctgctctacactgaccaggccctgaccagcccctgaccagcccccacccctgcaccctgggaatcccaggcaagtttctgcagaagggagcagtggctggaaggagcaggcacaccgatggggccaaaccgtgcacagcactacggtgtcctggaggaatcctgggagagaggaaaggaagggggtccaggcagaaggccttgcccccaagcctggggaccctgtcccagggaggatcctctcctaatattaacactccaccccaacatggtcagactccaccccctactcccagatggacaggaagggcgccccagagcttgactgggacacagggctggcagcgcctgccaacgccaacaggctcctgcctgcccaccccttggcattttctttttcatctccttgtccagccctggcaagtgagatgagttagagacagccaagtggccccaaagagtggggctgctgcctcacgtccccacaatgtggctccctggaaagctattttcacccaagtaggcctagcctcagaagctcttgagggcagcacatttttcagaaactaaaataacagctattatcagaggcaccacggtagagcgactcatccctgcccaaccccaagttgtagggcctgcagctctgcccgtcacctcccctggcaaggacaccatccctggccacggctcccccatgacctcagccctacaggaacctggccaaggaaacgcagaacccccaggggcatcagcctatgttcccagcagatagggcggccacataaaatcagaacgcctagttaaatgtgaatttcaggtgaactacagacaggttttcaggatacgtgcgtcctatcattgcacaggaacacaataaaaattacttattgcttaccagaaattcatatttaacaggcacccttctgttgtttcttgtgtttcgtttgtttgtttgtgctcaatctggcaatcctaccctcagatccagtcccaggtatacagttggtgttcagttgatgcctacattctttgttcttggtcagtcatcccagatgtatttatttatttatttattttagttttatttttttgagacggagtctcactctgtcacccaggctggagtgcagtggcacgatcttggctcactgcaacctccatctcccgggttcaagcgattctcctgcctcagcctcctgagtagctgggattacaagcgtgtgccaccacacccagctaattttttttgtatttttagtagagacaggttttcaccatgttggccaggctggtcttgaactcctgacctcaaatgatccacctgcttcggcctcccaaagtgctggattacaggtgtgagccaccgcacctggccagtcatcccagatttagatcaatgcctctcaaacatgtttctacatcagaatctcattagggtccattaaaatacagattccagggtcccaccatgatcctattccagaaggctagaaggctgcccagggatctgcatttctagcagacttccccaggggagtctattgcacaagagattccagaagcagcaggcctaagccttgctcctgtctttctaatgtgaccttgcaaataggcaccagcccacagaatacaagttgccctctgggatcaaaaaaactgctattcactcagaacataggaagggcagtttctccaaaagcaaaatacacaaatatgcatcttcagtctgtagacactccaggtgaagttgaggctgaaggaatgagcaggaccccaaatgttttaagccgccagcattctacttgatatgggagggggcggggaggcgcacggcattacctggtacccacctacagttttgcttcctgcagcacagagcccttgggagctgatgtcatcagggattcagaataggcctgaatggcctccttatcctttgagccctttttactactactccaaaataaatagcatttctcctagaagataaccaagctaatttatagttgacgttgaagccacataaaaatggttttacacggttcttcaatttgcaaaaggcaaagaggaaacaggaaaggcacataagtttagagtccaacaaccctcaacgattgcaggtggctgagatgtggggagctgccgctcttagacataagtacaagcatcttcaggaaacacacctgggaggtggacaagccaagctgaaaagggctcgtccacttgaaaatttaagccagcgaggaagcaaggtggggagatgggccatggagaccgacaaccagtggacttagctggggggctgtttaaaatcaacgaggaacagattgttctgttaaaatacttttgatttattttaaaagaatgacttgagaagaaaaaattactgctttttttaatttttgagacaggatctcactctgttgtccaggctggagtgcaatggtgcgatcatggctcactgcagcctccaactcctgggctcaagtgatcctcccacctcaacctcccgagtagctcagattacaggcaagagccaccatacctggctcaagtggaaaatttctctaaagagaaattaaaatatgttgagtttacccgcatgtgattttttttttttaaatcaggacaaattacataaaaactgataaggccggccaggcacagtggctcacacctgtaatcccagaactttgggaggccaaggcggcagatcatgaggtcaggagttcaagaccagcctggccaacatggtgaaaccccgcctctactcaatatacaaaaattagccaggcatggtggcaggtgcctgtaatcccaactgctcgggaggctgaggctgaggctgaggctgaggctcccacttgaacccgggaggtggaggttgcagtgagccaagattgtgccactgcactccagcctgggcaacacagcaagactccatctcaaaaaagaaaccaaaaaaaataaaaataaaaaaacaaaaaaaactggtaaggtcctgctacatcaaaacacacataatgggataaatttcacttacgtggcctccagtgaaacctgcagggagggagccacactgccgatcgtagcattcttactggatttgagggtgggatgctgatttgggggctgcggcagggaaagggaccctagccacagcctagaccttctgtgcttcctgaccctccttccctgtccccattctggtggacaatttggagacagacagaaggagacagagggatgaggctgtcatggcctcctctggcccagtccctcagccagtccccagggaccccctcatgtggctgtgcgtcgtcacttgtggacacctatggtgatgctctgccacgggaaggtattcatggtctgggagtgtgggttctgagtccttctgtcctccctacataattcagtctagaaactggagggagttccattttgctcgctggagtcacagccctgctgggttctggctccccctggggcagtaacagagaagggggctcccaaaagggctggttggacccaatggtcattgttcatcgggagctcaaacgctagagcagcaacatgatgacagctggtgtccaggctaccatctcacattgtggaaaccttttccccccgaggacaggaattttgaaaggaagtcgggtttcaggtctgaaagccaaggtgaagaaccaggaatgctttattgtcacccagcatgcaagcatggaagcaggcaagccttccctgagacaggggaagaggaagaatcattcaccagtgctaaaggaagcaggtgctgcagaggagccaagaccagcagagcagcggggcagccccaaggcccctcagaaggcctcggcctgtggccctaggatgatgcaggtgggggccacctcagagagtggctttctggtccatgcatccaaaaacagcctttcctgatgacctgccagtgggcagcatcccttcccctgccatggcagccactcgcccatctccactgccccttgagctctgtgatcacagctctcctgtccttcgtgtgactgtagtaacttgcctaaaggcctgccttgcccatctttgctgcagatcttatgttctggtcatctgcatcccctgacctgtgcaaagggccttgcagtgaatgcatgaatgaataaataaatgaccccgaagcaaggagggacactgttatcacccctcttcctgctgcttctggaggtctgaagcccagggctggagctcttccccacttccgttccctcctgatagcagctgccccatcctgttcaagccatcgacttcctcacgcactggggcctccccgctgggcccaggcttccacccctcccagcccggggcccattccccagccagcagctgacctagtgattcccctctttaaaagcctccaatgcctctgtcactcccagaatcagttccaaactgctcactgtgcaccacgaggccctgggtggcccgccctgtccactctcagacaccacctcctacctctgtccctgccctcactcccctccagccaccctggccctacctgaccgtccaatgtgccttgcctgtccctgccacagggcctttgcagtggccgctccaggcagcattcctcatgtggctgtgtgctgagtgcctccctggcctccatgtcaaagctcactatctacctcttcagagaggccttcctgaagctccatctgtccttgtccccacttgctccagacatgcactctccagtctggaagctgcattcagttggtgagcccttgaaacggggccagtccaaaatgagacctgctgcacatgtatcgtacacacaggatttcaaagacttcatgcaaaaacactgcaaaaatattgatgccgtttatactgattacatgttgaagtgataatactttgcatatatttgggttaaataagattaaaattaattccacctgtttcctttgactgttaagtggctattagaaaatttaaactgaaaacctcacacgtggctcacgctgtatttctatttggctctaacccctcacagctcctatcatgagtgaaattatcttttctgctgatttacttggttttcatctgtctccccggctgggatgccagcccccctcaatccccctgagcagggatctcagctgtctcctctactgctgtacgtcccctcgcccctaacagaacctggcatccccgggtgctgacttgatgaatggatgatgcaagtaccaggtctcattactcaaagcccacctgtgccccctccaagggagggtcccaggccttccagaacaggcagagtagtggcaacgcggcatgcaaaagacgcaagcgtgctgcgcagcccccagcagtgaccgctcccactccggcagagacgcaggactgctgctggaggtgggctccaggctgcggttggccagagggtccgatctgaggcccctttcccccagcaggcaagcgaatggctgtcagcccgggctgccctctggccagcacctacttggctccggatttggcagatgacagggaccagcagcaggacgcagcccagcgccaggaggacgtactgggcatagtgcatcaccttgggcatcaacaccagctgagtgtagaatgtgtgaagagtctccccctccatggccccgctctgaggagacagaatgacaaacacatgagctggggccgcaggctgcgggctacagcgcagatgccacccaacaccttcctctgtgcccgcctcagcttttccccacctcaagcttcccggctaaagcatgtgttggagcctgccagggacctcctccctccaggacacaaggtgagactacaattccccgactcccttgcagttgggcagggccatatgatcgtgtcctgaccaatgggaggtggacctggcctcacgtgactctccatctcgttccctgccactgaatggaggctctccaggatggcggggccaccggggccctggaaccctaaatgactgcagggagcagagctctgcctccccatcaacccacttcagattcggctgtgagtaggaagtaaacttgacattcggaggcttgtttgtcctggccattagctagccctgatttaaaacgaggtgggcaagaaacaataaatacagtaaataaaataaaataaaataataaaataaaacaagctaggccagaaggaattctgaaaagctgcgagagaagtaagtttaagagaaaagctgacaccttggaaaccaacttccccactttcaggagaagaggtcatatgccccaacaaaattattttacacccagggccagggactttacctcttcatgcagcttctgtcttccccatctctagggatccctttcaccttggtgggataactgacatagggtgcttggacagggtgaagtttctgatacgctggtccatgtcacagtccggttaccctggctcagccctctccctttctacaagctgctccccccgcctcctgcctcaaatgcccacattggctcttaacaaaagcccccgacgctgtgcccaacgcacccttacctctgcaaaccagagcagcggcaggaccacaggctcaatcttcccagtttgtctggaaataagcaagacatagctgtgtgaaacaaagtcttacacccaaacttgatctaattctgcttgaatacaacatctaaacaggtttagtataattttgcacacactaaaccctcaccaccaaatataaacaatgagctgaaacactttaggagccatatgacaaaactgtccccaggctgaaggtctcagtctacagccctcaataatacttgtaaataagactaactttaaatctttaaaaggcgttttgtttttttttttctttagttgacaaggtgagatgttttcccacagggctgtttgacatcacacagctttgaacctgtgatcataagctctgaggccaggagggatttgattctgcaatctcagtcatccctccttatccatggttttgatttctgccatttcttaccctcagtacagtacaataagatattttgagggagagaccatgttcacataacttttattatagtatttgttataattaccctattcttagttattgttaattgtggctatgcctaatttataaattaactttatcatagatgtgtgtgtataggaagaagcatagtatatgctatacagggttcagtactatccccagcttcaggcatccactgggggtcttggaatatacccccagggataaggggtccatggtacttgattggcatgggctgagggaaccagtgtttcgatgtgctgccagaaggaatctcccctggcaaagagcttgacaacttgaaaataatctttttaaactaaaaactcacatctcctacagggcagagaccaccagtgacccagccaaaatccattggtcccttttagaaacaggacccaaattttactcaggatggcaatgcacccagttaaagactccacttcagcctctcttgtggcaagtgaggctctgtgaccaagttctggttaatgagatgttcgcagaagcgttacgtgggatggccgggagggctgcttaaaaagaagctttcacagctgggaggtgaaccttttttccctcctccctttcagatgcctgaaacgcagatgcaagggctggagctctgcagacactgggaccagaggtgaccttgaggatggaagccatgtgttgggaaaatggaacagaaagatgagtggaacttggactatgaatgtctcttgccatacttggactgtctgcctccagacatcctctaaaagaagatttttaaaataacaatatacctttgtcccatttgagccacaactgttgagtttactgatctatactgccaaacctaattccaccaatatacctcacgacccagcaattacgctcttcagaaactgccctagagatgctcacacatgcacacagaggcacaaagatgttcagtgttgcttggactagcaaagacaaacagacaaacgacaatatgtatcttctctatggccacatatatatgaatgtaaataagtaggaaaaggcctggaaggaagcacagcaaattgatgatggtgggtacggctggggatggcggggagtcacaggaaaccatattcttcccctcaggaagatatgttcttattacctgtgaagttaaaacttacacgtcaagttaaaaagataataaaatccaaagggagaataaaagtaaacttgatactgcagaaacgtcacaggcatgacctcatccaggctatcaaggtcgacatcaacagtgatacagtatgttgacggaatgtacccaagatgctctgaaactggaactttctctctgcggtcctcctcccaaaacccatcaccccagtctaatcatgagaaaagcaccagaccaatcccagtagagggtcatcctacaaaatacctgaccagtgcttctcaaaagtgtcactgtcatcaaaatgaaggagagatgagagactgtcacagccaaaaggtgcctaaggagaccggaagaccaatgcgacacctgggaaactgtgacctgccacgacgaaggggaccgtgcagacatgactgcatcaaggctctcagatggggagagcgtcctggaatatctaggtgggtccatgcagatatggttacatcaaggttctgagatgggaagagtatcctggaatacctaggtaggccccagagaatcacaaaagtccttaaagagagaagcgggaagtcctagccagagcaatcaggcaagagaaagaaaaacgaaaaaacaaaaacaaattttaaaaccctaaaaaaagaaaaattaatttttaaaaagaggggctggggcgtggtggctcacgcctgtaatcccagcactttgggaggccgaggcaggtggatcacaaggtcaggagattgagaccatcctgggcaacatggtgaaaccccatctctactaaaaatataaaaattggccggacgtggtggcacatgcctgtaatcccagctactcgggaggctgaggcaggagaatcacttgaaccagggagtcagaggttgcagtgagcggagatcatgccattgcactccagcctggcgacagagtgagactccgtctcaaaaaaaaaaaaaagagggaagcaggaggttagaggcagagagaaattggacagtgctacactgctggctttaaagagggagaggccaagtgcagtggttcacgcctgtaatcccagcactttgggaggctgaggtgggaggatcacttgcaccctggagttcaagaccagcctgggcaacatagtgagacccctgtctctacaaaaaaaacacaaaaattagcagggtatggtggcacatgcctgtagtcccagctactcaggaggctcaggtgggaggatcgcctaagcccaggaggccaaggctgcagtgaactatagatcatgccactgtactccagtctagatagcagagcgagactgtgtctcaacaacaacaacaacaacaacaaaacagggagggctaggattaaggtcatgagctaaggaaagtaggcagcttctagaagctgtaaacggcaaggcacaggttctcccctggagcctctggaaggaacaaggcctgcagataccttgatcttagccttgttgtgttcctttcagacttcagactcccaacactgcaagatagtttttaaaagtgagccatgacatttgtggcaaaattgtgacagcagcaaaaggaaatgaatacagcaactcacactcagtatggagcagcagggtgggctggctcaccacttgccccacacagacccccccacaacaggtgtctagcagaaaaggcagtgtggcgaggtggttaatagtgcacactcaagcgtcgctgcctggatttgaatcccacctgggccgctgtgcaggcacgtgctcacgtggcaggcccgagcccttccaccccacacaggctgctggcaatgctggcccggagctggcgtctgggagcctggattcgggaggcctcccattgctccctaactgacaaggatggctcactgtgcctgagcaatctgtacaagtaatgtggtttatactgaccaccagcttgccttctaagggtctggaatttcagtacctgccaggcagagggtggccacatgaccagcccctagtaaaaaccctgggcactcagtctctctagcgggcttccctgccagatgacatgtcacgtgggttgtcacaactccttgcagcaagaattgggtgactcccctgggagagggctctggaaactggcacctgctttcctctggacttggccccgtgtggcttttccctttgctgatttgctttgaatccttttaccgtaataaatcatagccacgtgtacaaccatatgcttcgtcctgaggcttcccagcaaatcgtcgagcctgcggtggccttgggacccctgacacagccacttacgagctctgtgaccttgggcgtgctactgagcctgtgtcccttctgtataagcgagatattataacgtaactcttcctaggactctagggaggattcaatgcagtaatacatgtaaagtgcttcgaaaattacccggcatataaaagtgcttggcacatttattattgttgttgttataattgttaaatcccagcaaagaaatggacacacaaatattctgtcactttgccatgcacagcagtagggaggggagatggaagtcactgaggggcggtgacgaaagtcagcacaaaaggctcaaataccacaatcagagaccgggcgcagtggctcacgcctgtaatcccagcactttgggaggctgaggcaggtgatcacctgaggtcaggagtttgagaccagcctggccaacacagtgaaaccccgtctctactaaaaatacaaaaatttgctgggcgtggtggcgggcacctgtaatcccagctacgcgggaggctgaggcaggagaatcgcttgaacccgaggcggaggttgcagtgagccgaaatcgcgccattgtactccagcctgggcgacaagagcaagatccatcttaaaaaaaaaaaaaggctgaaatcccccaatcacaattattggaggtctctcaggccccttgttaagtagggtattgcacagtgaaatgggctcacactatcaccctacagaggacgaaacacgatggggagacaacagacggtaccatttactttggctgcttttctctgaaagactttgtaagaaccaatgggaattgtattcaagtaacatgcaaccccactgcctttacctagcgagcaaggagcacagaagcttccccgacaggtcacgagacagctctgcttcccggcagctgtgtctctagacttttcccacggccatccctcgtggccctccacatctgctgttgagaccactttcctggagtgccttgttcccagtccacagggaggtcagcagctgtgcggcccagagaggttgggtgaccggtccacaggtcactggcaggcacaatccagctgcccgcgtgaactgtttgttaagaatgtgaattaggcccagcgcagggctcatgcctataatcccagcactctgggaggcggatcacctgaggtcacaagttcgagaacagcctggccaacatggtgaaatcctgtctccactaaaaatacaaaaattagctgggtgtactagcgagcgcctgtaatcccagctacttgagaggctgaggcaggagaatcgctggaacccgggaggcagaggttgcagtgagctgagatcatgccactgcactctggcctgggtgacacggcaagacttcgtctcaaaaaaaaaaaaaaaaaaaaaaaaagaatgtgaattacctcccaataagtaaaaattgacagagctcctgttaaaattcagatttggaagtccttttgaaaaatgcagaggatgtggccacactgagcccgcatttccatggggctacagtcagctggtgctgggaaggggctgtatcctcggccccaggtcgcctcttctatctggtcacccacttggccccagttgcatcccagttagcagcccaggtgccacgcggtggaaccagagggaggacttgggctgcaaacgcctcttccatgcctggggctgtttccccacccacaaatccatcaagaacaaattccctaagtggcctcaaaatataaaaataaaatgcaagggcgggatgaaggaagagagctcacagttattactcgctgccgtgctctgacaaagtgttattctttccagccgagaggcatttgacaaagctgaatagatgctcacattcctgcaacccagggatttttctaagagaattttttttaacgaaactatttcagatatgctaagaagtacagacactgacatagcaacaaatcagtataatccctcaccaagttctagcaacgtgtaatgttatagcaagtgctggtgcgcgtggggaggaactggaaccctgctgcactgctgctaagaatggggatggggccgggcgcggtgctcacgcctgtaatcccagcactttgggagcccgaggcgggcggatcacgaggtcaggagatcgagaccaacctggctaacatggtgaaaccctgtatctactaaaaatacaaaaaattagccgggcacggtggcgggcgcctgtagtcccagctacttgggaggctgaggcaggagaatggcgtgaacccaggaggcggagcttgcagtgagccgagatcgcgccactgcactccagcctgggcgacagagcgagactccgtctcaaaaaaaaaaaaaaaaaaaaaagaatggggatggggggcagaggctgtgcaagtctgactgttcctcaaacggttaaacaaagagttaacataggacccagcgattccacccctcggtacatacctaaggaaaacgagaacagatgtccacactgggactgacacaagaacatttacagctgcattatgcataacggcccaggcgtggaaacaactcaaacgtccatcaaccgataaataaatgtggtctatccagacaatggaatattatccagccataaaatatactgatccatgctacgacatggatgaaccttgaaaacgtgatcctaaatgaaagaagccagtcgcaaaagaccacatagtgtatgattccatttatatgaaatgcccagaataggtaagtccgcagagacaggaagtggatgaacggttgcctggggctgaggggacagggaagtgagtgttaatgagtgtggggtttcttttggggatgatgaaaatgttccaaaattgattgtggtgatagatacacaattctgtgaatatactgcaaatcactgaattgtgcattttattaggggggttattttttttattttgaattgtgcattttaaaggggtgagttttatggtacatgcattatatttgcataaagctgttttattttaaaaatcaaaaagaggaaatcagtgcttgaaaaattcttttttttttttttttttgagacggagtcttgctctgtcgcccaggctggagtgcagtggcgcgatctcggctcactgcaagctccgcctcccgggttcacgccattctcctgcctcagcgtttccattttcaaacatttggttttgccaggctttcatttctgccactctgtcgtgtaggaaacagcttggattgaagctctggctaattggcagggagggggtgaatgttaaaaaagaaaagtgaaggccgggcacggtggctcacgcctgcaatcccagcatgctgggaggcccaggtgggtggatcacttgaggccaggagtttgagaccagcctgaccaacatggtgaaaccccatctctactaaaaataccaaattagccgggcgtggtggcacatgcctgtaatcccagctactcaggaggctgagtcaggagaatcgcttgaacctgggaggcggaggttgtggtgagccaatatcccgcccttgcactccagcctgggcaacaagagcgagactccatctcaaaaacaaaacaaaacaaaacaaaaaagagaaagaaaagtggtgttctggggaaggaatatcaggatgcaggtcaggacctggctcaaaaccaagacccctcagggagaagatcagcagggactggattccacccccaataggaccctctcccctccccatgccctggttcctggggtatgtcactggagtctgggaccactggagcactgagcacctaatctctcaatgagcaatgcagccccagctcccagtccccactcacccaatgcctgcgacagatttcatgtagaggctcagctgcagtttcacagagcagttcatggggattcccgtgacctgcggcaacaaacacagtgaggagactggccacccccaagctccagggacaccgtcaaccctcctctccctggtcccagtcaagagggtgggcgtcccagctaactgcccagtggagcttgcttgtatcttacctaaaacaagccacaggctggggggggtcaacagttctagaaatgctgggcaggtgcactgggatctcctctcctgattctaaccccttatagggaaacaagtgcttcccacacagttatgttcacagcctcaaagaggttccttctataaagcaaggctgtctcagggtggaaaatacctaatcactttcacctgtcctcctaagacagcgtttcccaaagtgcagaatggcaatttgtccatgctccctctcaacctccacattcaataaaacagacaaaagtcccttctcaattcactcccaactcctcctgatcattttgaagagtaggtctcagccaggtgtttgcatggtctttaatacccctctaatacacctacacaaaatctccacttctaacaatggtgctgacagctggccccaggttcactcctgctgacagacaacaatattttacatagagcctaatatttttttccttgttcatttttatggttgtcttctttttttggagaattttgtaatttcctatttgaggtagtaagaaaaagcttcctttgtgcagaaatttatttttatttctttttgagacagagtcttactcagtcatctaggctggagtgcaggcaacctctgcctcctgagttcaagcgattgtcctgcctcagcctccccagtagctgggactacaggtgtgcgccagcacactcggctaatttttgtatttttagtaaagacagggtttcaccatgttgaccaggctggtctcaaactcctggcagcaagcgaactgcccaccttggcctcccaaagtgggattacaggcgtgagccaccacacccagcctatttatcattattatttttgtagagacagagtttcactatgttgcccaggctggcgtcaaactcctagcctcaagtgatcttcctgcctcagcctcccaaagcagtggaattacagccatgagccactatacccagctctttttaacgagacttttttttttaagtaaataaccgaagtgacacacatgtgtcatcaaaaacaacaggaaggtggttccagaatgaagtcaggaaatgatagtggaaataaaactagatttgaggtcagagaactgcagttggttcttcttaactgagagtcgcgtcctcatctgtaaaacagagagaactctcccgacctgacagaatttttgcaagagcaaaagtaaggtatgcaagatagccacacgcagggccataaatgcctaggttattatcacgtacactatagggaaaggatgttttcttcattatggcccagcatgctgaggaccttccaggcccctgtggcaaagaagagctcattaaaggcctcacttacgcccacgactggggagtgcttgccctcgagagcctggtgggatgggcatgagatcacccgtgagtagaacagagttcacgccacaggcctgaagctgctctccttaggaattctgctggcatctgggaacccagatttcaggagggtccccaccatcccctaactgatgagagtagttcactgggccgaaattatttgtacaaacaatatggttcttgctcagcacctgctttccttcccagagcctagaattttggtacctgccaggcagaggtgcccacatgactggcccctagcaaaacaccatgggcactgaatttctaatgagcttccctgctagacaacatctcctacatgttgtcacaactcattgctaaagacattaagtgcatcctgtaggaaccccctggaagaggactctggaagctccagcctggcctcccccgacttcacccaaggtgctttttccctttgctaattttgctttgaattctgtcattacaataagtcttagctgtgataccaccataagcagcgtcctgttgagtcccccgtccccatgccctcccccagtttcaggagcagaaaagtggccacacggaagcagcttccaacacacgttcgtttttcaaggctaaaggccaacaggcagcaagctgatctcctgatccccctccccaacgtgcccagctcaaaaaacaaagaaataaaggccacttcctctccccgtcggcctcaagctcatctggaggtagaattggacgcagcagctaaagtggctgcggcaaaacagctgtttgcctctctctgggctcccaaacttaaccccttctttcttgatgtgaggggaagaaagaaaatccgtgccctgaaaggaaagcgatcactgagagcgcacaggagactgtgttcatggtggaattctccggaagccagcagagcaagagaggctggaggaggaattaactaaaagagggaaggcagagaccagggctggggccggggccgagagggcctagtcagcggctaaggaggcctgggaggacaaagaaaaatggtgcagaacagcatccgccatggagcttcgggaagggcctaaggtgcacagcattgtggcaaacgtgtggagcttcctcagacaacgaaaaccagaactaccatcggatcagtgatcccactgccgggcatccccccagaggaaatgaaatcagtgtgtcaaagggacaggggcactcccatgtacgctgtggccaagatacggaatcaagcgaagtgtccgtcagtgaatgaatgggcagcagaaacgtggtgcacacacagtgggatactgttcagcgtttaaaaagagggaaatccagctgggcgcggcggctcacgcctggaatcccagcactttgggaggccgaggtggacggatcacttgaggccaggagttccagaccagcttggtcaggatggtgaaatcccgtctccactaaaaatacaaaaattagccaggtgtggtggtgtgtgcctttaatcccagctactctggaggccgaggcaggagaattgcttgaacccaggaggcagaggttgcagggagccacgatcatgccactgcactccagcctgggtgacgcagcaagactctgtctcaaaaaataaataaataaaaacagggaaatcctgttatttgtgacaacatgacggacctggggacactatgcgaagtaaaataggccaggcacaggaaagcaaaccctgcatgacctcacctgtatgtggaatctaaaagagttgaattcaggccaggcgtagtggctcacgcctataatcccagcaacctgggagtccgaggcgggtggatcacctgaggtcacgagttcgagaccagcatggccaacgtggcaaaaccctgtgtctactaaaaatacaaaaattagccgggtgtggtggtgtgtgcctgtaatcccagctacttgagaggctgaggcagggagaattgcttgaacccgggaggcggaggttgcagtgagccgagatcgtgccactgcactccagcctgggtaaccagagtgaaactccatctcagaaaaaaaaaagaaaaaaagttgaattcatggaagcagagggtagaatactggctaccaggggcagggatggggaagtccgtcaaaggatacaaaatttcagttagacagggggagtaagtttaggagacctactgggaaatagagcaacagtcactgtattgtactatacaatacaacacagtgactagagtgaatagcaatgtattgtaagcttgaaagttgctgacagtagattttaaatgttctcagcaccaatacatcatcagtatgtgaggtaatgcatatgttaattggcttgatttaggtattccacaagttatatacatacatcataacatcatgttgtacactcaaaaatagacagcttttcttcttcaatttagagaattaattttggctgggcacggcggttcatgcctgtaatcccggtactttgggaggccaagacaggaggatcgcttgagcccaagagttcgagaccagactgggcaacatggcaaaaccgcgtctctacaaaaaatataaaaattagccaggcatggtggtacatgtctgtagtcctggctacttagggaggctgaggtgggaggatcacctgaacccagggaggtcgaagctgcagtgagccatgatcatgccactgcaccccagcctgggcaaccgagtgagaccctgtctcaaaaataataataattttgttaaaggcccatgggatagaccacaagtgcccacccaggaaacagaaaaccacagatttctgaatcaatggtagcagccaccaagaccaactgggcatattttacagagaacggaggtgccaagagaagaggccacaagctgaaggagtgtccttgggagggccacatgtccagctccctgcttgtagacagaacttcacacgggacaaattccctgtgtgatttatctgcaaaataccccaggctcttcttggtacctaaagatctttatggtatcttgacacatccagagggctgcctccagctcacatgtaggagacatcccagctgataagttctaattaatttactgtcttagagcccatttatagaaaccagtacagggatcataaaacccttgaactaccttgaactatggagtcggggtgaagtaaggaactttggtggctcgagattctagaagccaggcttcccaccaccccagcccacagcagctctctgcctggggagagaggaggcagccaggtgtgctccaaccaggaatcacccaccccccacagaggatggcaggggctcaccgggtggatgtccaggaacaaggagtgtgcctcctggttagggtgcaggccagtcaccgcttctgccagaaccgggtcagcgttgaggaagtgaggatgggagagaaacaagggggcacctagaagaggggcagggaggggacatcagacaaggacagtatattggcaggtcctgccaggccggaggtctgcacagagctgtggtctgcagggcacccccgtggcgatgacaagataaccagacagagaggatcccttcctccattctgtaaaaagccccaggccctgtgatgagggacaagctctgcgccagagaaggggtgaggcaggagccgctgattctgacaggagagaccaaaagaaggaagaggcctcttcacaggagccaggtgaaggatgcccgggaagcgcattccaggtggaagggaaggcagaagcaagcgtggggagggggaaatgcatggtgcacaagggtgctagggaggcacggatggaaaaggcaacgccagatttgaacttgggtgtggggaggggagtctcaagcgcaagccaagcagcccacactgtcccctgcaggacacgcagcaatgatcggagctcaggtgtgtgcacctgtggccagatctccctgcatccacaggagtgtgtccctgtagacacacctgctacaaatgtgagctcaacctcgccactgaccaaccaaaccaggcaaacaccagctcaccctcgggacaatggacaacaggcctgaaggacaagttaacaaggaacagcgagcgggcctctctcaaaagctcacgagggccaggcgccatggcttacacctgtaatcccaacactttgggaggcctcagcaggcagatgacttgcacccaggaattggagaccaggctggacaatatggcaagatcctatctctacaaaaattagccgggcatggtggcacctgcatgtagttccagctactcaggaggctgaggcaggaaaatcgcttgagcctcagaggttgaggctacagtgagccgtgaccgtgccactgcactccagcctgggtaacagagcaagatcctgtctcaaaagaaaaacaatttttttttaaaaagctcacaaggatccagacagtgctaatccacagacagagccaacgggtggtgaccaggggctgggggagggggcggggagtgacttctgatgagtctgggtctccttttggggtgacagaaatgttctggaacgagatacaagtgatggctgcacaaccttgtgaccctgctaaatgccactgaatcattcactttaaaatggttaattttatgttacaagaattttgcctcagtaaggaaaacaaaacaaaacaaaacaaaaacttgaatcagaggccaggcacggtggctcatgcctgtaatcccaactctttgggaggccaaggcgggtggatcacttgaggtcagaagttcaagaccagcctgggcaacatggtgagaccccgtctctactaaaaatacaaaaattagctgagcatggtatgtgcctgtaatcccagctactcgggaggctgaggcaggagaattgcttgaacctgggcggcagaggttgcggaggctgcagggagctgaaatcgcatcactgcactccagcctggacaatagttttcggaggttgcagtaagccaagattgcaccaatgcactccagcctcggcaaaagagcaagactgtgtctcaaaaaaaataaaataaaataaagggccgggcgcggtggctcacgcctgtaatcccagcactttaggaggccgaggcgggtggaccagttgaggttgggagttcacgaccagcctgaccgatatggagaaaccccgtctctactaaaaatacaaaattagccgggcctggtggtgcacacctgtaatcccagctactcaggaggctgaggcaggagaatcgcttgaacccaagaggcagaagttgtggtgagccaagattgcaccattgcactccagccttggcaacagagcaagactgtgtctcaaaaaaaaaaaaaaaagacatagttaaaaaataccgtggaaaataatgatgttgtaagttctaactagaacctgttactgcatgaggctttaactgggagccctgctctttttctgttaaaagaaaaaacaaaacaaaaaaggctgatgagtgtggaaggctcttcaagtcctctcaacaccaagagaccttctcctgcaggtgatggcaaggaggaaaagagcatggacccagaagctcactctcacctccttggaccttctgaagccatcccaagcacccgcagggacagtgtcctccacaatctggaaaacgctgcctctcgtgcctcctccgtggaggaggcagccacggagccgaactctggaggaatctcaaacaagccctggcctgcccacagccccaggtggagaccgaggtgggatggaacaacttgccagcccccgcccttgcttcagaggccgagcctgcatggacccacgcacgtgtttcttccaatgttattaccaagcacgccgagagagatcttcccagctgtaagtggtaattaatttgtagctttatggcatatctagccagacataattgcccaggattgccaccgatgataattagttggctctgtgaggcaagtcggatgccctcacgcaacagggaggtttgagatgagggagttgtctgagtccaacagatttcaaggcccagaaaggcaaaggcatggtacctttactctttagataacatgccacagaaacacagacataggtgcaccaaacgacacgtgtgcaccacggtcacggtcgaaaaacaggaacttggatgcctaggagcaatggaaggagaagatggaggtggcacccacgatggaacaccacacagcaacggagaggaggggctgctaccacccacaacgtcacggacgaattgcaccagggtgctaaggggtgcacggaccagaaaaggaggaaaaggagtctagcattatgggtccattcacatgaagatgcaaaccagctgagctccggggctggatgtcagggcggtgggaggaccgcgagtggcatccagggcctgtcctgtctgtttctcagtcagggtgctggccacggggtgcgttgactttgtgaagtttcaaactgcaggtgtcagccaggcgcagcggttcatgcctgtaatcccagcactttgggcgggaggatcacttgagcccaggacttcaagactagcctgggcaatatggtgagaccccgtctcttaaaaaaaatttaagaattagctgggcatggtagcaaccgcttgtagtcccagctactcaggaggctggggtaagaggatcaattgagtgatggaggtcagactgctgtgagccatgatggcaccactgcactccagcctgggcgacagtgataccctgtctcaaaaaacaaagcaaaaaaccccaaaaactgcatgagtcatctgggaacttctttgtatctatgtatattttatttagaagcaaaaactaagcccgggcaagacggcacaaccccacctctacaaaaaaaaaaaaaaaaaaaaaaaaaattgaaataagataaaataaattagccaggtatggtggtgtgtacctgtgctcccagctacctgggaggctgaggtgggagaatcatttgtgcccaggaggtcaaggctgctgtgagctgtgattgcaccactgcacttgagcctgggcaacagagaaaccctgtctcaaaaatataaataaatataagaaaaaactctatttaaataaagattttaaaattcctttgcgcttttgaaattcttttggcagatgtgctaagagaaggcgggacacacctcgtcccacgcccttggaggggatgggcatgtcgtttctcccccttctcctggtacctacacccccactttaagccttccctactttcagccttgtgcttggagtggggccggcccacccaggagccatctgagcatgtgacacaagcctggccaatcagcatagtccacctcggctactgtgattggtttacagctgggcatgggagccaggcagaccaattagagcaaaccctggaacttctgctggagtgaaggaaacacaggtggccccctttctgcaggactcggagctgggcggaggtgagcctggagcctccacaggcagccaggagggagagcctgcttggcagcaaagccagtccagcagaaaactgagctgggacttggcagaggcagcttccagacaacatctaagttctggatttgtgcctaatgcagagatctgccctggaatttttcattacgcaaaccaagaagtgcccttttggcctaaatcaggtggagtccagcatctgccacttgcgacagttgctgtagcacacctattgggtgtgtaacatcctcaaccttaggagcagaaatccccgccgataccagcaaagaatgaagcaagcagaggccaatgcccagacgggccagacaggaccaggagacagcagcgggcgtcccaggccccagctccaaaccattcattcacaggttgttccattctgcctgaaataggggaaagcatccaatctgttgacagcccctcctcctgacccctgttgcagaccagtcctttagagtcgccattgccagctggaggacggggcttcaaccaaaaaggctcccagaaggcaagacacagtcaaatagagggccgcttccggtcctaccaaccctgtgaccttggtcgcatccagcatcaggcctcaatttcctaagtacagaacgcactcaccatccctatattcaaatactgtatgagtacccattacatgcggggcacagttctagaagctaagaataaaaccaacaagaggagcttggggccctgcctacagggatgacagtgaatggaaggggcaatgaataaaatccacagtccatgagttcagggagcaatgagcaccaagacaagaagaggaagacaagaagaccaagacaagaagacaagaagaggaagccatagggagcagcaggtgggagagggggcaactttagaacaggaaatcagaggaggcctcccggaggaggtggcatttgcatgcaggccaaaagaaggtgagggatgatccactcagaaatccagacaaagagctctccaagcaggggaagcaacccatgcaaaccacagtgcaaggcactgaccttggtatactttagaaaaagggcgaaggcatcagggctggagaataatgaacaggggacgtgtagggagaaatggagtcagagaggctggtggggctggatccttcagagaggccggtaggggctggatcctgcagggcccagggccatggtgggagtttggacttcactatgaatgcagacagagctgccagacattttaagaggacggcggccatctgcatatttttcgagatgggtcttcctctgttgcccaggctggagtgcagtggggtgatcacagctcactgcagccttgacctctgggcttaggccatccttccaccccagctttccacgtagctaggactacaggcatgcaccaccatgcctagctaattttttttttttttttttttttttggccagagagaggtcttgctatattgcccaggctggtctcgaactcttggcctgaagtgatcctcccacctcggcctcctacagggttgtgattacaggcgtgaaccaccacactcggcctgcattgttaaaagatccctccgctgctgtcgggagtgctacagaacttcctatgatgatggaaatgttctctatctgtgctatccaagacagtagctgctagacacacatggcttatgagcatttaacttccggccggtgcaaccaaggaactgccttttaatttgatttcgtttaaatcaatttcaatttaaacagccgcaagaggccagcagtgaccgcactggatggtctaggggatggatggtaaggcggcaacactgcattgagggatgggctactgaaagggctggatcaccaggaaggacgtgtccgtggcctggacaatgaggcgggggttggggtggggagcaagagagaggaaggagtgaggactcaacctggaggtaaagccatctgggcttgttgacgcactggaagagctgggtgaggacagggaaacaaactgacgcccgagggtccaaactgagcaacttgaggtgggggtgtctcagggactggcacacaattgagacacaccaacaatgtcaggggaccgacgccaacagcagtcatcacatctgcctagccacccacactgcggaacgagaagatgttacgtaacacacagaccctcgccagcctcatttcatgtcatttaggacacgtacatgccctaagccccagaacccatgactatgtcaggtcacagggtaaacgggcgctgggcctgctcagcagctgccttgaaggtccagaaattgggccgggcacagtggctcacacctgtaatcccattgctttaacacgcagaggcaggtggatcacttgaggccaggtgtttgagaccagcctgggcaacatggtgaaacaacatctctataaaaactttacaaaaataaaattagctaggtatcatggcccacacctgcggtcccagctactcaggaggctgaggcaggaagatcgcttgagcccatgaggtcgaggctgcagtgagctataatcgcaccactatactccagctccaggctacagagtgataccttgtctcaaaatataaaaataggctgggcgcggtggctcacacctataatcccagcactttgggaggccgaggcaggcagatcacttgaggtcaggagttcaagaccagcctgggcaacatggtgaaacccccatctctaccaaaaatacaaaaaattagccaggtgtggtggtgcacgcctgtggtcccaactactcgggaggctgaggtgggaggatcacttgaacctgggaggcggaggttgcagtgagctgaaatggcgccactgcactccaacctgggtaacagagtgagagtctgtctcaaaaaaaataataataaacaagatggggagattgtcctggggtatccaggagagcacgatgtggtcttaagggtccttagaactggaagagggggcagaagagggaggagaggaagagatatgaggacagagtggatcagaaggatgccatgttgctggcctcaaaggtggaggaagggcccgggagccaagaaacacagaggggcctctggaagccagaaaaggcagacgcagcttctcctagagcctccagaaggaacacagccgccttgttctgagcgcggtgagacccacgcagacttctgactacagaactgcaagataaccagtgtgtgttgttctaagccctgaagttcatggcaatatattgtgacagcaactaatagacctggcatttcttccttttcagattatcttcctgcggcctcattatcttcgcctaatgggattatcaagagtacagaggccagagattaagcagacagcactgggcagataaaccctcagctggccccaccctcacaccctcccgccatcccagcacaggggacggcacgtactgaacctgcaggtgctgacgttctgaattccagactccaggcacgggcagaagccttcgttgggtgggtagatggacccgttggcaaacagggttttgggagccacgaagcgataggtggggatgccttcaaacacccctgactccttgtacattagcttcatggatctgcaggggacagacaggatgagaggggacacccagacccggcggccagagccaggccctgccaaaggctgcccagatccagccacttctccccacgggcgctaccacctcccgggtccaaaccgcccccatctctcacccgcggagctgcagcgacctcctaacaggcctctccgctccgactctgcctccccacccacatcaatgtattagccgtggccagatggagttttacaaaagaacagaggccaggcattatggctcacacctgtaatcccagcactttgggaggccgaggtgggaggatcacttgagcccaggagtgtgagaccagcctggggaacatagtgagacccagtctctaaaaataaaattgtttttgaaagttatgaaattaaaaaaagaacagaatatatcatgcccctgctgaaaatctgtgaccctttctagtctaacctaccattaggattcattgaccttatctagcccctgcataagctctgctcagccctgccccaacttcctgtgcccagggcctccctgcagttcctaagcacactcactcctgccccaggccctttgcatcactgctccctctgcctaagaacagtctcctctggcatcttcatccaccagacttcagcccttcagtcagatctcagttcagctgtcacttcctcgggtggcagcaccgtcccccacacccaccccatccaccctccatccattcatgctcctgtactttctcaaaagcacttctgaacttgaacatgcactgtgctacccactctgtccacggcagccactcagcacgcatggctgtccatcccgcccttgacatggggtgagtccaaattgggatgcaagtataaaatacattccagatttctaatacttgctagcaaaaaaaacaaaaaaaaaacctcatcaataacacttgaaatgatcccatttttgatatatgaggtcaaataaaatacattattaaaaataatttcaccaatttcttgttacttgtattaatgcagccactaaaaaattttaaattgcatgtgtgccttgcatattttgatttataggaaagtgccagcttagataacagtattatgtcaatgccaaattttctcattttgataacagcattatggttatgtaagaaaatgtcctcgtttctgaaaaacacccactgagtatttggaggtaagggggcatacagcctccaacctactctccgatggttctggaaaaagacactcggcgagaagagggggtggggggcttaacacggctagtgaacctgggtgaaggggagacgggggccacttgtatttctcatgcaacttttctttaagtttaaaattcagcttttaaagtcagctgggtacagtagctcacacctgcaatcccagcactttgggaggctgaagcaggaagatcccttgaggctaggagttcaagactagcctgggcaacatagcgagatccccatctctaaaaaattaaataaataaataagtaaaaacttaaaatagtaaaaagtggccacacagagcaaaagcactgtcactctctgacactctagtgtttgtgcatttgcctgagttgccctgataggacacagcctcctggggaacggagacttggcccaccctctcactaccgggcacctggcacacagtagggcttcacagggtttgctgggagggcagataagtcaaggtccacatgagtgaattcctaagtaaaggacttttccagagtgaccagaatggaacacgacacagcaaggcctccagaaaagggctgtaggagccacccactgtctactcttaccccacaactgggaccatgggacacagagctgagcctgaaggggccaagcagagccagctgatgtctcagcacccagatggtcatgggggccaccagccagacgccagagggagcccacctctcgcctccattttatggccccctgtgacttgacatgtcctgccccctcctcccagcccagcaccacctggctgcaaaccaccaccagcagcctctctttgggctgtgtagaggcattggcagctggagtttggcttttggtggtgtgaccaaagagaattcaagctggtgccaagggctactgagtcaaatccacgatgagtcaaaatgctttccaagtgcacagccaacaccacagaatttggccatgagctacccaggaaacccaggaggccccgagtcccagtgattaccggcaggcctccgggctgtagaactccagcgaggactcaggagtcatgaagggcggccacatttgcccagaagttccattgatcatgttgcactgatcggaatgccagaagtcaacctggggggaagcatccagactagacccctcagtagggccaaggccccttaataagccctctcaggtgctgcacacctaactcaccctggtgcacgcacggccactcaattcccaatactggcacggtgggaagagggcaggctatgtagacacacagagagaatgcctaccacagcttccccctcccagacccctgaatgtgtaacttcgctagggactcagttctttcatctgcaaaataggcctatcacccacatttccagcctgaatctggaaaagaagtgtggtgagcaggtgaggtgagaggtggggcgcggctgtgctcagccctcagagcggaagtcaacaggcacctcctgaaaacaatcggcacacaggcaaactacttaaaatcataatggtggccaccaccgggcaaccccaaaacagaacctgtcaggttaactgactctggggagcgagacccagactcgacaaaaccaactgctcactttccaatcttctgtatgatgaggatgtttaaaatcacgtgcacatgtacagtatattggaatatacaagccacaatgaatgtgaactccatctatcgtgaatggctactgccagttgcagatggtgatttttgccactctgggcaccggttggggtacgatttgtccctagccctcagggtctttgcagtaactaccacggggagtggggagtgggaagtcacacagtcattttcacacatattgagaaaaggtcacgaaggtgaaaaaagccagttgcaaaacaatgcacgtagtatgatttcatgatgttcaaagaagaaacaattccgtatttctctgcgtacatataggtgtgcacatgggtaaaaatggatgggaagaatatatcccaaactgataattgtgggtttcctctggggcaaggggtaggggtgggaggtgatactaagggcacttatctccctctcttgttttattttgtaatgtgaatctcttctcttttttttggagaccgagtttcactcttctcacccaggctgaagtgaaattgcgtgatctcagctcactgcaaccttcacctcctgtgttcaagcgattctcctgcctcagctcatgagtagctgggattacaggcatgcaacaccacacccagctaattttttgtattttagtagagacagggttttgccatgttggcctggctggtctcgaactcctgacctcaggtgatcccccccacctcggcctcccaaagtgctgggattacaggcatgaactaccacgcccggccttcaaaacatttttgtaagtaaagaatcgaaaggaagaaagcactcagttcccagcagatgccaggtgctcagtaagctcagtaagcaatcactaaccccacctgcccctctgggtggtcaagctttaaccagaggtaaaatccctcctccaacttcaagagtgttcatcctcccagcaccctcttcacgacaaaggaagaaggagctctctggtccctgccactcccgagcagccatggccgggcccaccctcccctctccctggcgacaggggccctcgcctctcgcccctcaccttgctcagcccgttccacttgtccacgaggtggatcctgctgatgttctggacccccgtgaacaccgtgaagagcccagagtcggagttgttgagctacagacacagcagggaacagcatcgtaaggcttaggcctgccattgagccggcctggtctgaacattctgggctgagccctcctccccctccaccagaaggacagggcccccagcatctggttcactgccaaatgcccagtgtctggggaccgagaggaggcttgggagctttctaggaggaatggtcccgggttctgtggctgcagtgttccaccctcccttcctaactccaggagagtctggctttcctcccaggtaaatggcagatcacccccaccacaccctactccagcataaaataaagcatggccaggtcagctccctgagcaatgaaaaaggagaagtggcatgtcacttggggggatgctttaaggactgtgcacacgcctttcaccgggctctctgccgctgctatagcagccaaggaggtatgtgtcaagacagagcctccctcagcctggatccccaagtgaccaccacaagcgcgggtgccccagtcacccacactggacgtggagtgcaagcaaaggaataagtcttggttgttctaagccatggagattccggggctgcttgtcacagcagcaaaacctggcctgtcctaacccatcgaggttcttgatagtggggcccaggctttggtgctccgagagcatttcccagaagctggtttctaatcccaaagacatgcaaagcacaaagtggtatgagtgactgaaggaaatatctagaagtgctttgcagggtggagcacactgaggagctccaaggttgcccggctgagtgactgcacccatcacagacctccagagcaggacccagcacaaggccccagcccagcatcccgggtgtgtctgtcacgtgcccatgtggagccaagaataaccagagccactacaaaggggagcattaaagggactcatgtgcaaaaacggccaggtacagtgcaccggacacagtaagagctcaaaatgatagtctttattttcattattattgttattattaataaatgctcacccaataggatacttaaatgatcattataatggacggagagcatcagaaactgccagttactacccaaagcccaatctctccttactctttcatacaaaacccaaaccatactcagagcatcagcacacccagctaaaaggctacctttccagcttcccctggagctaggtgtggccatgtgactcagttctggccaatagaaaggaagtggacattggttttcttcctccctaagagggaggaaactggaacacgctgttttacccccagttcctccatctgctccccaaagccccaccattttttccttcttgctgtgctgcctggaatgtgatgtgattgctgacactctagcagccaacttggacaatgaggttatcttgaggatgaaaaccacatgccaaggatggcagagcacagtagtagaaggcttccagatcacttaagaccatgaagccaccacaccaacactgaacagcctaccgctagacttttcttgtgaggttttcattatatgcagtcaaacgtagattatactaaactagggactttgtaataactttcatttgcaaagcacttcaggatttacaagatgcctttacagcatcatgccacttagcccaaacttgctcatttacccacacgacaggagcccgtcacccttgacaaaaacgtactgagtatctatcacacgcagcaccacgatatcccccccagcactctaccctgatcagcagagaccaaagagatggctgaggctggagcagtcccaaggactcagtgaaacctgcggtgagggagccaaggtcagggtcagaccctccatggacgagatgttggctccgaagcccagtcagtgaccctaccaggttgccaagagtcaagattaagagtcagcttgtgatattactccccagcagccatgcccccttcctccagcaaagcctccaatttgctaagctaaggcccagtcacatcatttgagcctggatcaagctgtacctgaatccaaccctagcattttcagttctatgagccccaacattccccatttcactcaagccggtttgagtcaggttctcagtcacttacaacccacagccactagatccccagccagctacaaagcaagctggtgaccagtgtccaggctgtgtgaggggaagacaggacacaggcctgaatctttggcttctcaccaggccacacgtacctcagcaaataatccgaacttgtccttgaaggggaacatgcctggaaagtacttgttgatgagattcacaagggggtccttgtagccccacatgatctcacccacagtgcggttcatgaaggcacgttcgccgagggtggtgaatgccaaggtcatgatgagcttcagggtcatgggcttattctccatcatcaccgccgcaccctgcaaggcgaagggacactagtgtcagaggctggacgtggctggcccatcctcccttggccccagctgggcctcacagcaaagagcccatgaagggaaatgctggggtgcaggaggcccctggagtggccacgtggggcatctgggacaccagaaccaccctctgctcctccagtgccaaggccacatgtgctcccgagaaccccttctcccccttgcaccccactggactcaggctaagtgaactccagccccagtcccagaggcgggcctgtggctcagccctcaacaagacagccccttttggagatctcagaaatgtaaattgaaaagggaaaaaaaagtactttggccaggacttccaaaccaagacaggtggacccacctgggaaactcagaacccactgggggtggtggagacagcacagggccgaaagccacccaccaggcgtgagtccccacgctccgaccacctcagggactgctctctgcacaaggggcaggcgggaggagagacaggggacgaggtcagggtgcgaggcggcgtgggccacagggcagcctcaccaagaccaggatgttgggcatgacgatgtagtcgctctccgagccgtgggacttggagggctggaactggaaggtgcggtactcgaggaaggacacggtgtcgttgttgttgaaggtgatgttgcttttgtgcctgaactccctgtgggggaagccagtgggtcagacgccccgccccgctgcatgggacgtttcccttctactcgcctgcaatgcctgcctgggaaccaggggccctggacgtctgtgcacacctccggccccacagccaaagctgagctcggccccttcgccaagtctgtccctcccgccgcctgcccactgcaggacatggtgtcgccgcccacccggcctcgttctgctctcccccacccaacacggccatcgtctctccatctacaaaaggaagtaatcacaagccctacttcacagggcagctgtggggattaagcaatcagatacccagaaagcaatcaacacagccgccgggtgcagagaaagcacgaggtaaacatcagctgctgtgactgttgctgctgctgtccttatgatctctcatctctccaagccactctccaccatccagaagaatctttgaaaagtggaaatcaggtcgggagcagtggctcatgcctgtaaacccagcactttgggaggctgaggtgggcagatcacctgatgtcaggagttcaagaccatcctgcccaacatggcgaaaccacgtctctactaaaaatacaaaaattagctgggcatggtggcagatgcctgtaatcccagctactcgggaggctgaggcaggagaatcgcttgaacctggggggcggacgttgcagtgagccgagatcgcgccaccgcactccaacctgggtgaaagagagactccgtctcaaaaaaaaaagtagaaatcagatcgtgccatgctctggaccacaaccccactttgcatgcaggttaaaatcaggctcctaacgtgacctctgaggccctcagcaaggctcaggcctcgtctctccactgtctccctccctcgtaaccccagccgcacaggcctctgtcccagccttcagacctttgcacatgctctgcccgggactctgtctccccagggcctcttcccaccatgcgggtccagtgagtgtccctttgcagatgtgctcccgaccctccagtcagaccgagccccaaggccaccctccctcctgcactccggcttcacactgttttgtctgcacaatactgatggctgcctgatttccccttatttgtccacttctttactctctccccatcagaacatcagcttggtgaggcagggccttggtctgcctgcgcccccagcacacaggaggtgctcagtcagtgctcacagaatgaaggagtatagagagctttggcatttttgcccattctgtccactgctgggtcccctgtacttagaacggcagccaacacctagcaggtgctcagtaaacatttgttaaatgaacgagcgaatgagtgaatgagtgaacggaatgcagcagctgattcatgtttcccattcccaaacctcaggcacatttgctgggttttcatcttggctttcccagaaccagactgtgggtctccaacagcgggaacaccctctgcccgccccatccctggaacaccgtgtgccgggggcaagtcagctcccctgtctgtgaactgggaagtgggggtgtggaggaggggaggtgctgtgaaaacgccaggaggtaagggagttgtaacaggcacatccgccagccgtctcagagctccgagtgcatcctgagtgtcccggtgaccccatgaaggggctcttgtgtctctccagtctgcagacgggcaaactgaggctcagaggaatgaagtcacttcccctaggccacagccaggtacaggacaagcagaaagcaaaggcacaactctgtggtccttgggccagcatgttccacaaacagctgaccccttcccgtgctgacccacccggtcctctggcccagatagggtctggggggtcggtccctgctcctggtcatgcatgtgtgtgtgtgtgtgtgtgtgtgtgtgtatgtgtgtatgcatgtgtaggtacatgtgtgtgtatgtatgtgtgtgtgtatgtgtatgtacgtgtgtatgtatgtatgtgtgtatgtgtatgtgtatgtgtgtgtatgtatgtgtgtaactcacacatgcaccctccacccagacgcacaccattggtccctccctgctccataaagaacctctctaggcaacgtctggtgattcgcacctgtaatcccagcactttgagaggctgaggcggaggatcgcttgagcccaggacttcaaaaccagcctgggcaacatagcaagatcccatctctaaaaaaaaaaaaaaaaaaaaaaaaaaccctaaaacaaaaacttctctgggactagcacttaccccgactatgacttgcctgcttccggaacaatctctggggctcagtcagcagcctccccatcccgtccactctgagacccctcccctgcccagcctcagccggcccctccaccctcacctggacacagcctcacctgtacacgtagggcccgcgctcccgcacctgcggcttctcgcccttcaggatctcgctggggttcatgacgtcaaagaagtagacggagagatagaaggggatagggatctccttccacatgttgaaggacaggctactggggtcgatgcgcacgttctgcaggggaagggacaagtacgcttgtgaggagagtgatgagggccccacgccccaccacaaggctccggaacagctgcccgagcccggccagggaaggggctcctcggcgggagcttgggataggaggtggtgggaaagcccttcgcacatgaggctgtcgcacctggagcttatggaattaaacaggcaacctatccatgctgtcataatgcatcttaaaatatgtcctaacagcaacaggtgacaccagtcaagggactgtggtaaacaggggcccatgcaccacctaaagggagcgccggagctcagggtagcggatgggctcagggcagggatagcctcatgcaggaacatgggctccgtgtggccagggggatcattcattcattccacaagcaagcactgagcactaccacctgccaggcgggttctaagagctggggatgggagaatgaccaggacagaccaaaagcccagctatgtggggctttaccatagcggaggaaaggcaggcaccaaacaactcaggtaaaacgcatgccacgtgacagagcacagagaaaacacagcagggattggggagagactgggatttgagacagtcatcacgtaagtgaaatataggccaggcaccatggctcatgcctgtaatcccagaactttgggaggccgaggtaggaggatcaccagagcccaagagtttgagaccagcctgggcaacatagcaagaccctgtctctataaagaataattttatttatttatttattttttgagatggagtctcactctgttgcccaggctggagtgcagtggcatgatcttggctaactgcaacctctgcttctgtgttcaagcgattctcctgccttagcctcctgagtagctgggactacaggcccccaccatcacgcctggctaatttttgtatttttattttattttatttttttgagagggagtcttgctctgtggcccaggttggactgcagtggcgcgatctcggctcaccgaaacctccatattccgggttcaagcagttctcctccctcagcctcccgagtagctgggactacaggcacccaccaccatacctggttaatttttgttttagtttttgtttttgttttagtagaagtggggtttcaccacgttggccaggctggtctcctgacctcaagtgatccgtctgccttggcctcccaaagtgccaggattacaggcatgagccactgtgcctggcctataaaaaataattttttaaaaagtagctgggcatggtgctgcacacctgtagtcccagctacttgggaggctgagatgggagggtcacttgagccaaggaggtcgaggctgcagtgagctgtaatggcgccatttgtactccagcctgggtgtccaagcaacaccctgtctcataaaaaaaaaaaaaagaaaagaaagaaagaaaaagaacacacacaaacacaacctagacccaaaatcaaaacagaaggcagtgaggaagggagctcacaaatctagaaggtgaggcgcaggggacattccacagcaaccacagcctgtgcaaaggccctgtggtagggagacgctgggagagagcctccctgtgtggctgagtgagccagtcggaagatgagaacacagaagttttccatgaaaaccagaaataaagaaatgtatatgaaatctcctgatttaaaaatgttgcaaaaacatggttttcttaaagggactataggaaacacgcctggggtccacttggactcctctgccagctttcctcctctagatctataattcgctgccccagtgtcacagggaggtcccccctagtccacctgacccccaccctcaacccagccgggacatatctcgggcccctcagtgcccacaccacgtcagagcccggcaggagtgacccagcccattagactagagctgatgtcgcaaagccaggcagctgcgtcaccttccaccctcttttgaacatggccttctaagacaaggacagccagaaccaacaggcagaggctctacaggaggcagacagctgagctggccagtcagggccagccccatgtcccccggaaggagcagatttggaggcagccagaccctgggtcgcactccacggggccacttgggcaagtcagcccctgtgaacctcaagtttctcatctgtacgaaggagctagtgacactgtagctacaactgtgtctagtttgacctacgtggcgtgtcaatgaagaagctgaattctttgtcaagaaactggaagatgtaatgtaaaatctggatttcagagttctcttggaaaaatcaggagatcagagactggccttcaagtgccataattgtttattgataaacgtgtcttcctacccagctgccagcaccagaaggatcaccttatggtctgagcagcccataggtgcaaacgaaggcgcataaactgaatattaatgaggtaacagaagcgagcatttccggggtgcgccatgagcctggtgatgctgttcactgtgttctcatcctctgaacagcaccattactctttgaggcagccacctccactattattacccccatgttacagattaggaaactgaggcacaactaaggctggagagagattcaaccaatagttggagggcactgaggagtccgggaggtcttcctgggggaggtggtatgtgagctggatcaaagagcagtcctgccccctcggtaacgccctccccaccccatggcggctcccaccaccccatgcgaccacagcccacaggcaccagctccagcccctcccagctctcaggccccgatcgcccagcccttccttcagtcctggccttcacccagcctcaaagcccatgcactgcaggtccctctgtctgggacagaccctgcagccctggggaccctgctcaccacaggccagaccccttcaccagcctgggggacacatccagctgctggtgctccccccatagaaaacacagcatcaaaacccagaaccctggaaaatgtgttcggggagtagagcacgaactatatgttctcaccacagaaaacagtggggggcaggagggaaccgtagaggtgacaggtatgttcagcacctggatctcaggggcgggtttcccggtgtgcacacaccagcccatcaaactgcatatattaaatatgtgccattgttttatatcaatcacaccttaataaagctgcttttttaaaaaagcaaaacaaggcccagtgcggtggctcacacctgtaatcccagcactttgaggggccgaggcaggcagatcacttgagcacaggagttcaagaccagcctgagcatggagactccatctctacaaaaaatagaaaaatcagccatccgtggtggcaggtgcctatagtcccagccgcttgggaggctgaggtgggaggatgacttgagcccaggaagcagaggttgcagcaatctgtgatcacaccactgcactccagcctgggcaacagaacgagactccatctcacacacacacacacacacacacgcacacacacgcgcacacacacacacgcagcctcaatttccctttgcagcctccctctcccacctggtttctcagcagaggctgctgggctggagatacctttctcctttggaatctcaccatgctttcctcctcccctggccgcttggcctggttctgaagatgaatcagggctaaaccaagaagtcatgggatccggccgcgtgtccatgtctcaatctctctctctctctctctctccccaaagaagaggctttcaggccctgggtttcagcccattcattcagcactgcccaaagggaatcttcagagacccagcgcagccctgtccaactgggtgatcagggatgggtcactgaccttctccgagtctcagtttcctcaaccatacaatgggcgtaaggagagtgtcgcctcatgggctgctgtgaggtttgaatgagtccatggaggtaaagtgcttagaacaaggtctgaagaccccgggcaccagagggtcagccctgcagtcattaagtgacccttcctcctctgccccacctccacccgggttaagggatggactttgccctgcttttgatcagcaggatgacttttttccaccacactagaccaggcagctgattagataacagtggtggggacactgtggccttttgcctaacatggctgattctatgattctgtccccaccacccccaaggtcaaagaccatggccctggaacacagagttgggatagaatgccaaggtgagcccttgttggacgccactccctcccatctggcgaaatagaccctttgagcccaggaaggctgcctggaggaggggacatctgagctgggaattttaaaataagctgggctttgctaggaaaagaagatggtggaggagtgcctggcagaggacacagcctgtgcaaaggctgggaagcctttaagagcgtgacttgcctgaatgttcaccaaaaacaaatatggaatgatatatccatatttgatagttggaaacaactcaaatatccatcaacagataaatgaattgccacatatccacacaatggaatgctacctggcaatcaaaaagaaccaaccatggatgaacaccacaacacaggtgagcctcagaagcactaccccaagcaaaaaaaagaaaagaagaatcatactacacaacaccatttccgcgacatcggggaaagggaatactctagagagagaagccagaccagtggctgccggggaccgggatggagggaggggactaacgtgaactggcccagctatcttgattttggttgccatataggtgaagtgtatacatctgatgcaactcatcaaattaggccaggcatggtggctcacgcctgtaatccaaggactttgggaggccaagccaggagaatttcttgaagccaggagttcaagaccagcctgggcaacatggtgaaaccgtgtctctactaaaaatacaaaaaatattagccgggcatggtggcgcacacctgtggtcccagctactcaggagactgagctgggaggatcacttgagcccaggagttcaaggctgcagtgagccgtgatcatgtgcctgcactccagtctgggccacaaagcaagaccctgtctgaaaaaaacaacagcaacaccaccacccatgacatgctatatttaccgctatggaacaatctccagaatattttaagtaaaaaaaaatttaaaaatgaatactattactacctttaaaatataatgcaatcatgttgatcaaaaggcagatatgtgcatacacatataatcccatttatgtgacgttctaaaacaggcaagactaacatatcaatagaaaccagaacaggggtcacctgggaggttgggggataagcgggtgaaaattctgtttcctgatctggttgctggttacccgggactatgttcactgaaaaatgtatggtgttattccctttatatgtgggcttttctatacgtgtgctacacttcactaaaacccttttgaaactataatgtgaaattttaaaaataaaagattaactgcaaatgggcaaacgacttgaaaagaccttgctccaaagaaaatacacaaatagccaacaagctcatgaaaaggtgcttgacatcatcagggaaatgcaaatcaaagtcacaatgggccaccacttctcacccaccaggatggctagaattttttttcatggaaaatagcaagtgttggcaagggtgtgggaactggaacctttatgcattgccggcagaagtgtaacgtggaacagccactgtggaaaccagtctgaccgttcctcaaacgatcaaacgcaaagttaccgtatgaccctgcaactccactccccagaacagacccaagaagaactgaaaatgggtgtaaaaaacaacacgtacaagaatgtgcacagcagcactgttcgcaatgggcgaaaacgacccaagagtccgtcaacagatgaatggctgaacgcagtgtggtctgtccagacagcggcatctgactcacttagaaaaaggaatgcatgggttggctctttactactgcgtaaaaaagaaatgtatttaaagagccaaaaaaaataattttaaagaaaggaatgcggccaggtgtggtggctcacatctgtaatcccagcactttgggaggctgaggcaagtggatcacctgaggtcaggagttcaagaccagcctggccaacatggtgaaaccccgcctctattaaaaaaaaaatatatacaaaaattagctgggcatggtggcagccaactgtattcccagctactcgggaggctgaggcaggagaatcgcttgaacccgggaggcggaggttgcagtgagagccgagatcgcgccgctgcactccagcctgggtaacagaccgagatttcatctcaaaaaaaaaaaaaaaagagaaagaaagaaagaaaaagaaaggaatgcaacactgacacatgccaccacatggacaaacctcaaaaacctgacatggagtgaaagaagccagtcaaaaggccacacttagtgtctgaccacacttacgaaatgcccagaataggcaaatccagagacagcagattggtggttgccaggggctggggcagaaaggaatggtgggtgactgcttaatgggtacacggtaatgagaatgctttggaactagatcgtggtaacgattgcgcaaccttgcgaacgcactaaatgccactaaactgtacatttgtaaatggttttggtgaattttacgttaactggatcttaatcacaatttcaaaaagaaagattaactccaaattaaaatgagatatcatttcccagtagatgagcaaaaattaggacatccaagaaaacaactacaggcaaagatgtttggaaacaggaccgctgtgcacagcgggggtcaggccactggggagtcgggacagtttctaatcgggtcaggtgtgagcaaagccccatggtctgtgggttccctgttcagacatggtgcagagcaccagcttcccagctcctgccaggctagggccacgacctgcacacccaccagaagcctcatgagggaatacgcaccttcccagcatgatgcaacttacgttatgactccattattcgcccctctggtattctatcctattccattctgtttttaaaatgctgatcccaggccaggtgcagtggctcacgcctgtaatcccagcactttgggaggctggggcgggcaaatcatgaggtcaggagatcgagatcatcctggccaacacagtgaaaccctgtctctactaacaatacaaaaaaattagccaggcgtggtggcagatgcctgtagtcccagctactcgggtggctgaggcaggagaatcgcttgaatccaggaggcggaggttgcagcgagccaaaattgcgccactgcactccagcctgggcaacagagcgagactccatctcaaaaaaaaaaaaaaaaaaaaaaagctgatccccacccaccccacttatttcacaacccacaatctgatcacatctgacagtttgaaaactctgccctagaaagattctcctaagtgtgcaagaaagcgccagaagaattgtcagacctcaaaaaaagaacagagggccaggcacgggggctcacgcctgtgatcccaacactttgggaggccgaggcgggtggatcacttgaggtcaggagttccagaccagccgggccaacatggtgcaaccccgtctctactaaaactacaaaaattacccaagcacggtgacatgcacctgtagtcccagctactcgggaggctgaggtgggagaatcgcttgagcccaggaggcggaggttgcagtgagccgagatcacaccattgcactccaacctgggtgacagagcgagaccctgccttgaaaaacaacagagagcccagccaggttctcagtcaaagataagctgggcttctgcacacggtggctgcacagtgagtaaacgccatcgacttgcagatatctcaaaggcagaatcttgacagaaggacaaatactgcaggacaaatacttccagatttgtcttttagaggtgaggaatctgaagacattgaatacacagagagttgaatggtgcttacggggcggaggctggggaggtggggagatgcaggtcacagggcgcaaagctgcagtcatgtgggatgggtggtctggaggttgcatgcacaacacgaggactgtgattaatactgtactgtatactggaagcagatttcaggtgctctcaccactaaaaacaaagaggtggccgggactcatgcctgtaatcccagcactttgggaggccgaggtgggaggatcgcttgaggtcaggagtttgagaacaacctgggcaacatagggagcccatctctataaaaaatacaaaaattagccaggcacagtggcgcgcacctatggtcccagctactcaggaggcttaagtgggaggatcacttgagcctgagagttcaaggctgcagtgaaccgtgatcaccccactgcactctagcctgggtgacagagcgagaccctgtctcaaaaaaaaaaaaaaaaaaagaggtgactatatgaggagatacatatgttaatctgcttaactgtagtaatcatttcactatgtgtgtgtatatagcaaaacagcatttggatgccttaaatatacataatttttattatttatttattttgaaacagagtctcgctcagttgcccaggctggaaagccttgacttcccgatctccccagatcaagcaatcctctcacctcagcctcctgagtagctgggactacaaggcacataccaccacgcccggctatttttttatttttttatttttttgcttttagtagagacaaggtctcactatgttgcccaggctggtcttgaactcctgagctcaagagatccactcgcttcagcctcccaaagtgctgggattataggtgtcagccactgcacctggcctcaatttttatttttaaagaaaaaaaaatcttgagtgaagaaaaggctaaagaaagaaacaattgacatgggcctcttgatgtgaattttccaaacacatgaaataatactctatattctttctgaagacaaacccatgtggaaatgtagaaaaacattcagggaaatgatacctgcaaacaatctcaggagagggctgggggctggggatgtggggaaagctttaactgtcattgtgaacatgttatttcttgaaaataacatacgagccaccgtccgaacattggcctacaagcccctctgcctggtctggcccctgtgttctctctggccccacatccaactgtagcaggacaagtcacagacaaaactcctcagacaccggattaaagaaggaagaggtttttattcggccgggagcatcggcagactcgcgtcttaagagccgagctccccgaaaaagaaattcctagcccttttaagggcttacaactctaaggggtccatgtgaaagggtcataatagatcgagtaagtgtgaggaacgtgactgggggctacatacatcagctaacagaacaaaaagttttacagtgctttctcatacaacgtctggaatttacagataacaccagtagttttggtcaggggttaatattattattattattattattttaaccaccagggccaggtggtggcgccaaggtcgtctagctatttatcttacttctgtttctttccatctttttgctttctcccttttctcctgtcttataaactagggaaaaggggaggctggggagaagctgggaaggacaacagcagaagcggtggtctcattccacaaccactgtctgttactcagcccagccccacagcctccttgctatcctgtccaagaggccacgctcctgccccagggcctttgcacccactgcttcctcctaaacacgtggtcaaatccctcaccccttcgaatctctgcttacatgcccccttctcagaaggctcatccaacctgcccctaaaactcctgacctcccgacctgccgtgttgtttccatgctgcttgtggccttcgagcacacggtataattagcttatcaggtttattgctgtccatctgtatcacctgcctggccataaacccacaagggcaagatcctcagctgctttgtttggcgatgtgtctgtcctcagggcctgggacagctcttggcaccttgcaggagctctgtaaatattttctgggtgaatgagcaaaagtgagacctgaaaccatataatcaacgtggaaatgtctagcgggtggtaacgctagtcctcctttgtgtgttttaaacagctcatacttaagaagggatttttttttttttaaatacacagagagtaccgcctgtttaggccggggcaacaactcggtaaatgtgtgatggatgagatgaagatttcatagacattaatttttagcattctcttcctaccacccacagcactctcccctgcacctggagaggcccctgacctccaaacctaacaccccgctcgcccaggtgccacctcctccatgaagcccactggaacgacctcggcctacagtgaggctgctctgacctcattgggattgcagttcatgccctgtacaatcatccgccccatgctagatgctatgctaggaatttaaagacacagggatgaacacgatggggcccctgccctgagacgcccctgccctcagacaccaggggagcagaatcgtctggacgatctgcccggccctgttcaggtagcgaaacacttccacctacttcacctcttaaattctcaatggctcatctcatcgaagcagacactgaggctccaaagccaaatgcctgaccaaggtcacaggagcagggagagacagagccccaggctccgtatccacgtctaggcctgtgccctcacgcttctctcctaggccatccccgctgggctccttgcacgggagcttcacaaatgaatcattaacttgacctggccactgaattgcaaggtctaattcctcctcctatgagaagagaaaacaggcttccaagaaacacacctctgaccaaatgagccaagaagccaatttgcccagacgaagcctagttctgggacaaggccaggccctgcccactctggaccagcagtcagtggctgactacactctcaatcccagggctccaggcatccccagctccatggggccttaagatgcaggaacaactacgacacaggctaatccaatctgggacttgggaacaccacacccttggctcatgttccaacttcttttgatttttaaaggactaaggtaagaagactaaaataaaaggtttttacaagaaacccacgcttgtaagttgcttaagcgaagaggttgagtcattcctgagtcctccattttcctcccacctagcaccctccatcagcaaggctgggctgctctcgctttaaagcatgcctcaaatccatccacttctctccaacaccatcctggcccccatcctggcttgtatggatgggtgccgtagtttccccgctgttttcctgcctctgctcttgccccccgccccgttctccccacagaatccaagttatccttttaagattaaagtcagagcatgtcattctgctcaaacctcccccatgcctccctatttatctcagaatagaatctaaattcctgacagtgacctatgaggtcttgcacaacccagctccctatagtcactccagtctcctcccccattcctatctgcctcgctcactctgctccagccacactggccttgctgtgctcctgagccaccaggcaagtttctgccacagggcctttgcactgactctttgctcctccaggggcaatctttcccctgatgcccacaaaagtgagcccctcacttctcaagtctaaagtcactttctccgtgagaccttccctgagcaattttcaatcccttaaccatctctattgagccccactgtatggcaggctctgctctaggcctgggcacttcaatagtgaacaaaatggatgaaaataccattcttcctaaagcagcccttcccccatcacattatattcatcaccctgttttatctccctgacattatcaatatctgaaatttctatgtagttgttgataagtcccccttcctgctgcccggaattcagtcacaatggatggagctagagcagccatcttggatcatgaggcacccttaagaatgaaagccacacatgaagaagggcggagcagaataggagataggagaaaggattcctgtgacttcctggagccacccaccagccctgggtggcttagtcatcagagaaatgtccactggactcacagtgagatcccatgccatacaccagaatggctacaatgaaaaagactgacaataacaagtgctggtgaggatgtggagcagccagagtgctcacacattgctggtggaagtgcattagtgcagtcactgtggaatatactttttctaccaaagctggacgttcaccctacaatatagcaatcccacccccagtatttgtcccagaaaaatgaaagcatgcacccacacaaagattatccacaaatgctcatagcagccgtacccataacagcccaaaactggaaacaacacaaatgtctacaagcaagtgaatgcatgacaaatggggacacactcataccatggaatgctacccagagacaaaagggaatgaccaattgagacacacaatgacagggtaaatcacacacagggaccacgtgcatgagtccatataagtgacgtcccggggaatggcaaaaccaatccatggggatagaggtgggggcagcaggacctcaggggtggatactgacagggaggggtgcgggggaggcgtttacacttggtatagggggtcattacaagcgtgcatacctaggtgaaaatccatcaacctctaaccgaaattgtgcacttttcttaatgcatttgatacttcaatttttaaaaagaaaaaaattaaagcaaaaaaaattttttcttttttcagacagagtctcactctgtcgcccaggctggagtgcagtggtgtgatctcagctcactgcaacctccacctcccaggttcaagcaattctcctgcctcagcctccagaatagctgggactacaggcatacgccaccatgcccagctgatttttttttttttttagacggagttttgctctgtcacccaggctggagtgcagtggcgcgatctcggctcactgcaacctctgcctcccgggttcaagcaattctcctgcctcagccccccaagtagctgggattacagatgcccgccaccacacctggctaatttttgtatttttttaagtagagacggggttttgccaaattggccaggctggtctcaaactcctgacctcaggtgatctgcctgcctcggcctcccaaagtgctaggattacaggcatgagccaccgcgcctggactgatttttgtatttttgacagaaatggggttttaccatgtcggccaggctgaggtctccaactcctgacctcaggtgatcggcccaccttggcctcccaaagtgctgggattacagacgtgagccactgcgcctggcctaaagcaaaaaattattgatccagggttgggtactcttcagatgttcaatacaccctcaagtggtgtcgctaataagagagcacctacagccaccaaggcccaatcagggtcccagtgccccgtcaaatctgatttctgaagcagagcagcgaggccagccaggagaccaccaggggccctggagagacgtgagaggtctggggtcccctctttaccagcaaaggggctctgtccactccctgtcccctcaaccccctgcccatcctccacctaccagcaggcgcctgatacaacttcctgtgcctgtttctttacctgtaacaaggaataaagaataggacccatgcagcagggacaggtcatgttgacataatgtgctgggaacagcccttcgtcactgcgatcttccttccaaaacccggaactagggcctaatcaatagaagaacaacagacaaatcccagcagaggggcgtcctgcaaaattcctagccggtgctcaggaacgcaatccaggtcatccaaagccaggaaagtctgagaacccacagagaccagaggatcctaaggcaacgtgagggacaaacgcaatgtggggccctggattgggtcctgggacagaaaatgatacgaaggagaaacgaaggaaacgtgaatcctgtctggatgttagttattactgatgtatcaacactggttcattcatagcaacaaatgtatcccattcctttaagatgttaatagcaggggacactggctgtgggatatgtgggaactcagcactatcttcccaatttttctgaaagttgaactgttctaggccgggcgcggtggctcacacctgtggaatcctagcactttgggaggccaaggcaggtggatcacttgaggtcaggagttggagactagcctggccaacatagtgaaatcccgactctactaaaagtacaaaaattagccaggtgtggtgtcaggcacctgtggtcccagctacttgggaggctgaggaaggagaatcacttgaacctggaaggcagaggttctagtgagccgagattgtgccactgcactccagcctgggcgacagagtgagacttggtctcaaaaaaaaaaaaactgttctaaaacagaaagttattttaaaacaagcaggctctgtcgcggcaatacagggagggccaaatcagtgcctcaccgaatcatattacagcttcaagcaaaaggaaaaaatgtgcaccccatatttatactttttccagaacattaaggtctttttgtaaaaacactgacaatttcaaaagttcacatattaacacaacattattttaagtttaaatattttatttaagcccacccaaaccagattatactatcatgttaatgacctggctttaatggaagcattttcattgtattagcttcccactgctgctgtaagaattaacaattaacactggctcagatcaatacaaagttattatcttacagttctcggggggagaagtccaaactgggactgcccctgagatgggatgaaagtcacggtgcaggcagggtgcttccttctggagctcagggggaatccattgccttccgtttcccagcttctaagaggcctccgcattccttggctcctgtccccttatcactccaacccctgcttctgaggtcacatctcctactctgaccctcctgcctccctctgtcaaagatccttgtgaaagcattgtggcccctgggacaatccaagttcatctcccatctcaagatccttaactttttttttttttttgagacagggtctcactctgttgccaggctggaatgcagtggtgtgatcacggcttactgcagcctcgaactcccgggctgaagcaatcctccttcctcagcctcccacataactgggaccacaagcatacaccaccacgcctggctaatttttaaattttttatagagatggggtctcactatgttgcccaagctggtcttcaactcctgggctcaaaaatctcccaccttggcctcccaaagtgctgggattacaggtgtgagccatcatgcctggtgtaagatccttaacttaatcacgcctacaaagccacttttgctgaggaaggtcacatattcacaggtcctggggatcaggacgccagcaccttttggggacattgttcagcctgccacacccacccagagaccccagagcatcctcccacacagccccctccaccccagggaacacccctgcaccagggagtgtgacatttgccccgtgcaccccttcctctccccacagccctatcttggccagaaggcaggcttcgctagaaacaaggtggacccggcaggaagcccagtgtcctctttaatgggaagctccacgcccaggatgctcacacgtcccccgcttttgaaccctgctgtgttttggcctgagctgtcctaagagaaacccgggccggggaatgatctgcggagcaggacactctcccgcagctgctttcaagcagctcagcgggggcactttgttcttgcagctgggatctgaaaagcaagccctctgggctgcggacgtgcccgtgctgcctgcactgcctcctcgtgactcccgagacctcctgccagtgacacgagggtgtccagaaacacaaaccgaggcccgccctgaaaagggctaagccagcttcatcctcagccacatgggaggaagaatgcaggcaacagccagcaggggcctgaggggccctgcaaggccagagccaggggtcttgtcaaaagcaggcctcccaagccagtgagctcccacgggacacacggggggacagggaggcagccagaggtcagaaccactccagggtcctcaggttcccagaaacttccaggctgggccgggaccagaaacagacgtcaccggtgccagtcccttgtgctggtccctgagccacagcccctgaggcccccaaaaggggcccaaccaacaaggggctgagggtccgggcagagcctcccactccaggcatgaggtctcgggcaatttctgaacactggagcaggtccacctttcaaacctcattactgccctacagaacgacttttggtgtgagcatagtactgtggtcatgcttggggattttcttttgctttatcattgtggtggtgtttactaggtacctgttcgggcagtggttcttgaagtgtggtccctggctgagcgtggtggctcacgcctgtaatcccagcactttggaaggcaaagataggaggatcacttgagcccaggagttcaacagtctgggcaacatagcaagatctcatctctagaacaaaatttttttacaatagccaggcatggtggcatgtacttgtagtcccagctacttgggaggctgaggcaggaggattgcttgggcccagaaggtcgaggctgcagtgagctgtgattgcaccactacactccaggctgcacaacagagcaagaccctgtccacccccccaaaaaaaaggcggtctccaaaccagcaacatcagcatcacttgggaactcgataaaaaagcagattcccaggctccatgccaggtctgccgactcagacactcaggggctggggcctggtgatccgtgttttagtgagccctccagcgtccagactccaatgcaccatgaagtgccgtggctatactagagacactgacggatgaggcaatgtctgacatgagccccagaacaatgtggaaaaggggaaagtgtatggaggcacgtgcagaaggcaagacttggtatctcctcagcaagttacagggcccgtgaccatcgcaccggtctatttttatgtatgtttgaattttttttttttaagagacagggtcttgctctgtcaccctggctggagtgcactggtgcagtccgagctcactgtagccttgaactcctgggctcaaaccatcttcctgcctcagcctccttgtagctgggaccacagcagcttctgtcaccatactcagctaattttttcattttttgtagattttattttttgtaggggtctcgctatgttgcccaggctggtctgaaactcctggcctaaaccaattctcccgcttcaacctcccaaagagctggattacgaacgtgagacactgcacccagcccttgaaatttttcataaattttttttaattcactcaaaatttcttatacaccgcatcctccccgcccccactaaaaaaaacacaaactaggtcttgtctcttcctgaaacagatgccacaaactgggcccatgggccagattttgccagtagatgggttttgaatcacatatttcaaaatatttgaatctgttgacagtatcttaaaccagcaggtaaattcctgccttctggcttcttttgggaacctgggtgatgtccagctctgggcctgcatgccacgtggcccagcccgctggagcaaagcaggagccgcttcacagttggggtgtgccctccagcttgcaacgggccccaccactccctatcacctcatgccagggcccttcccccatgtatgttcctgcacagtttgcaatccctgtcctatagtaacacacgatgagaacgtggcattcattcattcattcattcactcagtcattcattcatttcaaccctgcctgagcatccaaagcgggcgatcagtgctacaggggtaaagttaatccaacaggattcctgccctcgtggactgagcaggaagtggggaagaggacacgcaattcacaagtgactcaggtacccagtaggaagagctcagggacatcacacgtattcactggcacgcactggcaagcaccagaggtctcgcgcatgtgtcactggccagaatgtccatcagtacagccacctcggagagccactgggcaaaatctactgaggcagagcacgatgttctgaactgctgaacgcatctggaaaccaccacctcccatctctcaggaagcacaacagtaaacatctgcattacagaagccactggaggcaagttttatgttgtttccagctcaaagcatcccatttaaagcaatgctttcatttatttaaacctaacaattaggctgggtgtggtggctcacacctgtaatcccagcactttgggaggctggggcaggaggatcactggagcccaggagttcgagaccagcctgcgcaacacagtgagccccatctctacaaaaaatgtttaaaaatttgccaaatgtggtagtgtatgcctgtagacccaggtacgtggaaggctgaggcaggaggatcccttgagcccaggagatagaggctgcagtgagccatgatcgtgccactgtactccagcctgggtgacagagcaagaccctgtctcaaaataaaatgaaataaaataaaatagaataaagctaataatttgtctccattttactgatgaagaaagtgaagtacagggagattaaaccactcgcttgcccaagagcacaaacccaatgttggcacagagtcttgaccttgggtctgaccaaaggctgggcactgccttggtaaaggcccagcacaggcgtggcaagtaaggagctcagaccagcgaagagaatgctggaaggtgcatacagtcctggtccccgggcacagagatgaatcaagcacaacctctccttccccgccaaatcagggcctcatcctgctccccagttgcacctgcatgacgggaactccaggcagcccacctctacttgcttttttggacaaaaacaatttctaccagggctgatcccagccccactgtttccacacaagtcagacagtgaatatgccttctttcaaacaccccaacctcaataaagctggctgttttcaagcaaaaacattattcttctctgttcttagaaaggtttcaacaagctacagcctgtggaccaaatccagcctgatgcctatttctactcaccccacaagctaacaatcattttgcattttcaaatggaaagaagggaaagaggggaagaaagggaagaaagaaaagaaagaaagaaggaaagaaagaaagaaaggaaggaaggaaggaaggaaggaaggaagggagaaaaaagaaaagaaaggaaagaaaaagaaagaaaagaaaagaaaagaaaagaaaagaaaagaaaagaaaagaaaagaaaagaaaagaaaagtcagccagctgggtgcagtgctgcacgcctgtaatcccaacactttgggagaccaaggtgggagggtcacttgaggccaggagttcaagacgagcctgggcaacatagtgaggaccccccctacacacccacccaccaacctataaaaaaaaaaaatgagccaggcgtggtggcacatgcctgttgtcccagctactcaggagagtaaggtgggaggataacgagcccaggaggtctaggctgcagtgagccatgatggtgcccctgccccccagcctgggtgacacagtgagaccctgtctccaaaaaatatgttaaaaataaataaacaaacaattgaaagaaaaatgccatttcatgacatgtgaaagttatatgaaattcacattttggtgttcataaatgcagtggcactggcccacagcggccacctcgacttatttctgtgtcgtcaatggcagcctcagcatcacagcagcagggctgagtagctgagacacaacccgtgcagcctgcagagctgagcatattgactatctgtctctgtacagaaaagcatgccaaccccagcctagaccacacagaaattcaggaagggccatcccctgccaggccagcttcacgggtgaggccggatctggccattagggagagggccagggcgcagacctagttctggcctcggctcagtcagcccctcccaccccggtcccctgatatgccacatggagacgtgactgcctccccatcctccccgtggcagtgcagagagaatgagatgacccaggacatgtgtctgttgtgaagagggcacccggctataaacatgcctcagggaactattgttacaggagcctccctgagctcaccactggctccagttcaagaacacgtcatgaagccagccaaggtcttgtaaaatagggcaacggtggtttgggcctggaggaatcagaagctcagggctgcctgcttcaaaggctaagtcttctgcaacaggctcagcatgttggaatttgaccctggccaacaggctgggccgtctggtctaccatctacaaaccaacagcccaacccattcaagcaggaggggccggtaccatttctcccttcaggttaaaccctgccacagtttttaattttaattggggtaaacataaaatttaccaacttagccttttttttttttttttttgagatggagtctcggtctgtcacccaggctggagtgcagtggtgtgatctcagctcactgcaacctctgcctcccaggttcaagaaattctctgcctcagcctcctaagtagctgggattacaggcgcctgccaccatgccaggctaatttttgtatttttagtagagacggggtttcaccatcttggccaggctggtcttgaactcctgacctcgtgatccacccaccttgggctccaaaagtactgggattacaggcatgagccactacacgcccagcccaacttagccatttttaagtgtacagttcagtggcattaaggacatttgcaatgttgtgcaattatcagcaacatccatctaaagaactctttcatcttgcaaaagtgaaaccctgtacccactgaaaaagagctctgcaccccctctcccccagcccctggcacccaccattctcttttctgtctctgtggatctggctactctagggagctcatgcaaatggaatcgtacggtatttgtcctgttgtggcttatttcactcgcataacttcctcaaggcccgtgcatgtcgcagcgtgcgtccaaacgtccttccttttccaggctgaatcctattccaacgtgtggatgggccccagcttcttacccaccacccatcagcggacactcgggttgctcccaccgttgggccatcgtgaacagcgctgcaatgaacgcggtggccagattcctcttcaagttcccacttccatttctttgatacccagaagtggggttgccccaccatatggtaattctatgttaaattttgggggggcctccacacagcagctgcaccatcctacattcccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcatcctcaccaatatttgagattttctgttttctcaagtgaccatcctaatgggtatgagtgtgtctcactgattctcatttccctaacgatgagcgagtgtcgctgagcacacttccatgtccccgttggctatctgcattttttttttttttaagacagagtcttgctctgttgcccaggctggagtacagtcttggctcactgcaacctctacctcccaggttcaaacgattctcctgcctcagcctcctgagtagctgggattacatacaggcgcctgccaccacacccggctaatttttgtatttttagtagagacggggtttcgccatcttggccaggctggcctcgaactcctgaccttgtgatccgcccaccttggcctcccaaagtgctgggattacaggcgtgagccaccgcgcctggctgcctgcatgtcttctttgcaggtgcttggtccgtgttttaatggggttgtctgactcttgttgttgagttgtcctcgcttgattttaggaccagagttaaggcccacactccatctgctctcaacctccctcccccgatcttctcgtctcggaaaatggctccaccatctaccaaactcctcaaaccttgaggaaccacccttgattcctctccttccctcgcaccccagtccactgacctatcttgttgactctccctgaaaaaaaactcgaatatgttcccttctttccatttagaaaactacccccacctggctcaaatcaccatcttctctgcctccccgcttccagcctggcccccgacactcccttctccagacagcagccagagagctcttcaagactgagtcaggctgggcgtggtggctcacacctgtaatcccagccctttgggaggccaaggcaggtggatcacctgaggtcaggggttcaagaccagcctgcccaacatggtgaaacaccatctttacgaaaaatacaaaaattagccgagtgtagtggcacgcacgtgtaatcccagctactcagaaggctgaggcaagaaaattgcttgaggctgggcgcggtggctcacgcctgtaatcccagcactttgggaggccgaggtgggcggatcacgaggtcaggagattgagaccatgctggctaacacggtgaaaccccgtatctactaaaaatacaaaaaaattagccgggcgtggtggcgggcgcctgtagtcccagctacgcgggaggctgaggcaggagaatggcatgaaccagggaggcggagcttgcagtgagcggagattgcgccactgcactcccccgcctgggcaacagagcaagactccgtctcaaaaaaaaaaaaaaaagagaattgcttgaactcgggaggcggaggttgcagtgagctgataccatgccactgcactccagcctgggcgacagagaaagactctgtctcaaaaaaaaaaaaaaaaaatactgagtcagatcatggctcttccctgctcagaaccctccatggaattgaaaaccaaatctgaactcctccaggtgtcctgcaaggcccccacatgcctgtcccctttcaccccctccagtcacttctcccaaccccactggcctgctccctcttcctccaacacagcaggctccttcgcacctccggcctttgaacctgctgtgctctttgccagctgctccccagctcatagagcccctcctctgagaggccctcctgactcccacatcagaaggagtccccttcccagcagtggctccatgtcagctcacctgcctcgtccccttcctagctcttctcgccaccccacctcttccatgtgcttctccatggcccatccctcctgctaaagcgtagctgccgtgagcaggaccaggtctcttttgtccacggctgtagctccaacacttggcacgagacctggcccacaatttgtgagcagtaaacatgggccgaaaggatgagtagctttccctgccacttcagccctgggggtccctcctcctcctcccacagtcctgtgtgccccattcaggtggttcataaacagctgcccggagcagattctccactggggtttgtcccatctgtaaaatgagggttgtaaatgtgcccaaacagctggggatgaatgcaaagcgccccacgccccgtgtcactcccagccaggagcaagagggcaccatgccagtgctgcctctggcccaggcagtcacctgtccaggggaaacaggcctctaaggctccaatggcctcacgcactggagttcatcaataacacaagccgagaaagccccaggaaagctggagacgctgccggaaatgcaaagctgctcattcttccatccgtcccagctaaaggggttcgaggaagctcctccccacacacctcccagggtggaaggggacctcatatctcagcggggctctggccctggccccagcatcccagtccctgtctcttctccctgcccccaccaaggacacagatgcccaggcctgctggcagcttcatcacacttatctgcactcccaagccacagattacagctgtcaggcccagaggaaacgtggcggtcacatcaaccctgactctgaaaacagccctgaaagacacaggggtgtttccagcacagcaaggtcttactggaaaggacccctggaccccaatgtcctagaggtgtgccccacgaccccacatgcccctcttcactgctctggcctttgggaaacacagccctgtcctttacaaggtcctatttgcaaagcctgctgggagacagaggcccagggctcggatgaggatgggttctgtgcgggaacaagagatgccaagatccacctaggtgccccagccaagaggcagaaaagcatgggaaccgtgtgcccttgtgggacgtgtgccacggacgggaaggatacgggtgtgggtccccctctgtggacgcaaacatgtttattgcaggaaggaaaaacaaggaactattaacccaagtcacctctggagcaaagaccagctggggccaggggagcagtgtcgtgctgtgatctttccagaaggctgactctttttccgtacacttttaatttgtttgatcatatccctattttaccttccttatttttaatgccagccagggctttctgggtaagagctgggcacacccagggagaggcacgtgaccatccgcagctgctctccttggcctccagtttgttttgtttttgtttcttactttctgtggagatgggggggggggtcttactatgttacccaggctggtcttgaactcctggcctcaggcgatcctcccacctctgcctcgctaagtgctgggattacaggcatgagccactgcgcctggccttgacttctggtttgtgagatggaagaacattggccccatgtgcagaggtggaaatcggcttttaggaaaaaagtgagtttccacaggacccaagtaatgggacctggatttgaacccagagctctgcagatctgaggattgggcacctgcacacatagtgctggtctgaagcatgtcccctgccaaattcatgcccacctagaacctcagaatgtggccttatttaaaaatagggtctctacagatgttaccaagttaaggatcccaagatgagatcatcctggatttatgaagggccctacatccaagctggaggccctccaagcccaagctggtggggtctagccccagtttgctctgtgaccctccaacatggccctcaaaatctctgagcctcagacccccacctgaggacttatgaaaggaagaagactcaaattcacacctcagaaaagcacatgagaacaatgctgcaccacgtaccctcactgagaccccagacattctcgaagactaaatcgtctcaggtgctggagaggatgtgagagctgggagggtgaacagcagtggcccttctggaaggcatgttgggtgaaaatggctccccctctgccctacagcaattccactcctgcgcatccccaggaaattgtggagaagtacaaggcagcagggtccagcatatttgctgtttgtggaggcaggagtcagacataaccaaggtacccccgtcgctaagggaataaatacaacaggatgaacatgaattagggggtccaggcagcagaaggaagcaataagcctgatacacacataggaacacggatagattttaaacagggcagcacgaggaatgttgacacgagttaccgtgcatggcatggaaaagccgccctctcctcagacgtgacaggccacatgaagggggcctccctgtgccacccccagctcaaagcacttccacctctagctccctcggtcctcactgaatcctataggaaggcatggttttagcccattttataggcaccctactattatgagctgaacagtgtccccccaaaattcccatgttgcagccctaaccctcggtgcatcagaatgtgactgtattggcgcggggggcagggcctttaaatcggtgattacgtttaaatgaggtcagtggggtgagccctaatccaatctgactgacgcccttaaaagaggagattaggacccgcagagagtcaccggggatgtgcgcacacagggagaaggtggcgtctatgaggccgggagaggggtctccggagaagccagccctgccaacatcctgatctcagacttccggcctccagaactgtacgggaatacatggtctttggcccatgcacctgttatggacatttttttctttctttctttcttttttttttttttttgagacagagtcctgctctgttgcccagactggagtgcagtggcacgatctcggctcactgcaacctctgcctcccatgcagactcagacacccaccagagaccagagactcgaagagcctgtccatggtcacacagcagcaggaggcagggccgggatctggacccacacctgcaggctccggaatctaggactgcacaaggtccaaggacacactcaggtttacagacgcagccacacagaggatgggcgcaggggcagggcgggctgaagagcgagaggggtgaggggaaggagggcataaaaggagaccactgaaagcagaagccaagcgagttcccgaacatgcgcgctcccagcagcaccgctcccggcagccaccagcccagacgcccatccacagaggcgcggaaaaacagcatgcagtgcacccgcaccgtggaggcctgctcagctacaaaaaggaaagcagcactccacatgccacaccacggatgaaccccaaaacatgacgctaagcggaagcagccaggcacttaaggccacacattgcatgatttcatttataagaaatgtgcagggccgggcacggtggctcaggcctgtaatcccaacactttgggaccgaggcaggtgtttgacctgaggtcaggagtttgagaccagcctggccaacatgtgaaaccccgtctatattaaaaatacaaaaaaaaaaaaaaaaaattagccgggcgtggtggcgggcgcctgtagtcccagctactggggaggctgaggcaggagaatcgcttgaacccaggaggcggaggttgcagtgagccgagatcacgccactgcattccagcctgggtgacacagcaagactctgcctcaaaaaaaaaagaaatgtccagggccgggcacggtggctcaggcctgtaatcccaacactttgggaccaaggcaggtggatgacctgaggtcaggagtttgagactagcctggccaacatggtgaaacccgtctctactaaaaatacaaaaaaaaaaaattagccgggtgtggtgacaggcgcctgtagtcccagctactcgggaggctgaggcagaagaatcgcttgaacccgggaggcggaggttgcagtgagccaagattgcaccactgcactccagcctgggcgacagagcaagactctgtctcaaaaaaaaagaaagaaagaaagaaagaaatgtccgtaacaggtgcatctgtagagacagaaagaaaatgagtgattgccaggggctggggagctgcaaagagtggagaatgggcaattctacttgggagggatggaaatgttttgaaactaggtagaagtggtggtatcactgaattattcgatttacaaggattaattatatgttatgtgaatttgaactcaataaattattaaatgaaaaacaaatgataggattggaaacgctgcaaccactttggacaagagcttggcccttctccatgcaggtgaagacacgcacgccatgaccagaccccctactctgactgtcgggccctagagggattcaggcacatgtcccttgcaggcagggacacgagtgtgtcataacccagaagtgaacacagtcaccggcatcagggttaaaacagatgaactggccgggcgtggtggctcacgcctgtaatctcagcactttgggaggccgaggcaggcggatcatgaggtcaagaggtcgagaccatcctggccaacatagtgaaaccccatctctactaaaaatacaaaaattagctgggcatggtggtgcacttgggaggctgaggcaggagaattgcttgaacccggggggcagaagttgcagtgagctgagatcgcgccactgcactctagcctggccacacagcaagactccatctcaaaaaaaaaaaaaaaaaaaaaaaaaaaaagacagatgaactgtgatactcagcttcttccgattagcatcatgaactgtgatatgacatggccatgaaaatagagtgcagcttatcgcagcaatgtgggtggatcccacaaataccatatgaagtaacaccagcaagaccaaaccaaacaaaaatactgagagtatgcctgcatccaagttaagtccaaaaccggaccaaactaatcccggtgtttagggatggctatgagggagtgatactataaaaagcaaagcaagctgggaccaaacacagtgtcttctgcaggggcttcggggcagatgagctttccctcttcttcacgtggggtgattgcatgcatgttcatcttagttacatatttgattgcatatgtcttacactttcctcaaagtgagcaaatttcacaaaaaacagaaatccaagactctgggtggaaagtgcaaagcgaggggttgcagcaggtggagtccaggagcctgggaacagacagtggaaggaaatcccaaggacaggggagacttggctgttcccagagctgccaagggatcctggctgcaatgggctctcggccaagtaaggccagtttgacctccacctgcctgccaggaggccagacagggccaagatgatctggcacaagaatttccacaaggctctgaggcctgggcatctgggctagtggctgccgggaggcccagttagggagaggcaaaacaggaaaagcccccacctgccactccatccagcctcccgtttccacccgaccagccctgagaccccagggtttccacaatcttcctggcccaggggatgagtcagggatcagatccgccatctcttcccatgtgatggcactggggtgggcagaggctggccgagggccgctgaaggatggacacatcaccgctcaaaggcaaggaatgagagccagaaattttagaaagcaggtggaggaagggaccaggaggaattgcaggcttcttcaacccaagaggttcagacttgcactgtgactgccaggctgggagctgggggaggatccaggcacccaaccccggctcatcagaaacactctgctccaatctgattcacacaatgaggcttttgtgtgggagtctgtgggaagaccacgtgcactcctgagaaagcaatcagacaaatccaaatcaagggccatcctgccaaaagcacccgcctggcccctttacagatgccagtgtcctgaaagacccagcaaagagaaaagggctggagaacaggtctggattaaagaggaaaaacacatgaggcaaccagacacagcatgcaaccttggattcaaaaaaaaattttctttttctgagacggagactcactctgtcgcccaggctggagtgcagtggcacgatctcggctcactgcaacctccgcctcctgggttcaagcgattctcctgcctcagcctcccgagtagctgggactacaggtgtgcgccaccatgcctggctaatttttttacttttagtagagacagggtttcaccatgctgcccaggatggtctcaatctcttgaccttgtgatccacccgcctcggcctcccacagtgctgggattacaagcgtgagccaccacgcccggccaattcaaaattttttaatgaacaactatgacaaaaagtgttattggggccgtaagggaatctgaacacagactgtcagattaaaggtgtggatcctcgtggccttcttgagtggggccgtggtccacggccatggagaaggacgtccttgtccttaggatgcacccaaaaggctcagcaacgagagagagaggatgcacatgcagcaacttgtacttttcttcccgtttttacaaaataaaatctttgaaaatagaaccttgggtgatgtggtggtggaagaacacactgggctgctttattttacaagctggatgcctccctcgtgagaacggcagaacgagccgtggtacatccgcaccgtggagcgtttccaggcatctagagaatcagagcgtgatcatcaccagaaaatcccagctgactgaggacgacatggacaagcgatgacagcgtgagaaacccacggtgcagcaaagcgtgcatagtatggtcccatttcagcaaactgctgacagatggatccctctctatgtctgtgtctatccggttaagatgttggaaacagccagcccttacttgacacttgccgagctgctatttgaagtgtgacatgtgccaattctgccaccttaaaagccctatgtaggagacacttttattaacttcattttacagaaaagtaaaaaaggcacagagagggtaagtcacttgcctgaaggcacccaactgggaagtggccaagccaggatttgaacctgggctgcctgccttcaaagtccatatgctggggtccacctgagctgctggaagctaaagccctgccaaaggctggagagaagcctgggatgctgctgggacacactgcagggtaaacccagtggctaggattccagatcaactcctccacgggtgcatctgggcagctcatccctcccacccctacctcatcccctctctgcccacggcacacccctgcagcctctcaccttgggtggacaaagcctgaactttggcacaccagccctgatatctccccaactttttaaaaaatgcctcatcccagtcctgccgccaggatgtgaacaggcaggggtatcaatgggaccctgggaactttctgcctgaagaacattcgttagtgacttcctccggcacccacccaggccccttccacccttgctgcccgggccctcctggcctccatccagctagcctgggacagtcggccccacccagcactggctgctaactatctccgtggccttgagtaaacctctgctacctacagaatttggtttccaaaggaaaaataaaagatagaactgagcttcggaacccaagtcagtccagatctaacaatctgacagctgatgaaactttccccgttagagcaattaggccaggtacagtgattcatgaatgtaatcccagcactttggaagaccaaggtgggaggattgcttgaggccaggagttcaagaccagcctgggcaacatagcaagacccctgtctctacaaaaaatctaaaaattagctgggcatggtggtgcacacctgtagtcccagttattcaggaggccaaggtaggaggatcgattgagcctgagtggttgaagctgcagtgagccgtaatcatgccactgcactccagcttgggtgacagagtgagaccctgtctcaaaaaatctaaataaataaataataaagggtgggcactgtggcatatgcttataatcccagcactttgggaggccaaggtgggtggatcatttgaggtcaggagttccagaccagcctggccaacctggtgaaacctcgcctctactaaaaatacaaaaattagccgggtgtagtggtgggcacctgtaatcccaactactcaggaggctgaggcaggagaatcacttgaacccgggaggcggaggttgcagtgagccaagatcatgccactgcactccagcccgggcgacagactgagaccatgtctcaaaaaaataaataaataggccgggcttcgtggctcacacctgtaatcccagcactttgggaggtcgaggtgggcggatcacctgaggtcaggagttcgagaccagcctggccaacatggagaaaccctgtctctactaaaaatacaaaattagctgggcacagtggcgcagcctgtaatcccagctacttgggaggctgaggtgagagaatcgcttgaacctgggaggcaaaggttgcggtgagccgagatcacaccattgcactccagcctgggcaacaagagagaaactccgtctcaaaataaataggtaagtaaatataagtaaatacatacataataaacagctggtaagctactacctcctcaagaggccttggtaaacagaatagtcagccaaacaaaataatctctaatactgtaacagccagagacagtgaaaggcaatgtggggatgaagtgggaagctacctgggggcaaaggggctcagccccatttttgctgcctatggccgcctcttcccccgacaacagcccctcctttttgccttttgggaaccaccctactcctacctgagtctctgtgggcaagaactacttccctccctggctccaaatgggcaggcgacccaaggctgaccaatcacagcagtccattactcgagccacagcaattggtccaaggatgcacatgtgatcccagctcagccaatcacagccaatgagcattgactccataagttgtgccagccactgagaaaattctttaattctccttcaatatccctcaggaaggttcccttccaagagcttctgggaattccaaagcagtcagtttctccctgacgtggtgcagatgccatttattttctaagcgtcagaggaagccactggcaagtgagactggggcgtacatataaaaacataggaatctaattctagaatcgcattcagcctgtccagatgccctgtcacgggacccaggaagaacagcagggtcacaagaaactcactccctacattgacactaaccaagtctacttatgagggtcactgctgttttcctttttttttctaattgaatgcatgtagatgattttgcatgaatgacatgcttatgggccacacctccacattcctgcacggagcaaaatcacaagcagaatggacctcggtctcctgactcagcctcgcacagtcctgctaatgagaacaaagtgaaacataaaggattccatttttttttttttttttttgagatggagtctcactgtcacctaggctgaagtgcagtggcgcgatctcagctcactgcaacctccacctcccgagttcaagcagtcctccgcctcagccttccaagtagctgggactacaggtgtgtgccaccatgcccagctaatttttgtgtttttagtagagatggggtttcaccatgttggccaggctggtctcgaactcctgacttcaagtgatccacccacctcagcctcctaaagtgccgggattacaggcatgacacctgtaatcctaacactttaggaataatgtaataatggcgcccggcctataaatggttccattctaaataatgaaccttggcttaaatgctcagggagagaaacactcccagccccagccccatccaagacacctgatgggaccaagatgccaacaggaggatccctgcttcctcctggaggcaggaggtggccccagaaacagcctccacgcttcctgtggcccttccaccatgacaggtgctgtctctttacccaccatccacagacagccccgatgacatctttatacacccgcatcccttccttctggctactccaccttcatgctggggcaggaaaggggtcaatcaaaagccaccaaagctcagacagggaaacagcccagcactggaaccaggcagaagtcattgaaatccagatggagtgtgttaagactcaggcctacaatctgtggatgcatcccagggacccaggctttggggtgttccccagggcgtatgacctcccttacccctcgctacagcccgaggagggaggcccggagaaacacgcccggcagggttatgcaactcacccacagccacagagacaggaagtgcaagagccactgctgaactcagggagtctggttccaaagtccacgctgcggaggacccccactggggcctctctgccttagcccaaggtcctacgctaggtggttctctgccctggacaagggtctccaactatggaatgcagccatgaacgagacagataaagtctctgtcctcatggaactcacacaagtggatgagataatttcagagactattaagggctcagaagggaatagcatggtgtggttataacacagatggcgcaagccaggcgcggtggctcatgcctgtaatccaagcactttgggaagctaagacaggtggatcacctgaggtcaggagttcgagaccagcctggctaacatggtgagaccccatctctactaaaaataccaaattagctgggcatagtggtgcacgcctgtaatcccagctactcaagaggcaaggctggagagtcgtttgaaccggggaggaggaggttgcagtgagccgagatggggccattgccctccagctgaaaaaccacacagatggcacagacagtggacgtggggggcaactgtccattgggtggggtgggcaatcacggggtgtcttcttcaaaaggttacatttaagcttcaaaaggttacatttaaacataaaagaggaaccaagcataagagccagggagacaaaaagacggtccaggcagaaagaaaagcacttccaaaggccctgaggcaggacagcatgtgacacgttggaggaaaaggaaggcctgtgaggttgcagtggggtgagaatgctgagttgagatgggcagggcccacgaaaatgaggctcacagctttgataccaaatgcaggaagattttattcagcttcttgaaatgatccagtttgcatagttttgttttttttttttttttttttgggagacggagtctcgctctgtcacccaggctggagtgcaatggtgcaatctcggctcactgcaacctccacctcccgggttcaaacaattctcctgcctcaacctcccgagtagctggaattacaggcacatgccaccacgcctggctaatttttgtatttttagtagagatgaggtttcaccatgttggccaggctggtcttgaactcctgacctcaggtgacccacccacttcggcctcccaaagtgctgggattacaggcatgagccactgtgcccggcccaatttgcatgttttaaagagcatcctggctttgatggggagaagtgacaacagtgtggtataaatcagcagagcaaacagccccatgatgacactccagcatccactgggaaacaacggtggcagctcggtctggggcgacggccacggcaggtggaggagtaggccccattgccctgcacaggaccacaacctgccactggtcacgaaccatcctgtgaaacaacccttgtcttttaaacatcctttcaataaatatttgagaacctgcgattatgtgctaggcatcgttccaggggcttgggtcacggcaacgaataacacaaaggtccctgccctcacagtccgacattctcatggggagaaatagacaataaacaatcaacatgatacccagggaagttccagggtatctacagtggctgacaggtctaagcagagcgggtaaggagggctggcagcacagggggacaagggggaacctgcatgatgcacaaacggaatcaggggagggtctccgtgagcaagtgagagctgaacagagacctacgggagatgagagggcttgtgtcaggagagctaaggcgattgggcccatggggctgaggaatggccaggaggccattgtgcaagggaaaagggaatgcggacgtcgccagaaaagtggcaggggtggatggcacaggccctgggccaggttaggacctggctgtgactcctaggggacgggtctggccatgtcagggctttgaggggaggaggtgctaagtgcaatcttgatgggctcccatggctgcttattgagaaaccccactggggagcaaggatgagcacagggaggccagtgaggaggcggatgcaggaatctgggggagaggtgatggtgccttggaccagaggtgatggcgcctcgggcgtggtgagaagtagttggaatctgggtatatttagatgatgaagctagaaaactttctgacgggttctctgagggaagtggagagaacagagtcaaggctgagtgcaagatgttggcccgggcaactggaagatgggggggctatgatggagtgggaagctggtgggagccacaggtgtggccgagggtgatgaggagccagccggggcgagcgtgagctgcctttgaccccgagttgagatacggactctgctgttggacactcgggggtggggttcaggggaaaggtctgggcccagggataccaatttgggagtggtcaggacagagatgccattcaggcgcaaggctggaggagcccaccccagggatgagggatgaggacacacagaaaggatgcctggagctccaccagcaggaggcaggaggccagggagatgaggaggcatcagcaggcaagaagacagagcagccaggaaggtgggaggaaaacccagagaatggagatttaaagcgcctcaagggtccttctagaagcttccagagaaggtgtaaggaacttcacccaaaatgccaggaagtgaacaaggtcaggcccctcccgttccttccccctccccagcacaggcaatcagtgaacaggaagaaacagtggagtggagggaaagaaaacaagaaaattaagacggccaggccttgggccatgaggcttcctggaacccgggacctggggagcttctgagcaggcggagtgtctccatatctcacgcaggctttgggaggaaaatcgcccccaacacccacagggagccagcccctgggccctttaaggcttcaaagtcaagaacgcagctttttgtgttgtttttgtttctctttgcaagacagctccagcctggccacttgtgggccagcagagctcaaggtcatgtccaaacagggggagggagacgaggtaaataaaagggattctctttttgttttgcgtttttgatttttgactgagccctagcgttgaattctccgcacaattaatgtgtctgtggtgtcggagctgccagcgcctcctggagcagaaggcctggaccgaactctcctccacagaatcctccaggcccaagatttaaaccacaaactctctgggttcagccttggggggtgtggcttatggccccaggggcctctcttttgctgaccacagacatggaatcaccctctggacactaaggaacctccatgcaggacccacgaatgacagtgccaacaagcctgcagcaaatcgccactggggccaagactcatccaggaaaaacaccttcatggagcaagccctccatggggactcacttccatcccatttgctagaaaccaaaggccagggtaaggcgattccaggtggctgagcttcgccacgttctagttaatcagggtgcatctcccggcggaggcacagcaagtaccggccattccgggaagggacagggaatgtttcctggaaaccccaggtgctgggcctggccccagaaaggccaaccacagcgggacacatcaacatgtatgtgcagacacatcaacacacaaggacatgcataaacacgtgtgttcatgtgtgtccatttgcatgtacagacacaccatgtgtgcctgtgtcaacatatgtaggcacacatcaacacaggtgtctgcatacacatcatcacgtcgtcacacatcaaggcaggtgtgtgcatgcctacacaggtgtgtgtgtcactgttttcaccatcagcacttgtgtacacacaccaacacacgtgtgtgcaaacacacacacactcacgaagacagggagaggcaaatctaccaggagcaaataaactagactcacacaaactaaaaatagcccatgtttttcagccgtcgccagggagtaagttgaagctgtctctcacatgctagaaggagtaggaagttcaatggcaggaaagaggaagaaaaacaaaacagaattggcacacacctgtgatccaagctgtcctcgaggagccccctccccacctgtgcccagtgatcagttctagggctttgccccacatgtccaaacaagggggtcctacaggaaacgcccggtaggtggagacactgggcctcccccccaggttccgcaggggggctgataaaggcgcagagcgggcggcccctgcaggatgggtgggagtccagcccccggggtcactgggagccctgggctaggaacaggtggcctccccgggagcctcacttggtgcctttgattggagaacatgtccctggtctcagactacccccggaagggagaggccagggtgcactctgcaccagcaaagtttggcggggtgatgattaggacaaagcctcgaagggaccctgctgttccctggtgatgcacagaaaaggaaggggcagcccaggaagagaatataagaagggcaccccccgccgcccgccttaagcatgcagtcgacctgctcagacacacggagaaccgggaggacgcagtgcgcagaggccaccgggaccagctgtggagtcggcccccagacttgaaatcctgattcaaccgcttggagctatgtgacatggggcaagttactttccgcctctgtgcatccatttccctcaataaaataagacacaatagtacctattttagatactaaaatgaataatgcacataaacacttggaacagtatccggccacaacgagtgcccattgactgttatctcccatcaacccccatcttttaactgattgacaaagatttcccaaaaggcacaaactcagggacagccggtgacatccctggctggccctggtgccggggctccccaaggctcactgtgtggctctggctgagggaggcaggggtgagctaaagagcctgaggccagggctgggggtcgcgcccgcctcattcattctgtaacctgactggtgttgaaggggtggcaaggagctcaggcgctgctatggccctcggggacgctgcagtgacagtgatgggaaagcccctgcctcagcagatacaggggtatcaggaaaaaagcatgcaggcaaagatgaccgaaggtttttgcctctaccccaggggaaacaaaaggaggtgccgtttattgagacagggatcataggtgggggaagcccagcagcaggacaaggcaaccgaggttgagtccatctagaaaaccaacttaaagacagcagaggggacccaggttctctcctggacatggaagaaggccatgaggcctatcattgaagatggtggtcttggaagatgaccccttccctgcagcccagcagtagtgaggggcctctccccacgtccaccagctgggccttccttggaggaccagagacatacgggaacttggatgtgtgccccccaggacctgaaccaggccttcgttactcacccacatacctgagcacagctgcatgccaggctcagatccagggaatgggagcaagagtccccattctcatggcatctgcctctgggacagacagacaccttcacacacacacacacgtgcacacatgcacgcacacacatacactagcgaggtcacttggggcaaattactctcttcagcttgtctccttaacggacactgaagacaataaatcatatgtcacggccctctgcagggactaaatgagacaattttcacaaaggtgctttgaaccctgcctggtgcacagtaagctgcccatgaatggatgccatgaagttcacaatcgcggcccttagtgtgcctgtccaaacacctctctccaatcctacccactggcagaagggaaaagaaatgagttgcgcttccccaaagcctctccaagcaacctcgaccacagggcccctttgcagtgtgcctcatcggtctgtgtggcgcattcatctggccagtctttgaggaaaactatgtatctgttcattcgtaattttttttttaagagatgggattttggccgggcgcggtggctcacacctgtaatcccagcactttgggaggccgagacgggcggatcacgaggtcaggagattgagaccatcctggctaaaacagtgaaaccccgtctccactaaaaatacaaaaaactaggtgggtgcggtggcgggcgcctgtagtcccagctactcaggaggctgaggcaggagaatggcgtgaacccggaaggtggagcttgcagtgagccgagatcgcaccactgcactccagcctgggcgacagagccagactccgtctcaaaaaaaaaaaaaagagatgggatttcactttgttgcccaggttggagtacagtggcacaaacacagctcactgcagcctcgagctcctgggctcaagatatcctcccacctcagcctctcaagtagctaggactataggtgcatgccaccatgcaccagcttagttttgttgttgttttgttttgtagagatgggggtctcactatgttgcccacgctagtcttaaactcagggcttcaagtgaccctcccacctcagccccataaagtgctgggatcgcaagtttgagccaccatgcttggccttgtaatttttaatcaaacacgtagcatgtggatacattttctctgttaaaacaaaaataatggccgggcatggtggctcacgcctgtaattccagcactttgggaggccgagaggggaagatcacaaggtcaggagatcaagaccatcccggctaacacggtgaaaccccatctctactaaaaatacaaaaaaaaaattagctgggtgtggtggcaggcacctgcagtcccagctcctcaggaggctgaggcaggagaatggtgtgaacccaggaggcagaggctgcagtgagccgagatcgtgccactgcactccagcctgggcgacagagcgagactccatctcaaaaaagaaaaaaaaaaatagcattacagataaagtattaggtttcctttggccacacccccagtgtcctgccttctctcattagagtagccacttctgttagtctcaccttttcccaaactttaacatattctaatattaagccattgaaaataatggcagggcgcggtggttcacacctatcatcccagtgttttggaaggccaaggcagaaggatcacttaaggccaggagttcgagaccagcctgggtaacatagtgagaccttgtctctacgaaaataaaaataaaaatggaaagaaaatatagaatattgtttggtgggttttttttaaacataaatagcaccagagcttttttcaattagtaatgtgtttttatggcctacccatgctgagacatatttctaagttccttcatttttttttttttttttttgagatggagtctcactctattacgcaggctggagggcagtggcgtgatctcagttcactgcaacctcagccttccaggttcaagctattctcctgcttcagcgtcccgaatagctgggattacaggcgtgcaccaccatgtccagctagtttttgtattttttagtagagacagggtttagccatgttggccaggctggtctcaaactcctgacctcaggtgatccggtgaataatgaagacatggttcagatccctgggggcacacatccaagttctgtgaaaaggacatagacatgaaatgtggacaagaagccattcttaagaaattcagtctaaagaagcaggccaaagggaaaaagatgtcaactagtgtgacaatatccacatcttcaccccagctcatcattgaagacagcagcctcggaagatgagcatcccttttttgcagcccagctgcagtgaggggcctctcccccatgtccaccagctgggccttccttggaggaccagagacacacgggaacttggctaccaaaaaatggtaatgataaatcagtaattaccagtgatggcagagataggggaagtagcacagtcccataccttgtgggtggatgcagcaacagagctgtgcagaagggcaatttggccgtaatcatcaaaactcaaactgagcacacctgctcccaaggccccacttctagaaatccaccctatggaaatgttcatgaaccacacgaagagggatgtgtcgggatatcgctgtcatttgtgacagagaaaatgatcagtcaatggagaaacaggtaaacaagtctataaccattcaaaggaataccagcagtgatgaaggaaaacgcggggtagacttattgctgagacatggaaaatttttcagctggtatctttgaattgaaaaacaaattgcaagataattatacatgttcaagttcacctacacttagttcaagttatgtaaaatatatattaatatgtatacatacaggctcctggtacacagaaaagggtctagaaagatccacatcaatgatggtgataatagctcaggaggggaataaaatgggggaaactttctctcttttcctccatttgaacttttttttacgagcaagtattcatatattttatataaagtcgtccctcaatgtcagaggggaattggtttcaggacccccatagataccaagatctgcagatgctcaagtccccgacataaaatgctgtggtatttgcatatcacctatgcgcatcctcccgtattctttaaatcatctctaggttacttataatacctaatacgatgtaaatgctatgtcaatagttgttatacagtattgtttttatgtctttttttagttgtattgttattttggggggattttttctgaaaacttttcatctgcagttgattgaatccacggatgcagaacctgcagacacagagggccaactgtagggacttctgttgttaaccaaaaagcacattaaaaaaaaaaaataaaagcacaaggcctcccattcaagttgcacacagactcatgtagccaaagaaaacaccagcgggcagtccctgcttatgcgtgtgtctcacccgcctggtcccctgaacacaggctctcttcttccatgctaaggcacttggccgctgctccagcctgggcggttccagaagtggccgtcttgggctgggcgtgtcttcctgccttcacaccactcggccccaaaccaatcgcctttgggatatccacagaaggatgctgggaggctcctgttcaactttaagccagatgctcctagctccaggacaattgaggacaatgtggttttcctctttagaagcccaggagaggagtggggaaatttggtggtgcatgcatgtgtggtgcacacacacacacacacatcctactgacatacttaacctgatgacatcctgagaaagaaaacaccttgaaataagcccccgaataactgagttggcaagactctttacctggcataagtccccacactcccatagcaagagaccaggtgctcactcacagcacagggtcacatgcttgaactgcctgagtgatagcccctctagggaccctgcatacacacagtggggtcctggcactgcagcagccacaaggctgtcactgacacacacgtttcagtatgagtaggccacagaaaaataaagctccctcagtgtaacagagaaagcctctgagctgtcatgggggagaagaggccattctgctgattttcctgccatccccagagacagtgtcaccatccaccgggacctctttgcagtcagattacaggctttggcgggacaagatttgaaaaatcaaaaatagacacaacgtggctaagatgccctagacaactgctcacccagagaccttgagagagaccatatgttgctccatctttaaggccagctagctgggtcccaagaagtgtggcagccagatctaagcagatccttcattcattcactcattcattcgctctgtgaatgagggaacagacatgaaatgtggacaaggaaccattcttaagaaacccagtccaaagaggcaggccaaggggaaaagacgtccattagagtgacaatgtccacatcttcaccccagctctgcatctggctagaactttgataagagtgagccccagtttcccctccccgccactgcatgtgtgggttcccagggcttcaaaactctaaatggcttttagttcaaatgtgatactctgcaatctcccagcccttccctaactccaggctcattcaaacaggccacccaggcacccagggcagagtctgtccgtctgcagaccagctgaccgcctaatctgtctccctggttgaaagggcaatggtatgcaaagttaggatcagaggaaagacctaaggctgcgtgcactcagaggaccttgggctgctgcctgcctctgcatgaatctggggagaaaagcggcttatagtttccagactgaatcatggaggcagtgagcagggagaacagagtcgcgcattctgcctctgggagagggttcctatggggagattctgggcagtggaggatgctcagctgagcacctaccatgtgagctgggcacccacgtgggtctcacagaaggttcctgtcctcctgggctcacaggatacaagcaaagtgcagctctaattttaccggaccctgctaccggctgctgtgaaagcagacgttcacacactcttgggctccttcgggcggcaccacggaagcaacctgtccacactcctgatccgtcgtgggcgcccagaccctttagggcgggtcaggcgcccgggtggtctcccgtccaggcctccccaaccctggcctgcgcctccagcaaagcccctgggttcccccctagcctcagtctggggcggtgagggtggtggggaggcgggcagcagcccctcccgaagcgcctggcctccctcgtgctctgcggcgccaggcccgggcgccgattccgctgcggtcgcccacccaccgcaacgcgcgggtcctcccggcgcccagcgcccaacagcccgggtccgtgcgcggaccccctggggtctccctcacccaccttaaggacctgctgcttgatgagcgacggcaccatcacgatcatgacagcgcccagcacagcgcacagtagccccgcgacgcccagcgccccggcagcccagcgcgctttggcggagcagcccatgtctgcgcgcctggggcccacccgcggctcgcagggctccgcgcctggcaggagacggggacggcgacagagacgacacaggcggggactccgggcacgcaggccgcagaggcacggtggatccgggacggcagcgcacgcaggagcagcccggcaggtggccagtggttttatgccccatcgccggcgccgccggaccgcccccgggcagccttgggcttcaggattccggcggcaggggcggggcctgagc

SEQ ID NO: 270 - DNA, 86346 bp, Homo sapiens; identical to SEQ ID NO: 269

SEQ ID NO: 271 - DNA, 812691 bp, Homo sapiens
ttccttggagcctagcggctctccccgcgtccaagatggcggcagaagcagctggtgggaaatacagaagcacagtcagcaaaagcaaagacccctcggggctgctcatctctgtgatcaggtgagggaggcaggaggcagggtctggggactgggggcagcggctcgacctccgctttggaagggagaagggttagctgggtcccaccctgctctcccctttcctccttgcctcccgcagcccctccccagggctctaacccctccccagggccccagcaattccccctccaccttttttttctggggttagctatagagagaggagccccgcctcagtcttttctttaggggcagcaccttctattacagtctcgggaccccaaagcacgctatttgggtttggtagagaaaaccaggtgtaaaggtgtgtttattgattcctaaaatgcttgtttattgtttgcctgtagcagcactcactgagaaaggcgtcttgtttcctggactttggggtgtaaggccttggagtccggagattcctgtcacgagttgcagatttgtgttttcacactctggatactttcaaccacctgtgcgtggccacagccacaaatacaagaatctgcagtgagctggtaggaggactgggtttgaaggcacacatcggttttcaattttttgccctgcctccgcattctggtccattccttaaaaaacagaaccaaaccaatttcaaattatcctccatgcactgcccctctgcacctcccagaagattagggtgggggtggagtgggagcggtggatcttttaggagcttttttttaaaaaagcgaaatatattgaggatgggggaaccctttcaagaatcttggatatgatgcaggtactgactaaaaccaatctaaataaaatttattatggcacgttttttacgttgttggcatttgaatttcaactcgtttatttttcataaacaaacactctatttttccccacctatactaaacttttgtttgagttcttgcaagttttctggaatgtattgatcatcttttcaaaacccagggcccaacattatctggtaggtactaagcacttcaatgaatgcatgtatcaaaccattagaacagcttaccactcactgacaaagacacatcttatgggtcttatttaggaggctttaagattatggcctattaaatcattactttaattttcttttgggcttaagagaaaaacatctctgtgtggaaatgcttaatatacttggtaggccatacagaggaagtgctgttgtattgtgaatctataggcccacattctcgctgtgacaatacgcaggtagtgtagatgtatctcatgatactaaaattccaataagaatgtttgttgtttcccatctgaatttcctgtggaattagaataccaggacattatttggatccttttttgaacttgtttgttttttctaccttatagtcaacatttatttaaacaataggtatttagtgccagttgacagtatggcgtctggcacgtattacatattgaataatatttgttgacttaatgagtaaatgccctgagttttgcaaagatgaagcaggcacagtgttacccttgaggagagtatagtttacctgggggataaaacatgtcagtaaaaatgatgacataagactacgagagagacatgaaatgttatggaaatccaggaggagtggctgtttctaatgaaagtgaaatgtgtcatctcatctgtgtacttttgattctccaggctgttcccatttcttttatgctatttgtattttcctcagggccagttgaatttactctaaatgtcatatttttgaaaacagcatgaaagccaacctaaagctttttttactaatgctaattcagaacatacattgcctttgcttgaccattccttaatattctccaggaggaaccccctactgcttgatggctaagattttgtggttatccatccatctcttatgccagtttattaatatatgaccttcattttatcactgtgatttaggcctaggtattttttactttgatctctgttgtgcattatattgcttttcttttcttttcttttctttttttttgagacagagtcttgctctgtccccaggctggagtgcagtggcgcgatctcggctcactgcaacctccgcctcccaggttcaagtgattcttctgcttcagcttcccgcatagctgggattataggcgtgcgccaccacacccacctaatttttgtatttttggtagatacagggtttcaccatattggccaggatggtctcgatcgcttgaccttgttgtctgcctgccttggcctcccaaaatgctgggattacaggcatgaaccaccgtgcccagccctcatttttctactttatccttgaccacctcagatcactgcataacacttttgtgatatagtttttacaagcatggtgtaagggaatgtctagacctagtatcctgggcaagtttattaaggcttgggatgcattgttatatatgaccttaagaccgaatggtgttggtgtttgtatttcaacatttctttgagtcacagggagattttggtgttggagtgaggatgttggtagctataacttcctgttatttccttcctaatatgcttttgaacatacccagtggtttaaattttataaacagtggtagtgaatgagaggacaatggaagtattactttggtgtttgggatggggaatggggggagagtcctgcgggtaagagaaccaggaatgtatgtttcttgttagtaaattgtgctgtcacttggaagttgcttcttgtatttctgttcaatttatgtcctttgtgtttcccttcttgcaacattgtattcattattcctttttttttttttgagacgtagtcctggagtctctctctgtcgcccaggctggagtgcagtggcgcaatcttggctcactgcaagctccgccttccgggttcacaccattctcctgcctcaacctcccgagtagctgggactacaggcatgcgccaccatacccgactaatgttttgtatttttagtagaggcagggtttcaccatgttagccaggatggttttgatctcctgaccttgtgatccacccgccttggcctcccaaagtgctgggattacaggcgtgagccaccgcgcctggtctgcattcattttttcttaattcctcatataaaactttgattatctcctcctatctttaacgttgttttcaaattctctcccaaaggctatagttttcctggttgctttggcaacaagccacaaaaaggaaaacccatgttaggctcgtgtttataaggtctgagcattcctaacatgtaccgggtacctgctagctcctttcatgtttccatggacttattttgtcacaaaataaattaccgacagttagagagtctactgtcttttgaaaagtttgatcagtttagctttttaaaaaatatctttttgtatcactgagtagtagtttttcttttttgaatagtgagtattaaaaatgctcctttaattctcttgctcagatgtgtaaaaatgtaatttctgtactacattatgtatcataaaattttgtattttttcaatgcttttcctaacagttggggtagcatttattgttagtcatttttaatattgtattcaaaaaactacaggtggataagggtttgacttaaggacagagtatgtgtaggcatggggaatatccgaatctcatcgctatttccagcccttgtactaaatagttaaataacgactctattttgctagtataaagtatttaaactttaaagcatttaaaagccaaaaataaagatgaagtatagtgtaattgtaatgcaagtattatatgattttttaagtgctttgagactcaaataaaaatgcttaattatttaaaaattatcgaataaaaatatttcagggcagtcagatgtttcaaagggtggacttccagggctttacagaagaggcccttaggcctgtgaggtggggcttaggtgaggggacagatagtggttgggattcagtttgtcggaggctactgccaactgcagcttttggttttaagtcttgccactggccctttaaaatggaactaaccgggggggacagaatcctgattacgtgctgatgtgtgatgtatgatttggacagttttacacacacacagacacacacctacttttctgttgacctgctgatgtacaatttggatggtttacacacacgcacacacacacacacacacgtgcacacacacaatttttctacttttctgttgatttcctttgccaaccttttgtttggtgggaagtcagaggaggcagcctctctagatgggaaataagaaagatggcattttggagatattttatttctgtgagttcttgccagatttttaattgggaaatgtgtctgccacttactgttaggtgatttgctttccaattaaatgttgtgtcactttataacttggcctgtaataaccagtttaattgggaagacaactttggttgtgacttcaggagaccttattgaaaccttggagcagagcttttgaagacacactctggttacagatgtcaaggaggtttgaaggcagtggaaggctcacattttcatcaacttttatgtcttcacagaagttgaaatttcaaaaacttagaaaatcctttactgtagacacctgttaaattcccttcctccttggagagtattttggtcagccctgtgtttaattcaaagtaaactttgttgaaggggtccaggctttgaccagggctttgaacgaacagctttgaggttcgtgacacagtttgtggcaggaaaggaaagtagtcactctgttctgagccgagtcttggaagttgggtgaggtgttaatgttctttccatcaccatctcttcttttcatttgagcccatcacataatggtgtttggtttctagctctctttgtaccctgggacatcttggccctactgatgctgtgttgtttgaaaattactactagaatacccagaaacagtgctttcaggaagtcctgggatgtctggcagcatatgtgaacgtaaggggcaacacaattaccgtactctggctcagaattagtgtcgtggacccatgtcttagtgtacctcgtgtaactgttaacactgggatttcctgaaggctttgaggcctgtagtattgatggtggtggtatggtcaggttttttcaagccattatttgtacatagatgtggtcacagcctgtggtgtgaattgctgtggttgtgtgttgtagttgaaacttgctgtattacctgtgtaaccttggaacagttacttaaaaccaccgcgtcttagtttcctcatttggaaagtgggctaatacaatctgtgtttttttggaacatcacatgagatgagggtatataaaagtgcctagcacagtttggcacacggtaggcactcatatgttcatttcctcctttctaggatctgtagcctcttctgttaagaagattcttttgatattaataaatttgccggatagcaaccaggctataatgttaattttccaccagaaataaccttgacgcgttgactggagtgattccatttgtcaggatgttgtctttgtaaccaggaaatcttgtacagctgaattaagatagtaattatttggtaatttgagagtcagctgaagaagctagatttaaatgcatgtatggttatgtgtgtatgtaaaacatgtaaaatataaacacacataaaatataaaacatttattagattaaaagactgaaaagactataaacaagcaaatcaagggcccaatactctgttgagataatccttgttgtcctttataaaaaggacaacaatattgtgtattgtacaaatttgtaaagacgagtcataggaacattgtccagcaatctcatttcccaaaatattacctgtttttcaggttttcgtatggatcttgtccatgtatatacattttttaaaatattgctatacagtgttcatagttatatatgttttttaagtggaggaattaaacatacagaacagtagggaagaaaaaatcacccatagtttaatttcttttttttttttttttttgaggcagagtcttgctttgtcacctaggctggagtgcagtggcgccatctcagctctctgcagcctccgcctcctgggttcaagcgattctcctgcctcagcctcctgagtagctgggattacaggcaccatgcccagctaattgaatgtatttttagtagagacagggtttcaccatgttggccaggctggtctcaaactcctgaccttaggtgattggcctgcctcggcctcccaaagtgttgggattacagacgtgagccaccgtccccggcccacttgtattttcttcaccagcattatccactattaatacttttgcttccagtttaagaaaaaaaaaatcactctattgttttaaaaatagtactctcatgataaataattcaaacagtgaaaatgcagaaaaccgtgaagatgaaagtaagaaaaattatttcagattttatcctcctaaagttattatcattgatattagatgaacctaatcccagacccctcccttttctatgtgaatgtatgtgtgtatatgaaatgttgatggccagaaataattttttattaaatatgggatcttactctatatactaattttatttgtcctcctttttgaggtatacatgtatatgctagagtgcacaaatcttaagtatatggcttgatgaatttttacctgtgtaaccactgtccagctggaaatacagaacacttccagcatcccagctggagatacagaacacttccagcatcctagaatgatccttctctaccagttttttccagtacttttttttttgtgtgtgtaaggatatccatttccaacaccacttgttaaaaagactatcctttctgtatttgctttcttttgcaactttgtcaaaaaccaatttactttatatgtgtgggtttatttcttgactttctagtctgttccattcatgtttatattgataacaatactgcactgtcttgattactgctttttaaagttatgaagacatagtgtaagccctttaactgtttttttttttttgtttttttgagacagagtcttgctctgtcgcccatgctggagtgcaatggcaccatcttggctcactgcaacctctgactcccgggttcaaacaattctcctgcttcagcctcctgagtagctgggattataggcgtgcgccaccacacccggctaatttttgtatttttggtagagacaggatttcaccatgttggtcaggctggtcttgaactcctgacctcaagtgacccacttgcctcggcctcccaaagtgcagggattacaggtgtgaggcaccgcgcctggcccctttaactttattctactttttcaaagtagttttgggtcttctaggttgtttgcattttcttacaaattttagaataagctagtcagtttctgcaataaaacctgctgggattttgattgggattaatatatggaattgacatcttaatattgagtcttctgatccatggatggatggtatatgtctccatttaattcttcaattgatctcagcaattgtgtgtgtgtgtgtgtatagattttagtgtctaggtttatatgtctttggtcagatttctattttaggccacttcaagttgtgctacagttcatggaatgttgatgttcattaaaaaatgcattctttttctcttggtgttttgttttatatagtttgtgttgctatgctggttcactagtcttttctgctattcctaatctcttgctaatcctatctaatattatttttatcttagattatacttttcaatctaagatacagaagcttatcttctttatctggaagtttgctttgggtctttttcatgtctctgcttacatgttttaacttttcctgtagctttgtgaacaaatggaatataggtattataacagttttaatgtccttgtgtactaattttatcatctgtgtcatttctgggtttccattgattaatttttttttccctcttcctttacatgccttgtagtttttttttttttttctttttgagacagagtctagctctcttgcccaggctggagcgcagtagtgtgatctctgctcactgcaacctctgcctcccaggctcaggtgatcctccccacttagcctcccaagttgctgagactatagttgtgtgccactgcgcccggctaattttcatatatatttttaggttttgctatgttgctcaggctggtcttgaattcctggcctcaagcaatccgcaggcctcagcctgtgagccaccacacccgggcaccttgtagtttttgagttgatgctagacattgtcagttttatcttgatggtggttggttttggatatttttgtattccactattcttgagctttgttctgagatgtggttaagttacttggaagcaatttggtcttctcaggccttgttttatgttttgctagttaggagcagagcaacatttagtctagggctaagtttgtctcactactgtgacaaaattcttttgagtattccactcagtaccctaagaattatgaaattttttcactctggcctgggggataggcactatttccagccctgtgtgagttcagatcattatttcctctaatcctttcaggttgttattttcctggccttgggtagttacctgtcacacgtgtgctgatcaatacccagctgatgaccctctacagatctgcagacttccgtgtgctgcagctctttcccatctccattactgccctgcagattctaaccaccttaatatgcagtgttttgaaacgggttttgtttatttgtttgttcgttactttgttagtccctgttgtttcttctgggcctaaagtagaagtccatcagtacttcttattttaaaaaaaatctctaaaagtactattttggattgcatcttctcagagaggaagaataagatattcagatgtgctgtttaaagcgatggcagctgggtgcagtgatatgtgcctgtagtcccaactacaggctgaggtgggaggattgcttgagctcaggagttcaagtcccattggggcagcatagtaagccatgaaataaattatgaccttggtccttatagtggccagtttttttttttttatgtgctaggggtttagctttgaaaaacataggtgtgtacagtttaacaggaagtaataagggaaaattcttgtattatatttgacactcttggtaagaaaataaaatatttcaagattcttaggagacccttttctgacttttatttattcttttaaaagtacagagtctttgtcaaaataaaatagaatataattaaagtgtttttccatttaaaacctattcattgtgctgaatattatgggagaattatactaaaaatatcacttgagagcttgttagaaatgcagaatctcaggtcctacctgacctacctgagctgaatctgcatttaaacaagattcccaggtgatttgaaagcacaataaagtttaggtagccttagaacaagaaaccccaggcttgaaatgttctcaacatatagaaatgataaatgttagtgacgatgaatatcctgaataccctgatggtttggctgtgtcctcacccaaatctcatcttgaattgtagctcccataatttccatgtgtcatgggagggacctggtaggaggtaatttaatcatgggggcaggtctttcctgtgctgttctcatgatagtgaataagtctcatgagatctgatggttttataaatgagagttcccctgcacaagctctctcttgcctgctgccatgtaaatgtgactttgctcctcattcgccttctgccatgattgtgaggcctcctcagccatgctgaactgtaagtcagttaaacctcttccctttataaattacctagtctcaggtatgtctttattggcatcttgagaacagactaatacacctgacttgatcattacacagtctgtgaatattacaaaatcacatgtgtgccataaatatgtacaaatattttgcattaattaaaagagatacaagaagccaattgtaattgttaaaatttttttttctgagataaacattatatagatatgttttttaaaaaagcattctttttttttttttttttttttttttgagacagggtctcactctgtcacccaagctggagtgcagtggtgtgatctcagctcacttcatcctctgcctcccaagctcaagcaattcttgtgcctcagcctccggagtagcgaggactacaggtgtgtgccaccatgcccagctagtttttgtattttttgtagacagggagtttcaccatgttggccaggctggtctcaaactcctggcctcaagcaatctgcctgccttggcctcccaaagtgctgggattacatgagccaccgtgcctggcctatttgacagatcttttaatttttgtacatggttgaaaattccataaaaatttatatgtgtgtgtgtgtttacatatgtatatgttggggggagggaagatggtgggaaacaggttgattgattgatgttttaatagattagtatattacagaagtgctatatattctttatgtcctcttccctctcccctagacactttaacaataacatattaaagtgtccctgatttctgcctttaagaaatctgcttcaatttgtataacccagaatttccaaaatttgaccacataacacctcttaattttttgtaaaacattgtttctgaggaactcaccagaaaagaagatcactgtggacaatgcttggagaaggatgtggggctgcaaaagaagtagaaaaagaggtagagttgggtgaagtaagagtagggggtagattttaagttgactttgtcaaccttgggctcagttttatgccttagtggggtgattttacttaatattagataatgacctttgttgcctaagagatttatagcttttggtccccagaagtgttctataactgagttaattgaactcttgaaaaactgtatgtgttgggtgtagtaattggccctaagtgctgtctgaagcaagacaccaatgaattttcaattgactttaaagcaaaaattgtttactgtcacttgatactaaatacatctctttgtattgttaggggatgttgtttttatgcatcagaaaactttttcagagggacttgtcattgtgaattgctatcaattgggatgggattatcttgtagtttgtgtgctctaataagacataattaagaaataagcaatcacaatgtataattgaatataataaaatgcgatttaaaagtgtaatgtagatttggttatgctttgagggaagccgtatcttatgtgattatatagtgatacacatcttggacatttctttaatgtgtaattttttacacattaaactcataattctgagtaactcagaattatgatgagggtctcttcttttcataattcactggaagcatttatagactatttgtcatatacaaaatgttctgcttagaataataggcttggaaaacttatttcttaacttgtttctttagtgcttatattcttaactatctcttttcctcttcagtttgtactttcactctattcatacttaggacaggcttttgtttccctgatgacataataggtatatggtactgtcagccatttctcagattggccctttagtattttaaaggcaaagagaaactgactgtcatactgtgaaattagggctgaatagatataataacttaatctaatgtcttctggttaaaagcagtttgggaaagaaaacaggatttatgttgtaaagaatcacatcagctctagactctttttttcttgcatcgggatgagtagcaacaggaatattatgttctggaaagatcagtaagctaataattacctttttttccatctcggagtgaggttctgaaactagtgaactcttcagcatttgttgagagtttatgcttagtttttgccttatgataatgtgtttgaatattttgtaactaaatcaggataaccccttctctatctagtactctttccattatgtagtttaagaaatttcactggggccaagatcgcgccactgcactccagcctgagtgacagagctagactctgtctaaaaaaaaaaaaaaattcactggaattgtcccaacaagagagaaggtagcacggattgggtggttcaggtgcttgatgagtagaaaaggcagggattcggtgacatagtttatccacttaggggcccattttgagtacttttaagaggggtcactgagatttgattcttattgtagattgtgctctgtagagctgttgcttcctgataagtgatttttggatatgtgaagctctacttgtaattagtttttctgagttgcttgaagggatttccattcattgttttgttcatctttattattcctggaggagaagtcactggatgccaacaaggaatgtctttagtagacaattaagccgattaactgttttcagaaagcatgacttaatgctaactattctgcaggtgtcgccaaaattcaggtgtattacattaaatatttcttatagccagttaattagtttagttatctggggctgtattaggcagctaattcttgtggatttgccaagaatctgtgttgcttctgactaaggagagtgactgataacatttatcttgaaaaattaaccaaccaaaatgacactgcctgtgttttaaagtttggtatattagtctgcttgggctgccataacaaaacaccaaatactaggtgactaaagcaatagaaatgtattttctcacagttctggaggctacaagttcaagatcaacctaccagggctggtttctagagaagcctctcactctgcttgtaaatggctcccttgctctgctgtcacatggcctttgctgtgtaaatgtgtggagagggcttctccttccttttcctttcttctaagcacatcagtccttttggattaaggcccacccttataacctcacttaacctttattaccttctttgtaggctgtgtatccaaatacagtaacagtgagagtcagagattcaacatttgaatttgggagggacacagttcaatttgtaacaggtggtaccctgggcactcttattattttgataaaatatcctaaactgcttctagagtgagaatctctcatcacctacagatagtcttgaggctcgggcaagagccctggtcaagctgttaatttttcacaattgtttgtcaatcttactgcatgcttttctggcttatattaaaattaataaaacataatttgatctatttagtcctgtaagttcctgaaattctagacttaaattaaaatgaattgttggaaaactttgtacctgggctgtattcagatctttcaaaatctctaggcctgaattgagttttaatgttatgttcttgaaggaacttacaagaaatggccatgtaagatttgtgactttgtctgttttcagaagattgttaaggacatcttttactatattaggtcttccatgttttttaagtgaaagatttcttttagaatttaggactagttcaaaatttgcttccttaaaggaactggagtccatattttttgagaatgagaattatatcatgtgatgtgtctccttttgcctgggctgctaggaagctcagatttagtttgggggctcacttcatattaactttgcttgcccatatgatctgcatagttgtcttttacatttatttggtggtgtttagccctgcatctctttagtcccactttctcatttgtattttactttttattgtttatattcttgcacaagccatctcacatcttttttgggaagaggtgggatataattaaaatgaaacttgaatgtagatattgttactcagtttcacaattaaatactggttgaaaggttatcaggctttggctgggtgctcttccccgagtagtttcatagaacactcagagtaaaagctcacaaagttgggcctggtctggctcccagttttctccttgattcatttcctgtcactgtcactctttctcaagtctctaaagccacattgacctccttgccattccatgttccttgagcaggctaaacacaccctgtttcagggtctgttctctctggaatcagcttcccagatagtgccctttctctctcactttctagtaagctgtattcaaatgccatctttatccgagaggccctccctggcctccttatgtgaagtagcctccttcctccttgcctgtcttggcttttgcgtagctgttacctcccagctcccctcactagaacataagcttcatgagggagggattggttttgttcattgctgttatgtatctctaggcccttagaactgtgcctggtaagtaatagatacttagtgaatatttgttgaatgaataagtgaattaaatagggtcacgagcaactatttgttcttttctacagatttttgagcatgcatttcatgtgagacaatttagttgcaattgtttcttaaggctgggaactgtcctccatgacctctctagatcctgcatcgcactgctgctcattacttagcttttactaagcacttaatgtaccaggcactgtaagaatatagagaaaaggtctgatctcagttcagaaataaatatcctcaggaactttagaaagggataggctttaggggatttgggctaacaatgttgtgattcatagattatttattttgttcccaataatatatcagacaacacttccgtcacactttatattttcaaagcacattcacacatttctccagtcctaacaatatcctggcaaggcgggtattcttattgtcttacctgttttacaaagaaaaaaacagacccagaaaagttaagtcacttaccaaaggtcaagcaacttgaaagttgcagagctccgtttgaatctgggtgttttaaaattccagagcctgtgttcctttaatgtgtatgtggatggctcttgtttgatatagttgatgaggtagtaagagactttcttggtgtattcctaatggtagtattctagatttgggtttttctttttgcatccttttattccacttgagtgatgaatcacttttggtgactgaccttattttcacaggtgtgctttttcctttatttgatctttcttttgtctttaagaacaatactgacttttatgtattttctcctgtccggactccattactctattaagaccaaagtgaaagcaaaattgctccacagaaggaaccagtgatggtgactgattattttcctttcaaaacatttgatcgtctacactgaaatacagaggctagtatgaaaatgggaaacagacaaattcagttttagatctccagttatttaccctgggttttaatgcttgtttatgggactcacttggagctcatggttgtgaatccactagaacttaataacatatttgttcctactagatgttgttaacagtagctttacatgtgtaccgtggtccttttagccctttaggtaaataaattccttcctgggaattaattagtcatggttaagatgtaattcatcatgcaaaatatcagagctgtcttaatgaaaaattcttaatgatccagaaatgtctttgtgaccagcttaactggaatctagtttattcttttatgttcctccatgaacttgacaataatttataagtcataatcattttgagaataggaatggaaaaaaaaatctagagtgattcaataacttgaatacatcttgggttggcaactttatgccatttgtcctttgatcatgtcttttatttagctcatgcttttaaatcttgcccagattcaagactgttattactaaaaaagctgcttggtgctctctttccatccctaactgtctgctgttctctttacatatgaactgtggcttgatgagagtatgtgtcctgcagctcaggagttgaaggcaggaaagataggattttgtaacatgtatagtagaaagagcatggattttggagtcaaatatacttagctttaatttcaactctgatattaactatgtgcatgtgtatattttactttacctctgtgagcctctgattccttatctgtaaaaaggctggtgataatattttattatactagactgctttgaggattgtcttagattaggtatgcaaaataaccactgtattgcctggtgtattatagatgctcagtagtttttatcctgtgtctcactttcaccttcctttccaaacatgtagaacacagggatgcatgtaaatttctgcatttagttttaaaatttcacaagtggaggatgagtgagagttgacttgtcagcacttactgtcaaagggatcttggataatttttggactatatttttaaaaatggaatgtagttttaggctatattattagaaagatagtgttcatgttgtgggatataaaacctctttctgtttggaagtatgttgtattcacttctcagcacatctgagaggcaggttagtgaagccattaagagccatatggcccaggtttgaggtcagactctgctccttaaagactgtgccttgaataaaaaactccatctctttatctctacaaagagggataagtatggtactgatatggtttggctgtgtccccatccacatctcatcttgaattttaactcccacaattcccgcgtgtcgtgggagcaactcagtaggaggtgattgaattatgggggtgggtctctcctgcgctgcactgttctcgtgatagtgaatgagtttcaccagatctgatggttttagacagggtagtccctgcacaagctctattctcttgtctgctgccacgtgagatgtgcctttcaccttctgccatgattatgaggcctccccagccatgtggaattgtaagtccagtaaacctctttcttttgtaaattgcccagtcttgggtatgtttttatcggcagcatgaaaatggattaatacaggtacctacctcataaggatgtttttgcaataaattaattattatgtgtaagccacttagattaatgcctggcacatagtaagttctatgtgagtgttacctgtttttgaggggacttcagatgaaagcaaaaaagatggtgggctgctggaagtcatggtgtggaagaaacagttgaagaaactggaggtgtttaacccaagaaagaactattgaaagtcctttaccatttaaagggaaattttatggaagaaggaatagacatttttttgtgttacagaaaaagatgagactaggatcaatgggtagaaattagaaagaggctgattttattttattttaatggaaggctttataataagtaaagctgttcaaaattgcagtgaattgctttgtcagctggtagagctctgcattacacagaggcttagaaggctgaagagaggttcatgacctggctggtggggtgagctcaatgacaagtgttgtcttctgcactgctatctgttcaggttaagggactagtgataatcccacactgaaatttgctgggatttgctagcatgtgtgagaactttctccctggaattagtcagctctttcatgctttgcttttttttttttttttgagatggagtctctctctgttgcccaggctgaagtgcagtggcacgatctcggctcactgcaacctccgcctcctgggttcaagtgattctcttgcctcagcctcccgaataactgggacaacaggcacgggccattgcgcctggctaattttttatatttttagtagagacagggtttcaccatattggccaggctggtctcgaactcctgaccttgtgatctgcccgccccggcctcccaaaatgctgggattacaggtatgaaccactgcgcctggcctctttcatgcttttatggtctatcatttattaatttttattgaatatttatctcagacaaacatttattgtctgagacattgtatttctggtctcatattgcagaaaagaaaacagaacttggaaataaatgttcaccgcctaccattgcttggcatcatgcattcaatccttgaaggaacccaatgacttagattttattattgttgggagaccattctcctcagggctcttgtgtttctgaagttcttgtgagccaagcactgattgccctaagttttaggttattttgccaaggatgtttgtttagcaaacagcgttggaagatagagatggtctctcactccagagcaaggggcagatgtgtttccagtccagtctctgagcttagattcggttttcggagctcggagttcttctccaggagctgcctatgtgggcaggcttctctttgggcccatctgcctaacccttgtgggacttgggggcaaggggaactgatgtgaacatgctgcgcttacgccgcttgctgtgctgtgagtgtgatcaagtcttttggacttgaggagctctaggagttttgtgtcttctgccagcacctgtgaaactgtggctaacctcttagctttcgagtagaataaaatctcagccttcaccattcttgacattaaggaggaataaggtgacaatcagagagtttaaacctaatgcccagagttaagtgatctagtatttgggggcggtgggattttaacttttgtcttcagagggtgtactttttattatgttatggaaaaacgctactgtctttgctgctgccattactactgttattactggaacaataatagctaacgacaacaaccaacatttgttgagtgctagtgacataccaggccttgtttgatctcatttaattctcactaacaaccctatgtggaaggtatcttagtattttcactttatagatgagcaaaatgagatgccattactaaggtcatgagtagtcagtagggtggagccacaattctaacccaggcagctttactctgcctgaagagaccccactctgtagctgttaggagtgcaatctgaaagcagaccaacctgagttttaaatccccgtactattcctaaccttcattgtgtgaggtggtgtaaattaattcaacgtctttaaatctcagctgtttcatctgtaaaaagaggggagggaataataataggacctactccaaaggcctgttatgaggattaaacatacattctataaaatgtgcaacacagctggctcctggcagctagtaagcctctctaaatattaggggctattattatttttattatccttgctgccttccttttctctaattaaaaaaaaaaagctttaatggttttgcactctgagttctataatgtaaatatttttcactaaagacaaaatattcatcctagtttacatcaagaggatacattttaaatatggggcaaagctggcacagggtatttcttacataaatattttcttgaaaaaggaaaataggaggcagaacccccagtaggcccaatttcctctctaatcttcattttagtaaccctttctattccctaaataactcctaatgatccagtaatgtgttaacagtgacagctgatgccagaaaaggtgttctctctgggcctgacattttccttaatggtaattctaactagttaaggtaaacaatgtgaaatgtttggcatattttttccacaaatggtagtggagcggaaatcatgaaaagccttgtaaagatggcaaaccgatctagtgtagctttgacaattctgtgactgctgttacaaggggaaataatagagttaaacatctaggaacccttacctttgggacagttgataaattgaaggcattttctgattgtgctttactttagattaacagtctggaagttttcagatttaaagagcaaagttgtgtatcattaaaacaacaagaagacatgatacatgctaagctgctctgtacccaaatattgcaagtaatcttggtagctctatctttgaagcccagtttcgtttacattctccactctgatttactttaatagtcaaacacttgggtggtattctctacctgcaagaaaccttggaagtagtctggtttagggtcaccagtttacagatgaggaaacaggatctctcatgtaaaggctttaaatcaagtcttgtggttcccagtagtgttcctttcctgagcatcccacgctgtcctgagtggcttttgcccttcccttcattgcctttgttcctgccatccccctacccgtattcatgatatagctgatcttttggcattcctaacacctaacaaaaagaattgtaaaattctttttggaggttagattgaagtcaaagactggcctgaatttccctataaattggaaaagaagttttatatactgtgtggctcatgaattaagatcctttgctctaaatgacagttcagagcagactattgtacagtattttgcttgcaaatatctagaagtggatatgtgattaatttgctgacagaccatctctgaaagcagttctaatgatggacttataattgatggcatccatcattgagaacctaaaatatccccctccctaaattaaaaaagataaatgaaataaactaggctgaatgtataagctgacaaatctgagggaatttaatgaaactctaaattaccacagccaacagataagaggaaaaggttcctttgttactgattataatactaaattaaaaaaaaattatccaagaaagatagtgggggaaacaaagatctgtggtccatgtatcaaacgaagttattgaaatatttttaataagtatatctatctcattccctggttattgttgattcatatcaatcttgttagtgctgttcgaagactagtaaatgcgggaaccgtcctgtaggatagcttagatgactgctgttgtaagagattttagaattaatatgaccttatttccagactgctgggggctccataccaaattcaggtcattcaaatgagcttttcggaaggtggttcctcagtgtataagtaattgtatcagttactgtgctttcagctatgtatgaaaaagaccaactgaaagtgacttaaacaatggatatttattatctcccctaacaagaagtcctgaagtaaggcagctgcagggctggctgctttggtggccaaggacatagtggtagcttggcattcctccttgtttttccttccatggttgtaacatggctgaagtgtcttaagtatcttatctttgtacagtgatacctagggttgggaaaggcaccttttcttgttactattcttgcagaaaattgttcctagtacttccttagttttgtctcattgatcagacttgtcactgataaggagaatggaacagttcactcaaatcaagagttacccagtctcttgaacagttcatgcctgcctgctgtctgattaaaatcagttctaatgccaatgacagaagagaagggccccttggataggcaactacaaatccacttagatgggctattgaaatttactgtgaaggaagttttgtgttttctgtttgtaacttatttcatttcctagttaataagatgaatgtgcttcaccttccttttgcattttactttctgcttcacctttcttttgcattttactttcaagttttacttagcttgatatactctctgccttcaccaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtattcctcctttctggtctgatggtggcagcacttcccatcactataggtgttgcagcttggagaggagccatggtagtggctaatggtccttaacaaagtgattcaaaatgccacttttcaggagttctgcaggtgtctggaaaggctggttgggaaagatcacagaaggcatcctcggctgatttctcccctcccctgtgtcttatccttggttctgccattatttctcactgcagtgtggaatgagacaagcaagatggcctccatttgcttgtgtcttacgatccatccctaacaaaccagaaggcatactggcccttgtattctccattctcattctagcagttattcttgtatttcacacatctaaacaataaagcataatattctgactgttgattcaatgcctattctgaatcttagtggctgacctattgacactcacatgaattggagggcagccagtcgaatacccttttatctgaatccaaaccacagaagcgagaatgtctcctacattgaagttggttgtgacttgcctgcatttattgtgcattcttggtattttttgtgaagtgaagaaaatttaacctacaaattatttaaacataaaatgaaatgtttatgagaacaatttttttcttttttttttttttagagttggagccttgctctgttgcctaggctggaatgcagtggtgcatcactgaagccttgaattcctgggctcaagcaatcctcctgcctgagtctcccaaagtgctgggattataggtgtgacccaccatgcctggcaaaaaaccaaaattcttgaatatcatgctttaattgtgactaatgtgtattaagttttattttgtagttttcatgttttggaacagtttttcttttatttgttatttttctctctttttctcttccttcctttcttccttcccccacgttctttctccctgtctctctcttctcctacccctcctttctcccctactttcttccttttgctgtaggtccttgagaaaactcttggttcttgggtctatgcctttagtacctaaaggataaaatgggtttgtaaggagtattttcataattggccaaaggatgaactgatcaaataagggttatgtagtataacattatagttatgtggtttttagctgtatttttgagatcactcctttaataccatttagtactactctgtgataaataacaataattgccaccacttattgaacactgattctttgcaagggatgattatgtccaatcatctcaatgaatttagaatttaaactctaatctcccagattctaaagccgttgttgctgattttcaggcatttttaaagcagcagaaacttttttttttaatgtgatattttgcagaataccagcatgtcagtcattaagagaggcagtgctctcctcttctttggttttggggtgagaggtccaaagcatcatacttggttccccccaccactgtgggactgagtgatgcatagactatggtttaaaattcactgccctgtgctatgagattggttaggggactggctggcctgtatctgcccagtaacagctgtgcatatggcatcttcatgttttgttttctgtccattagacttatattatgattttgtaagcagatacataaattatgcttctacaaatactgatgatatatgactttcagcttctaagagtttagttccagaatcagtatgctcttaaccttttggaagccatgtgttgacctctttatattttaaaattaactgggcatttttttttttttgagacggagtttaattcttgttgcccaggctggagtgcaatggcgcgatctaagctcactgcagcctccgcctcccgggttcaagcgattctcctgcctcagcctcccgagtagctgggattacaggcatgcgccaccacgcctggctataactgggcatttttgaaaggaatactataattctttgcctttacaagtgctgagttcatcctatggatttatctgtgaaactagttaaagttatagatcacttgctctagatttaaagtaaactgtagtccattttgacccaatatactaagctcaagaggggtcaatgaatgtatagagctgctgaccttctggctttgcctcaggtaataacagcaaaggtgaaggacctcatggtatttgtattttctgattagtctggttgactgaaaagactttgtcctaatctcatgggcatgggaagcaccagcagtgatttctgctttgcttcccatcattctgagtcgataacatcttagccgctaacaaagaatgttcgcctgatattgaaaaagagccttgtcttgatcatttcacatttgttttagtagccacgtttcttaccatcctcattttcagtatgccagagttttgagcaaaagaaaataacaatgaaaactttattatatctgataattgtcacgaaagtaaatgtcatattattctgggttatgaattagcttcaatattgggtagagaaataaagggtcagagctcttttcaaaagagcctttaataattgattaatgggaaaataaaaggggggagaatgaaaatgaatttgtttttgacaattttgtaccatgacagtccatttcttgtcaccaaggaaacactgatgttttctcactaatcttttcctgtcatttttggcttttaattacactttggattatatatgaaatataggtgtgtattttttttaaagtgaaaacatggatgattcagtaacgattgggctacgttatctcagagccaagcaaaatgttgagaatgtgtagatctgagttgaaattttctttctattttctgccaaaagaataaggattcatgcagcaaatatctgttgagtgcccgctatgttgctgattgtgttttaggtgctagggctgcacaaatgggaaacaccagttcctgtcctcagggagcttatgtgcaaatgagaggatagaaaacgaacaaatagataacgttgaacaacatttatgtagtctctatgtatcgagtgtctgctttgtgctgaggattgttctagattttcaggtgtagaagtgaagaaaacataaacatttctgtccttgtggagttaaattctaatcaggggagacagactacagactataagtgaatatataagtaaagtgtggtatagcagatggtaagaagtgctacacacacccccacccactcaccagggaggggagactagggacttgctgttttagctgggttggccagaaagggcttcactgagggcccatatgagccaacacctgaaggaggttaggaagagtgtcaggaagagcattccaggaagaaaggaagcaggtgcccagatcccaagtcaggggcatgattggaggtttggagcagcagcaaggtggttgatgaggctgaagcaaaatgaggcatggggagagtggcaggagagagatgagagagctagggcatgtggtgtggtgggtgggtgtagggaagtcacgtagggtcttgtaggtcactggaaagacattgattttaactatcggtataatgggagaaatgattgtaatgctttgagcacaggaataacatgatgtggctaacatcttttttttactattattatactttaagttttagggtacatgtgcacaacgtgcaggtttgttacatatgtatacatgtgccatgttggtgtgctgcacccattaactcgtcatttagcattaggtatatatcctaatgctatccctccccactccccccaccccacaacagtccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccctggtatagatgtgccacattttcttaatccagactatcattgttgggcatttgggttggttccaagtctttgctattgtgaatagtgccgcaataaacatacgtgtgcatgtgtctttatagcagcatgatttataatcctttgggtagatacccagtaatgggatggctggtcaaatggtatttctagttctagatccctgaggaatcatgatgtggctaacatcttaaaaggcccactctagctgctgtgctgggaatagatttcattggagaccaaggcagatgaagatgttcatatttgtgcattgtcaccttttaaagcttgagaccacagaactgtttatgcttgccatttgagagagggtctctctccatcacccgggctggagtgcagtagcactatcatgaatcgccatagcctcgacctcccacactcaggtgatcctcttgccttagcctcctgagtagttgggaccataggtacattccaccatgcctggctaatatttgatttttttgcagagactgggtctccctatgttacccaggatggtctcaaactcctggcctcaagtgatcctcctgccttggtctcctaaagtgctgggattataggcgtgagccgctgtgcctggcctacatgtctcattttttgacattactttcatatattgatttacattatattggtagattctatgtttttgaggataaaagtgagctgacagatggatttaactttcttccctgatggtccaagcttttttaaaaaaattaattattgatttattttagagatagggtttcactctgttgtccaggttggagtgcagtggtgccatcatagctcactgcagcctcaaactcctgggctcaagggatcctcctgcctcagcctcttgagtaggtggtattacaggcactcacaaccatgcctagctaatttaaaaaaattttttatagagacgaggtctcaacagaaggctcataggctcagccttgataccatgtacaattgatcaggtcaagtaatgtggacaataagcaaaataactgggcagttctattacttttgaatgcattgtacaattgctcaaaatgagatgttattgcattggtaaacctccagttccataggttctgccagtgtctctcataataacaactgatgggcttattgtagcagcagcaccaaaagaaatggatacgagttgatacaaattggggagttgggccaaatgaattggtatgtttctctgtggtgtactaggtgaatgagatgacctcagatttctttaaagttacaaagtagtctaatgcttatcactggaacagggtaggttgaagggagatacttggctttgttgagatgtgcacacaaacacttaacatttcatcccaattttgaccaccctattggtgctagatcaagctctgaatctcattttttttgcctataatgagaaataagggtacacgattattcaagtgaagttgttagggcttaatcattgagtaatgaaacattcattatttggtagatacctaaaataattctggcttttaaatgcgattataccttgaaaggtagaattagaacgaggaataaccttaatataaaaaaatgtcctagtagaacaacatggtttgctaggaagttatttacagcccaaatataagatgctgcttgtatgagaaagggaagaaggcctttggtttctagaaatggacatgctaaacagtgggtaataatgagatataattttaaatgcgtgcagcactctagagcacattaatgcagttgctggaaccatgaggtgatctttccattaagttcaggtgtgtgtgtatttgtgtaaaggaaggtattggaaagtgttgaggggagcctctcagaatttcagaacttagagtggcagctgaaaaaacccggggaaagaaagcacagacagtacaagtttgaaggtaatttaaagatgatttgtagttctaaaaggcttttaaacagaacaatgagtggtatttccaaggttcgttctttccaggtgctttctaactaacctgcacaatgtgcacatgtaccctaaaacttaaagtgtaataataaaaaataaataaataaataaataaaaagaaaattcaataaaatacataataaaaatgtatcattaaaagtccagaaaaaaaaaaaagactccatggaaaaaattgggttggtctcttacggcaggagaaaacctatgatagtacttatatgtagatttactttcgccaacaaaattcaacaaaaacaaagaagacatctcagtattttatacttttaaaattaagaatgatgtcgacacattaattttcatttactatccttgactcatagataactttttaggatatttctagtctgtagtttcaatgagttgtttgcacattgttgtattctattacagataatatgcatgctcagaggcatttcctcccttctttatcttttccttgatccaaattcagtacttttcttttctattttttttttttttttggaaagagtctcgctctgttgcccaagctggagggcaatgatatgatctcggcttactgcaaccttcgcctcccgggttcaagtgattctcctgcctcaccctcccaagtagctaggattataggtacccaccaccacacctggctaatatttctattttttagtagagatggggtttcaccatgttggccaggctagtcttgaactcctgacttcaggtaatctgcccaacttggcctcccaaagttctgggattacaggcgagagcgatcacgcccagacaaattcagtacttttctgattttatgacttaaaagttatggtcttccccaggcctgtgtccataagcccctctcactatatagatctctggtcttcctctcacaaatgctaaggcagttttattcaaagccccacttagcttttctcacccctttatcttttccaaaagagggctgcaaaaatttcaacttctctgccgtctgtatcatctcacatttctattcacagtagcctcttgggccctgttttctttcttttctctttttctaatagcctctagttagggtgacttgcagattttgtgaaattgtagctattgctgaataggtgattatgagcaactgtgaagttactaaaactctgagaaagcaaaggaaatttgtctctgacttgatatcatggtttgaacaaccttttcacccatttgttttaggaagaaacagagtaacataatttttcaatcttaattatacttataaattaaatagaatgaaatgaaaatactgtcatcacatttataaaagtagaacagagttttgagaaataaatgtttcagtgtaatttgatacttttctaacatttgaatgttattcattgatgggtatagccctgttcctattaaaaaaacctttttttttaatttttaaaaattgacaaataaaaattacatatgtttgtagtagagagcatgatgttttgaaatatgtatacactgtggaatggctaaaccaagctaattaacatatacttcacctcacatgcttatcagttatttgtggtgagaatacttagaatctaccttttcatcaattttcaggcatacaatacattgttattaactgtagtcaccatgttgtgcaatgggtttcttgaacttacttctcttgtctaactgaagtattgtatcctttgaccaacatcttctcaacccgtcctctcaccctgagcccctggtaactactgctctactttatgcttctatgagtttgactttcttagattctacatgtaagggagataatgccaatattcatctttctgtgtctggctgatttcacttaacataatgtcctccaggttcatatgtgttgttgcaaatgacaagagttccttttatttttgagacagggtcgcactctgttgtccaggctggagtaaatggtgcagtcggctcactgtagcctcgacttactgagctcaggcgatcctcccacctcagtctctctgctatctgggaccacagatacttttttgtggagatgggttttcaccaggttgcccaggctggtttcaaacccctgggctcaagtgatctacccacctcaggctcccaaagtggtgggattacaggtgtgagccaccatgcccaaacagatttccttctttttaaatgctgaatggtattccattgtgcttataccacattttctttatccattcgtctgttgatggacacttacgctgcagtgatcatgggagtgcagatatctttttgacatattgacttcaattccttttgatatagaccctgtagtgagattgttggatcatatggtagttctattttttaattttttgaggaaactccatactattttccacagtggctgtattttccatctttattgaggtatagtttacgtacagtaaaatgccatattttcagagtgcagtgcaatgagttttggcaaaggtatatatcactgaatgtgttaccatcaccccagagctctctcctgcctttttgcggtcagttctctctcacatcctgctccaagcaactgctgatttgaattctggcactactgattagttttccctattccggaacttcgtacattattccctcttttgtgtctagttttttttgcttgccataatgtttttgagattcttcattgtttcttcctttttgtggctgactgaccctatcccccaagttctaaaataacatttttcatgactgtgactttctaatcataaagcagaaggctcagggcaatttagtattaaaagttcctgtagtttctttggtctgtagctttgttacctcggtttagagaattttggtgtggtcattttctacacagcctgatgctaattttttatcccccacaaattctatttcgcttttccttccatgtagtaagcaaaagtgagaagtgagctgattacattgcacatatcctagtgtgaagtgacacaattgtctttttccaatcagataggagtttgccaagctttactgacaccctgtaagtttgtccctgactcttgatcaggagcctagttgggtgttgtataacataagatttatttttaactgtttccatagtaaccgttacacatagaggaaaaagctgagaactatagtagcaaggtgatataagtaggatatcagaaatcagattctaacagatttgaactaagatttaaaatggaatgatttaatagctggagtccttaactcagagactaagaactccagtggaatttaggaatggctttgagagatatgttttattttattttattttatttttttgtgagacggagtgtcgctctgtcgcccaggctggagtgcagtggcccgatctcggctcactgcaagctccgcctcctggattcatgcaattctcctgccttagcctcccgagtagctgggactacaggtgcccgccaccatgcctggctaattttatttttgtatttttagtagagatggggtttcactgtgttagccaggatagtcttgatctcctgacctcgtgatctgcttgcctcggcctcccgaggtgctgggattacaggcgtgagccaccgtgcccggcctgagagatatgtttaaaagtcaaataaagccacaaatgatgataaaagactggactctcctacctcatcctaccccggtcccagttccaacatctcagagatgctgacttttactcttttagtttttcttttttaggtatttctatttctaatagtatgcttgtgctgtgttttttattttgaatgttatatattaacttccaactatggaagatgaggacttagcccccttcccaatctctccccatcccactacatcctcttccttcatcctctctatatagttgtattctagttttggttaaatagatgatcagtgcttacctttttataactacactaatatgtacatctaagccatacagcatactgtgattatgttttgtgccattgcgttgttgttttcctggagttactgattggatagtcctgttgcctttcttctgtattgtatttcctggatcccttgtttcttctcttctgttttctcttgtagtggtggaacacattcttcagtagtttgctgagatatggtgcatataaaattgagtttttgagagcttgcaaacctgaaaatatctttattctttcctcatacttgattgatagttcttctgggaaatacttatctcttaaaattttgaaggtatatcattcctttgtcttctagcttttaatgttgctgctgagagaaatccgatgtcattctgattcacaaggctttgtataggtcctgttttttcctttttttctttgacagcttttatgattgtctctttatcccttgtgttcttacatgtcagaatagtgtgtcttggcttgggtctttttgacttccattttcttgagcacttggtgtgccttttcaatctgaaaactcatgttttggcatgttctggccttttttttctttcttcttcttttttgtttttttttttcaaaagagctggagtcttgcttttgttgtccaggctggatgcagtggcactatcatgcctctctgcagtctcaacctcctgggctccagtaatcctactgactcagcctcttgaatagttgggactacaggcatgtgccactatacccggctgattttttaatttatggtggagacagtgtctccctgtgttgccaaggttggtcttgaactcctgagctccagcagccctccaccttggcctcccaaagtactaggattatagtaagacactgcactgagcaggcagttttttaaaaaaattatttaattattttttaactatttttctctactccatttgtttcgcttttccttccttggaactcctatctggtaagtgttggaccttttggatcaatcctcttgctttgttttacctcctatctcattttttggtgttttcctgtttggagatttcctcaaggataccttctaacctttctattggagttttaaaatttctattttaatttctaatagttgtttttcatttcttgaaaatgtttatatcgtcctgtccttggttaattgatgtaatagcttctgttatttttcctaaggatgttaattatagtttaacaaaattctgtttcctgcatagtttctgttcccccgtgtcctgcttcagtaattttctctgttttgatgcctgccattccattctgcaggctttctgtgcatgtctgatgatccttggctaaccatttgtgtgtaagaggcaggcactacaaacctgattggaagctcagaacatgttatggagcttgtccataatgattgggtagggactcagcagtttcttcagtgaaacctcaaatgtcactatctgtataggtcttcacttggaccagttcactttcccaagggagaagccatatgtctcttgtgttggggtgaaaagtcaagctgtcagtgttttggagcctaactattgacggagaccgagggtccatgggggctttggatcgtactgtttaatatgtcccactttgacttcatcctcctgttttctgtgcagtgtctcatgcctccctctcaaccatgcctggcatttccttgtctagatcctgtccaattcagttgctcccaatttggccaatgctgtgggggaggaaattacccatgtgtgtggcttgatggggatttggggctcagaatactcctatagaaacttttaactcagtacccctgccattagtatacttggtgcctcctttttggtgttagtaaatcctactccaggctaaggttttcagatttctctggcctgctaatttagttgcctactgtccatcttcttgctagcttccacagttttgttaccatcccttatttgctgttcttcctctctgttctctctttatgcttcaaaaaatttctttggtattaccttggtgggattgcaggaaggagtagaaataattggaatcatcttcatcagatttacaaagaggtctatgaccccccaaattaataatcagtctattatatatatatatatgtatatttttttttgagacggagtcttgctctgtcgcccaggctggagtgcagtggcacgatctcggctcactgcaagctctgcctcccaggttcatgccattcttctgcttcagcctcccaagtagctgggactataggcacccgccaccatgcccagctaattttctgtgttttgtttagtagagagagggtttcaccgtgttagccaggatggtctcgatctcctgacctcgtgatccacccgcctcggcctcccaaagtgctgggattacaggcatgagccactgcgcctggcctactatacttattaagagaggttacaaggtcttcttattaaagacttttttttaacatgggagactttcatagaagcatgatttaggtgttgtcatgaagtcgtaggaagggattagatgctttctcaagaaatcttttaatcttagcattttgtcctcatattttccgtacttgttggatgaatgttgaaatttagttttgtaatcaccggaggcatagtgtcagtgaatattttcatcaccacaccaagtcttgtagaagaacaatacagattttcagttaccaaaaatacggtagactctttgcactgatggacatgtcccatgtattgatgaaggtttggattatacaggtgggcgcatttgccaaaacttaccacgtggtacacttgagatgcattcatgggtaaattttacctcaaacagaagccagaaacaaaactgtaaagaaatattaaactcaaatttaaataaaaatacatgtgaggactatcaaaaatatatgaaagtagttctgtgaattttgaaagatcatggtttttaaaatttttccatgttgaaaaaatggaaaattttcaattaggggagcaaataaaaacttattcctatcacatgcatcacagctacctcctccattcttctcctctcccttttattttgtcatgttttgcctatgctagtcactatactatgcagatctacaggtggtggagattgtcttatttaatatctaatattcagaatgcaaggcaaaaaagccttggtatgtccttttattttcagattatctctggatgtgcctactttcttttggaagctggggttacttttattttagttaggttgagcactctgtttcttggttttaaactttagctggagttctagagctagaagcttggaccaagtgacctatcagctggataggaaatttgcaagcattggggaaggtataatagcatggactctcacattgatcattctccttttagatatattaatatttatgaggtacttcatattttcagagtgctttctctttagtaatgttttctagattcactcaaaggtaggttgggagtagttttctcatttcatgggagtgaaattagagagaggtggagatgtgcccaagtgagtctatgtcagaaccaggattagaattttggaggcagaccaaggagaataagtggcagtgggaattaggaactgctgcatacagtagtaccagtgaagactactaaccagattataggtttagactggcaagactttggactgacccaagaccgaatctgttttattgtaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtaagagaacagcctgtgctaagggtcatttttgttaagatgtaaaagcactctcttttattctctctgaatcctgtaatgcatgtagcacattacaaactgccctcttgggattcatgagcccttgaaggtgaagcctgggtatttctctaattccagtgtttgaaatggtaggtaattattatttatgtattatctgtctttgtaacaatggcaagaaatataatagtaagaaaccagtacttaaatcaggttagaatggtaatgagaggtgttttttagcttcagaggaagatagttaatgaatcccattttaaacaatgaaatctacatgagacagaacttctgaagatttatagactagtgttccacacattttttgaaggaatttttacattagggctttgttcttttccttgaaattgataagaaataaaattttgggagactaatactggaagcaactttattgaccaagagtactccacaatctagcctttagcctccatcttagtccattgtgtgtgctcctttttgaattgctgaaagttcccagaaggatgcaattggtggttcatgtggctgagcgtcaagaagatgaataaaaagtagaaatacagagtttgctccctaataatcctctttcccaaggcctgtggctcttagagagggctgctctttctcccttcccttttacccacccagtcccacttccatctcattcagagttggttaaggaagctctctataggagctctgagcagcagatgggctgtatttgaattgttgttttttccttccccacagtaggtgaaagtcctttacctttgtttcaccaaattagattggctttaacactggaaaaaacactgaggggaattggtagggacacagattaaatgctctaagtggttctaattcattcagacttccaagaagaattttgctaaaagtccttcataagaagctttttaaaggaaatttggtaaccaaggagtgagaagtgccatgatattctatcagatattaaaacctggttatgtgataagactgaatggtcaatttccacagtggaaggagattaataatggttggcccttggctgggagtttaaggctgcagtgagtcatgatcaggtcactgtactccagcctgggcgatagagcaagactctgtctcaaaaagaaccccaataaacaacaaaaaaagattgactcttgggaatgacaaaagaattggttattttcagcatcttattcaaagtggcagcttctttaataataatgactatagggtgtctgatagaaaaaaattacttttcacctttagtgttgatttatgcattatgaatgcatacttgtcctatattctcaagattcagcaatcagaatagataagcaagtatacatttgtgtagcaaatatacatctatttgaatcatgattttttggagtgggcttgcttttaagtaagtgccacagattaaaataggttgttagaatttatttctgtgttaattatgttcatattaggatttcagatttttgtgttacggtctttgttcttaagggctaatttatttacttaagggctaatcaataatgaatactgtccctttttttctgacatattttcctcaagactcattaaataacttctttaaattcttggttgtaagttacagaaattcaactctagctagcttaagtaaaaataattgtttgactcatgtaaccagtctgccaaaggaataggcatgtatgtggaatgtcacctgtgtgttttctctgcatgccctcttcattgttctgctgaagactggtctcttcatgtgtgagggaggaggttgggtattgagggaaaacagggggcataggctatgtctacatctttccacctttacagaagaaaataatctttttttttttcataattcagaaatctagggttaggagctagattgagccaggttgggtatgataatcatcaataaaactatctggttggggcagggggcgtggtatagggaggaagaacagtcatgtccagaaaagagtgagtttgtaagacacattttccggaggttttgtttcgttttctgtttggttgtttatatattctagatattaattcttcttgtctgttagatatcttctcccaattggggatttgtctttttcctttgtttatagtgtctttgttataaagaaattaaaaatcgtaatgcaaaacaatttctcaatttctcagtattttttgttatgtgattttttttttttttttttgagacaggctcactctgttttccaggctggagtgcagtggtgtgatctcagctcaccacaacctttgcctcctaggttcaagtgagtctcctgcctcagcctcccaagtacctgggattacaggtgtgtgccaccacacctggctaatttttgcatttttagtagagatgggttttcaccatgttgggtcaggctggtctggaattcctgacctcaagtgatctgcctgccttggcctcccaaagtgctgggattacagccgtgagctactctgcccggcctgttatgtgatttttgatgcaagaaaattttttttccatcccagtgttctaagagaatctcctatgttttcttctttaacccgtcgaaagtccatttttatatatggtattaactgaggatctaattttatctttcttctatatagtctgttggctcaggctgtttattgaatcctttttctactgattcatgatgctattttggtcacacagcaacttatcacatatgcatggatctgtttctgagctctttattttgttttaatggtgttatttgtacctgcacccaaaccatgctgttttaactcctgtaactttataatacatcttgataggaggtgaagagattctctcatcttgctattcaaaattgtctttgtggccaggcatggtggcccacgcctgtaatcccagcactttgggaggctgaggtgggcagatcacgtgaggtcaggagattgacaccatcctggccaacatggtgaaactccatctctactaaaaatacaaaattagatgggtgtggtggtgcatgcctgtaatcccagctagctcagaggctgaggctggagaatcacttgaaccttcaatagctaattgattgaatttaagagaattatctttgcaatgttgtgttcttatctgtgaacctaatattcctttcatttattaaaatcttcatttgtgtcctttgataatgcttagcaatatatatagtccttagaggtatcatatgtattttgttagatttatttctgggtatttcatttttttgttgttgtcttttaaaacagtagctatttatttattaaggtttctagttactggttgctggtgcataaggatgtgatgtatttttcttttttaattgaccttgtatttccctgaactgattcccaatactgtctgcctggaaagtgatgacttcttttttaagacctggctcaaatttcatcaactctctgaatgtcccagatattcagatagctaggtgcttttctttatgtttccataagctcatatgtttcattttaatataattccttttgtttgtgtggtaggtcattgaggatagtggttgtgtcttacctatttttgtctgccctgttcccagcatagtgtagctcatacagtcagagttcacaaatcattagctaaatgggtgactatgtggaagactgtaataccactacagagagaaaaaggtatttcttttgtgggagctttgttctgttttttcttctctggttatttatttgtttatttatttcttaatggcaaggttctctagtgtctaaccttcccttttcgtagtaattaaatgaatgacaatgataacaatagctaatatgtattgagcacttactatgtcctggtactatttgaaatatgttacatttgttagcttatttctttcaacaactccacttctgatattaccattttataactttgcatgttctgaggagttggcatatcccaataaacaatgatttgtatatcccaatatgcaaaaatttcgtggaggtaggatttaaagtgcacttaaaaggttggagatatcttcaacttggtcttttgtatataagattgagtagtaagctctataattgctctttcattggacttcacatgaaaaacaatcacattttctttctccatggttatgtactgttagaagtaaaatctaaggcatctcaagggtccaaatcgaaatctttgctaaaagacatcagaggaaagtgaagacaaaacaatctagtccttcaaaaccccctgatttccttggatttgtttgtcagaagattttgcatttctattttaaggcagatgcagatgcttagtaatttaatccctactcagaatagattaataaatccagagtaaataactccatggtgacccattgctcttggcagctcctgctattcctactgcaccatcagactggtctggtagctataggcttggcttttaggtgagatatttgtttcttcttttgatatgataaccgagtattgcataaaataattaaattgtcatgacagggaatgtctgcaaataggtctggccttttgtttctttcttcaaggtaaacagctgctgttggcttatgaaaagctaaaaatgatccaacaagaagcctgtatccgtcacattgaaatcagagacttgattaatattgtagcctgtagctttgtgatatgtacggtttaaattagacctttgcagtcattgtgctgggttgatgcaagcacattaatgacataatttctggttgcagcatcacatttctgcagtctgtcctttgtattccactcacattaattgaagtaattttgccagtgaagcgtgtttcaaacctctgcatttaaattgaaattttaattcccttattgtcttgaaaagacggctgaagatgccttgttacaggtttcattatcactcaaaacactccagctgctggttctaatgtacaaagagtgattaattctgggaagaattattaatataagaatagcagcttcttcccagtggcatgagccaaccaggaaggtatttcatgatagttaatattttcataaactttttttaagggaaaatgtgtgtagaagtctgcatcaaactaaaattgcacagatgagctttgaaaaccacttacacaagttctgatttatcatcccatagaagtcaattcataattgcattcaatcagtggaaaccaagccagtgcaaatagttttgaagcactttagctgacagtcacaaggcttgtgactaaaataatttcatttctaagccttcctgagattgtagagattttgaatgtctcttaatcattttgtctgtctttatttatatgccttttaaaaagaatccatagctgtatagtcagataagggttattatgataattataataacaacttatatttatatatctgccttcttcccagaggatcccagagtgctttgctgagagaatggtgtaatgaaattatttcacttacactgtgtaaatgtggccatatctgggataaagaaattagggcagctatttaattgaatagttttctaagatcttatgtaataaaataaatatatttgtagtatttttagttaacaagatcctttggaattggataacatggtgggttgtgaatgtcagcatgggtcttaatttgggttaggtcgtctgatgcttgaatcccagctttgactcttagtagctggatgacttatggttagtaaattatctttgctgaaagctggagttaagaataatatgtatctccaagggttgtcgaatggattaagtgagatattaaactgtgtacataaagtatatgcagtataaagtttttgaaatgttatttataatcgataaattttactgatattgtaggaaatgatatgatgattgcttccatgttataatctcaaaaactgcctttgaggtggacttcttttgagctagtaaaagttgaagtagggttggattaagcagttttgattccttttcttcttggcctaacatggatgtacctaaatgaaaaaccagcccaccttttttaaaggtaaaggaactcttgtgggtggatagggtttttctcagaaagcaattctagtcttctctaacaattctgtgttacatttctaggatttggcatggacaaatttcagattatgtgttatcaattacttactcggcttacattaaaaatatgttcatagggtacccattgattgtataattctgagcaatgtaatttgttggtaaagtatccaagatgagcttgtaaaatctacttttaggtaagtaaatatgttaatccactgggtatcatcactagataaaagccagatcagtactggaagatgtttgtcgtcagaacattttagtgttagaagagttggtgttaagctgttgtttctgtgagtgcttagatagcaggaccagtggaccagtgaggttgcttctatttgtgtcagtaaagctgtgtcattagcaaatagactgatcttattttctcttctttatgcgcaaggaatgggtgatcatgcatccactgagaaatgattaatgtgcaagcaagaaaaaagggagccaaaacatacatacatcccttttatctggcttgaaagtttctgagatctcacagaactgttttttcttattactctgggaaaagtatcgatgtgaaagctctgtagataacaggagctggaatattctagtgagcttattggactaaacctgaaagtggttcagtgactgtaaaacaatgttccagtattccgtatggattttccacaacatgataaaaatatatcagtgatcaataatgaaatagccattactaaaacccatctgttcctagtgtagaagagcagcttgaaagactgaggccaatattctaagctaataatttatcaggaaagaatctggcacatattttgataaagagacaaatgattgggtctttaacatgtgataatgccattgttgataacttctgttgtttgtatgtgtatgtgtgaaggtggccttaaccttggaggatattacttgctagtgggaagagacagatggtgaacaaatagtgtctctcatattatgttaagtactatggagaaagctacaataagacagggagactgggagtattgggatttggggtagggatagtgtggtttgctatttaaataggggtggtcagctgtagctgcttttagccgcatttgagaccccccttcattcttctcttgccttcaaaaagatttaggaaaagctgaaaacaaaatgagtaattttgtttttttatatctacaattaagtgagtaggtttgtgacagttttatttttctcttatagagtagaagtgcaggggtttgtggtagctgtttttcatgctgctcaaggccctttttatttatatttgtttttgaaggctggggtttttagaaactagattgtttgataggcacctggttattgtattagttttcctttttttttaaattttgcttttttatctgctattcatttgcctcttttaaagccaatggaaattctgttttattgcactaaagcctacgaggttcagcaatttccatttggcttgcttggctatggggcagtgattcccacactgcacattaggggatcttgcaagaattctaaattcaggtcacatcccagaccggttaaataaaagtctctaggggtgggccactgacttcagttattgacattctccaggtaatgccaatatgcaggcaacattggaactattggtgtagggtatagcttgttctgtggaattcagcaaaacttattgtccttgtcttcatttagcaacagtggtaagtagttggaaaccaagtatttatgtaagacacacatcacatggtgatactcacatttatgtagaagtttattgtttgaagttgctttgtggccatactttattgtagttttgggatacagctaatgagtatttggcttttattctgattttatagtctgattatttggtcaaatcggtttagtagttaaatgagatgatttagtagttaactcacttagtttttaaatgagatgattctccatgtttggactgacttgcactctttagaactgtcattttgttgctctgatttgtgcatctttgctgtgggtcctgatatgacctactgcagggatttaatggattgaaattagagaatatgtttattaatttacaagtggtgactatgtatagtgtgtcatagtggaaacaaagtggatttaaaagcaagaagttcttaattctagtcctgattcaacaacttaccagttccttgagcttagataaataaattacattatctctctgttttagtatccttatctgtagaacagataaacagatacttacctgtctactttatagaatggttatgagaataaaagtgaaatatagtacaggaaaagtgctttgtaggatataaagcagtataaaaatttaaaatggtgtaggtatcatcgtcgtcatttccccatgccaggtaaaaagaaaatgcaggagtctgggcttgtttacactgagcagcatttctattctggtgctaccatcattaatgcataccggttttaatcagataaaccaagtgtgactgtgtttgcacacttgagtgtacaggaagaatgctctaagtcgagaataatacctaagtcgtttgctgccatcctccatcatatttctggtttcaacctcacatacgacctttcttgaacagatttttgattggtcagtctgtggccagatgggaactagatgtttgtgtaaattgcagctgatgacaacccatgttgttgataggggacttcagtctgaacttgatgatggtctgagaatgctaatgagtagcttttgcttggcttgacaagataggaggagcttgttaaagaagtctattttctctgagattcatcccaatactaattacttgtggttgcctagctcttgaaatgaaaaacgccatattcctctatcattcctttgtgggattttaatagttcacgttagtaaagagctgtgtaagtgctgagcatttctaatggatttggggctcttgcagagtgtgggcgaaattgtcttgattgaagtgcgagcctgaagtgattctgagacctcctttgccaactcttaaaaagagagttgttctgtaactttttcttgtcccagagtaacaaataacatgacatggtgagtgactttaggacgcttgttaaaagagaatggcttttctagtggtctcttctattggattttgtagtagaaacctaggttttaatgctctcttacagagcactgatgggaactgggaattgaagggaccatgaggttaggaacaaaagaggttttttttctaagctttcctatgagcagtttacaattatctttctcttaccgtgttacgtatagtttaatttcttcaggaaggtaattgtgaacagatctgttacaaggccttttagaagaaataaggctctcaatgtggaattatgcatcagaacccctagaactatgcatagcttaggacttgagatctacttctagaattttattttaaagaaagaattaagaattataactgttttgtgttacaaatatgtatacaaggatacttatcacagtaagatctatgaaagtaaaaagattagcaatgacttaaatatggggaattggtttaagtcattgtatagtcatactcatggactagtatgaaaatactaaatataatgtttagggataggcacatgctcccagtgtattgccaaatggaaaaaacatgtttaaaaacaagtatttttgcaaacactttgcatggaaaaatgattggaaagaactaggttaaaatattatatattattgcatcagatgagtgacaatatgatgatatttttcttttgtaattttctatgtttttcaagttttcttggttgagtaggtattatttttgtaatttgggagaaatgccaagcttaagaaaaaaataccattctaggcctgacttttttttaatctgtgaaattagggtgggaccccagtcttgaaaacctttaaaggtctctttcaatagaaagttcttagttttcatctctcagatactgccgttctgtgaggctcaggctgatagggtatgttagaagacttggctgttgctactttaggaggggaaaaaaaagattactttcgctttaataaaatatgggaattatttgtggcagaatgcactgatgtttaagggggaaaaacaaaaaactaacaacaaaagagggaaccctgaagaatgcttaagaatagcttaataaaatggtatgcttttagaacaagtccgcatttcatggtagtaatagggtgaaatctttcatgaaggaagaagtcacatttgatcctgttttcgagttttattttccgagatagatctgaagatactttaaagaataaattcacaagtaaagggccttttctttgacagcactttatcttgcaggcccccctcccttcattcacttatcaataacttcatctaatttgccttatcctgtaaattccattatctccctggcagtctattgcattaagcccttagtacctaatatcgcctcatttacattgacatatgcttgacctcagtccttctcctctctttgttaatgcaccaacaagcactgatatctctctggagcattatcatttgctgttagctcaactaataacaacccctcatttgagctgatgaaggtttattaaataaaaacatgcagtaaccctggcagtaatgaagggagaagggaggtagacaacatcctttttttaatggtgagagtacaccaagtctgctttataggtattgggtttcctaagggagatagggcacctgaatgggtctgatcaatattattttatcagggtgatttaagaatgggcatttttgattgtcttacttgatcactgttgattagcatataggctgaggagttaggagaaaaaagtattcttgctccaggcacttggccttgctcctgatgcagctgtctttggaactctgtcttcagtaccagactgtcaataaccctgcagctttcaggcagtggcaaagcttggccatagggagccagacacatcatcttagtcttctccagtgaaactgaaatcagaggttgtttttcccatagatcccgcaagagtccctgaaatcttcacaatagccctgacccttgaatgaatcccctttattttccctttcacgtcccatactcttattcccccgaccaccatttgtacatgaagtccggtctactggtgtcatgctgtaaacaaaagttacgtggatgctgttattaggtttgtattaacagttgggaattttgggttcacttgcttgcacatttatgtcacatacatatatattgtggtatattctactagtaaaattgttcctagtttatctgatgcagttaaatacatagagttctataaaggctacaatgtactgcaaagagtgctgtgatgtcccagatctatcaaagctttcagacttgctgctacagctgttaggttggaccataggaaataaccaatatttgatcatttttaacttgtaaaaacagtattttcttatggttcaagttaataatatgatagataccattttttttttctaagcttcattgtttgttttactagtttctgtctgataaagataaaaatttccgacttgggaaaaataagatgtagcaatgtagaaatagttggtgaatgaatgatctgggattcttggctcctgtgtgataaatatcttcgctgcttgcttagacgtgagtcggaatcattccacattcactgggagacctggaggcttcttgtgcccacccaggactccctgatcctgaaggtggacacttgagggtggagggccctctaggggagcaggccctaaaaccgctggaggttgccttccagcagtgcaggggcaggcagcggcaggtaggtgacctgggcactaagtaaatctaggcttcagggcatgtttcttttgttcatacagagattttgtgatgttcttatttattgaatagttgagactgctcaaaaagtttgtttaactgtgtcttatgtatatgtaggaagggggaaggtatcaattctctggagtagcctaattttatatctttttactgcaactccaaggtagaccatggcaacattttcagaatggttatgttgtcttgctagaaaaatgcttccttaagggagatttactgacctagtgaaaagtgataaaacattttagaaccatataattttcagagtcctcaaagaaatatttgttttggattcaacaatggcaatacatttgctttccttagggaacagtgttgccaaaataagcattttcgttagctaccagatggtttagttatcagttttgttttttgtttatacagcagtttttcttctttttttggcttgaaccttatttctattcacaaacagttactgatgtcgtttatctttgtgtgtcttactcacctcaactagaaaaataaaaagatcaatagtttcttttacaacatttcttcaacaaagcagctgctgagaatggccaagtttagtgttcctccaaaatatttacagtggttcatgtcagaacacaaaactagatctttttacatgataagcgtgattaagattggctaaagacaagcattaactaggaaataattatttcctgtattttacactaaaatgaagttgagaaatagacattgggaaagaaaatttaagggtatggtggttcctaattgcaaagattttcctttgttgtagacttatatctcaactcaggcaaatttttttgaattcttgattatatacattttaactgtgtgttcaagctattcttttagttatagaaacattttttagaatttttgttttcatacatggataggtttctaatagcaaaacatgctttcctgttcaatatcatgtgataaaacatttggaaaaggtttgcttatcttcataatcctaaaggaaatatttattttcaattctaaaacagatttctattgtctatctgagcagtttccaactgtgttgactagaacattaatattctgttagatggtaataggtgttcggtgaaaaaattcactggtagtcatatctgttttcctccaaaatgcatttaaaaatacttatatctgtctatatatatgaagaattctaaatacatttaggtgactcattattatatagtaatctaacttaaagaaactgtgagatatacctgataattctaggaggtcatattagagatcatttggcacatgaatgcgtggtgtttgatttgtgaataggggaatagacagcatttaccaattcactgtactgtggatgttgtctgtttagtctttcatctgctatgttttatcctgtaattttaatatatatttgtgacattattcagtgttgcgtgtcacacttatgaacctgtttttttttataatttcttatagcagctacctaccctgtgagactgtcttgttgctgtctgcattaatccaactgtgtctctttaatttctgttaatctttcatcagtgtgttatttaaaatgtactctgtagtcattacatttggaaaagtgcagtaatttatacaatgaccacttcccatacattaaaacaatctttttatcattaattatgcacattcctaaatacagacgattattttattatttctagtaaatctcaaatcttagtaaatacctggaaaccgtacctccccagtacaacagaattgactgtcagcggtagtctgttgggttgactgctgcctcactaacttttcctttgtgtgtaaaatttatgtttcaaactccttaaaaccagataagattaatgttagggctgggcgcagtggctcatgcctgtaatcccagcactttgagaggccaaggtgggtggatcacaaggtcaggagtttgagaccagcctggccaacatggtgaaactctgtctttactaaagatacaaaaaattagctgggcatgggggcaggcatctgtaatcccagctcctcgggaggctgaggcaggagaatcgcttgaacttaggaggtggaggttgcagtgagccatgattgtgccattgcactctagcctgggcaacacggcaagactccatctcaaaaaaacaaaaaaaagataaatgttaggtttctaaacatatattctagagagcaaatgttgcattgacaactattttctttaaattggtttgagtaccacttagtatggttagagtaagggaagacagtggccttgtccagcttccataattatagctttataaatagactatgaataagtgaaggccagaaaataaaacacagtgttttcttatagaaataagagactattctctttcctcttttgtggtaaggttttcaaatttttgaagttctgagactacctttgataatatatgttattatgttatcttgtattttgggtcaaggaaatatattcaaagtttgtcatttaaacagttacaatggctcaaagaaggaaggaacacttactgaaattgcttcactaaaacatgttgggaatactctctgaggtttctttactcatggaataaataggtactgttaaaaataatttcagtgagcactcaggagctgccaggcactgcgctaagtgttttacctgaatttttacttttaatttaattaggtgactttgaaagttgacacttgtcataaaattctgtatttggaacatgtactgtttgggttaaaaatcttcatgtacattcctacaaacaaatcaagtgtggatgtgcagtgggtggtttttaagcttaaatatctcagctggatttaattaccttaagggataaggctacgtgatgggccagtggtttaccaaattatttttcattttctggatctcagtgtcactgaaagttaatgcatcctctttctctgctagagacctgagttaaaatccattttagggcataagtataaatgaatttgttgttgttttttcctccttggggacactgtggtcattttgtgaggctgcctttccatttggaattgctggcagcttgctctgggcccaggggctctcatagcaggggcagttgcaagtcagcgtgaaaatgaactggtaggcttcagagggcagagctggcccagggcttgtcactctcccattccttgattctttcttggttaacttaaggaaacttatttgctactgacatttgattatagcacatcacaaaacaagtgatgtggttgtggataagccatcacattttctttaccatttcaggctggtttatatttggcagctacaaaggtttctctgttcactgtccacagactcctagatgactccttagactgctgtagttgtgtgatcaacatttttgatcaccaatgtgtttcatggctttaattacctattgttttagtgtaaatggttcattctttaggagcgtgtttgtatccataattacatttaagggttttaccctgaagtattattagttatttcctttatctgtacctattaggaatatttagtataaccaaagcagggaataatacgcatagcatttcatccctgagggagctcacttgtgttctttccctctaagctcatcctgtcatttctattttctctcaaagaatagcacctagagtatgctctttaagttttctttgaaaagatacaagatctttacacataaaaacaaacataattttgtgtacatgaataaatgggatcatatcatgcatgctgtcttttttttttttttcctttgcagatgtcactttgagtttcaaagtgagttggttgctccaggttccctgaatccttcatgttctccatttattgtaggcattcctataccagtttgatttatccagtccttttgtcttgaaaatctcccaaaccactttgcaccgggagtatcttcctcttcatgttttgtcttccagtcaccattcatatcccgtttcttctatcaaactgaatcaggacaaggagaggtgatgactactattgtccatttgtagcattcatgtaaaaaaatgtatttacctctgtgtgatgtgtatttgaaaaagagtgagagagagcccgactcttggtaagcacaaagagtcatgattgctgtgagaacaagttctttttaaaacatttatatagtgtgcttttttttaaagccttagtttaaaaaagctaactttgagtaaaagttgattaaaccattagtacatgggattcttgtgagaatgtgaatgatagtatcatttaaatagggaggtctttttacacgtgtccattgacagatgtgtgtgggcataaatagtttgctatggtggtgtgtatgctttcatgtttatctttgtctagattgttttatcattacctaaggtgagaaaaactctcccctagccacattatactctacgaagtcttttatatgctgataaagttctcgtaagctccctttgttagtatctttttaagacgtctttcttatttataatattgccaggttattaagttgtacttaattgtctttcatttttttctcttttcaggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcaggttaaagaggctctttgctataagtgtcttgtggcagtgtaggattggaaggaatattttttgtttcccagaatgttgttgtaatttattttacttttcctttaatggactgtctctgaaacttgaagatggttttataatagcaaatactccatgttctgagaggctgacatttgaagtttgttcattcattcattctacatttattatggtccttttctgtaaggatatataagaagcatttactgtgggtctcatattctgaatcagagacattggtacatctcagaaggaagtagaaaaattcttaaattggactgtgaagtcagcctaattaagaaatgtagatatattggctgggtgcagtggcttatgcttgtaatcccagcactatgagaggctgaggtggaaggattgcatgagcccaagagttcaagaccagcatggacaacagagcaagactctgtctctacaaaaaaagggccaaaattagctgggtatagtggtgtgcacctgtaatctcaactactccagaggctgagatgacaggatggcttgagcccaggagtttgagcttcagtgagctatgatttctccactgtactctagcctgagcaacagcgaggagacctggtctcttaaaaaaaaaaaagacaaaaagaaatatagatgtattgactgaatgataagattctttattacttagggttatgttcagctttaggttgtcctttttctggaatagtttaggaaaggttcagagagaacacttttattccttggttggttgtagcatagccctatatttaatggcctgggtagtctcaagaaattcattaggttagtagaggcctggtagggaataagactagatcttaagatggtagaatattggaatttttaacatatgttagatagctgtgcatagtacatgtccttccaatattcctttagaatagacagatcttttcagagggcatttcagcactatctactgaaatatacatgttcatgcttcttcattcagatatagacaagaagagcactggaagcagtgcacgctgggaatgaagtctttcaagtcttatcctgtttgaacaaaaaacgccaaatttgcttgtgatgcttcagtttaatcagagatcctgacagagaaagagaggtttctacctcttttcagcagataggcactagaaaaacttctgccaggcacacagatttgatatgtacctgagacataacttcaagactagctctgaatagggtatctgtcagtacctcagcagagagtgaagtggtgaataggggaagtgctaaggcattctttcgacaatgcctgctgataaatagcagatctgaagagatttcttcccatacaaggttaagtaataaaatcactatggtcctgtgaaaatattctgtattataagggaaaatgagcattatttgaggtctcagaggaagaacatttattttaaaaaaatttctgtaaagcaagcaagaaacatttaagagacttaagctcaaggtttctcaaaaaatacaagaaacacgatgtagtagattattcagaataatcactcatttcccttctacttttgtgggagaggagtatttcctacgctttttgttggggccttggcttttgccatcattagggtacatgacacaagcaggggcttcaaacgtgcttatgctgttgagtgtggcctttcgtgccactgccattgccttgctggcggtcccaggagaagggtaagagacacatggaactgactgaagatcagcagacctgcctagcctgcatcaaccaaccaccaaaatgtatgcttattgttgaacattattgagattttgtggttgtatacagtaagcgcatagcttccatgaaaacagtaaccgggagctacaagaacagagtgaggagagatgctaacagagctaactaaaacatgaataaaatgtaaggaaaccaaaatgaagtagagaaatttaagtctttaaagcttcagagagaagatctgaatcactgatgtggagggaaaaacttttcttgatgaagaggaaaaagacaagatgccaaaaggaagaggataaatatgaaagatgaacagtggtcaatccagtgattttaggggttccagagaatcacactaaaatgatagtgtttggggctgaattatgttccccctaaaattcatatattgaaaccctaatccctggtacctcagattatgactgtatttggaaatagggtcttttagaaagtgactaagttgaaatgaggtcatttgtgtgggctctaatccagtaggactgatgtccttataaaaaggaaatttgacacacttggagggaagaccatgtgaagacacagggagaagatggtcacctacaagcgaaggagagaggtctcagaagaaaccaactacgcccacaccttgatcacagacttccagcctgcagaactgtgagaaagtaaatttctgttgtctaagctatccagtctgtgttactttattatggcagtgggagggaactcagacagaggggatcagaagcaataattagagtataaataaaaaaacctacttaaacaggaaaacaagaccttggtctgcaagttgaaagaatttaaggtaaaatgaataaaaaaaagttactcttagatataatctggaaatttttatgattttcaaaaacaaattttataaataccaggaagaaatattatgtgatctgaagtgatagagataattatttgcccacccaatgtccattcttcccttcatttttaatgacaatctttatttcgttcctggtggctataggcccagctaaaaggctgcattttccatcttcccatatagctagagggtgtttagtgggacttcattttgcaagctgttgaatggggaggtcattaattttttaaagataccaattaaactggtatgctcactcttttacccttcatttgcctttctttactttctatctgggacatagattggtgccatcgagccgtcctagacacaaggtgaccttgaggatagaagccacatctgaaactccatgatcaccttgaacttcttttctagccctgggtggggtgcctctttaatgtgagaggaagtctttgttttactcagaccactattatttggtcttctttttatacacttaaaaccaggtcagttacacagaaaggagcaaaaatcaggctcaccaggatttgctgaatactaaatgccagaagacaatagaacaaaatctataaagttgaatggagaagagttgggaccaaagacttttctagccagccaaggggacattgatatgcataggtggccaagagatattctcagatatgaatttataataaaaaaaattagtattctttttccgagcaaaattctcagagataaactgtgagacgtacaaccagagaacaataaagttgtaggtagtttgaaacaactttgaggaccacataccattaaataggtacatgtatatatatatgtaagtaactgacaaatatgtttttacaagattgagaatatcagctaaaaaccattgtggaaaaaaaggtcagccgggcgtggaggctcacgcctgtaatcccagcactttgggaagccgaggtgggaggatcatttgaggtcaggagtttgagaccagcctggtcaacgtggtaaaaccccatctctactgaaagtgtaaaagttagccaggcatggtggtacgtgcctgtagtcccagctactcaggaggctgtggcaggagactcacttgaacccaggaagtgaaagttgcagtgagccgagatcacaccactgcattccagcctgggtgacagaacaagactccatctcaaaaaacaaacaaacaaaaaaggctatgtagtcaaggagtactctctaacagtaaacagaatttatatccctttttactcagttaatagtgactaggaaatttggataggtaggagaaaggaatgctgaattcttgcttaagatgagtgtgaagttttgttttcgactttaataattagagaaaatgtttaattttgtttttactaatctagatatgtatatttaaaaatcaatagagaagacaaaaatattctctattacaaaggatattgtactgcagccctcctttgtcagcaggggatatgttccaagacccacagtaggtacctgaaactgcagatagtgctgaaccctgaatctacctgcacagtaaatcctcacttaatgccctcaataggcacttggaaactgtgactttaagtgaaatgaagctgtaacttcaagtgaaatgacatacagaaggtcctagaataacattgtgtccttcaaggtcctctgctgatgagagaaaaaaaattcgtttcattatatgccaagattcttgattgcaaatagaggaaatcagtctgggtaactaaaacaggaaaagaatttattggaaagttatcaggttgttcacagaatctatgggaagtctgtataatcaggctctaaagcccagtaggaaccaacggagattaagcagctgagcacacacagtcttagacaagccacaggaagggtctgtttgggttgctatttttgctggcaccatgcccacaatagctggattttaaactcctctgtaaatgatctctaaatgtccctgcatctttcctttatctcgtcaagattcaaacttctggactcaggcatccagtttgctgagcctgggtaatgcctggactccttcagcttccatagtaggaagtggggccttctttttgctttgatgcagtcagtggggatggactgttcagatgtttggtacccaagacaaacacccaacaaatttctactgcaagagaaaacaaaggaaatcacatgaaggcacttacgtataaagaagaccagatgtttttgaagtagaagataggcagtagaattgacaaatgaaagaaaggtacatgctcacatacaaaaaataataaaaattttacttggaggaaatgaaacaaataaatggtgagactgtccttgttcttagctcatgaagatgtcagttccagttgaaaattttgaaactgtcaaatgaaatctaaagttcacatggatgaatacatgcgtaagaattgtttaaaagaattgtgaagggaggttatgaggggggcatttcttatgtgatatcaaagcatattgtaaagctgttttagtcaaaacagtacagacatgcaaaaataaatttttttaaagaaaacagtgcagacatgaagtagaaaatcagatgggtgagacaaaatagagttgagaaatagaccccaggatctatagactttagtattttgaacaatagttcagctggggggtaatgaaggctatttaatatatagtgttcagacaattgactgttgatttgaagaaaataaatttaggtgtctacctcttatgtacaaatgattcagccagatttaaaaatcacatagcactgtattagcattaggaaaacgtgtaggaggatatgtgtggaggagcctttttcaagcatatcagaagacataaagaaatatattaaatggtttaaccattaaaaaacccaaaacttatcttcaggaaaacagagtcaaaggataaactatactctgaggaaatatatgtatgtcatataacgctttaatatctaaagcatgcagatatttgtaagctcagtaaagcgggatatagactgttcatagattaaaaatacaaatggctaataaatataagattgttcaatatcatgagtagtcagagaaatacacatttgaaaaattaaatgcagttttttgttcataagatgatcaaaatcaaagacattgatagcatgttatgatagcaaagatggcggaaatgcgtagctttctcttgatggtggaataaccaatatgcctttttggaaaataaatttgcatattctttgtccagagaattttgtttctaggtctacatcctacaaaaacagtaccagttcataaaaatatatgtaacaagatattcattgtgacattgttggtaagaagaacaaaaatattcagcttaaatgttcatcaagaggagtatggtatattggtaccatgtaattacagaatttcagtgataatgatctctatgtgctgatatagaaaggtttctaaggtgcatttttgggtcccaaaagcaagttgaaaaatagcatagatagtatgaacctatttgtgaaagattgaaaggatagaaacttaaatatgtatactttatatattggtataaatatttgtatgtgtatagaaaatgtcagacagataatgtcaaaacactgataaaaggaattacttgtgagaaatggaaatgtgaggtggggaatagggaggtagaaattcttttatttcctgtgtacatcatgagcatgttttttaaaaataataatacaattactgatgatccttttgaagatttttaaaaatgaaatgggaaaatgtttagattatacccttgaagggaaaaactagaattcagatctatgcaggatgatcaaagaatgttgaaaaaggagcatgcgtgccatttttgtgttgtgtgacgtggggggtggatggacagacactcatttttaaattttttttcaagcagtccttgtacctcagcctcctaagtaactggcataccactgtgcttggccttgatgctcctttctgtaagatgttttggaaggcagtataccaaaatgatgtgaatggattattttttttttaagtattttcaagaaagaatttacacctttataatcggataaaattagtaaaaagttgtttaaaaataattcttttatttattgcatgatcctggataatactcggtttaaccttgcttcctcagccatcctgggacatcgtctagctcatggaagagaaaatttggtgtccatatttgtctctgggcatgtaaagaatgttcttcactgcattgtattcattccctaactattttgtcttttaaagattttttttctgtttacatatgttggttttctttttatctttcagttcttgttttttttttttttccctcttggcttagattttaaatttttagcctcactttattttctgttaccatgtcttcacccttggtctgtcatttgaaacgatggctcttttttacttttataccctttaaatcattcttattctttctgagtgttccaacagatcttagaactattgagaattattatgccagccattcctgtttcattatttggtgaagtcttactaagggcacgttatctttgacagatatttcttagctcagtttgatttaacaaaattttatgagcacttgctctttgacaagtactgtgccagctgttctggctatataagtgaatatatcagttattcgatttacaacttaaagttcaactcacctctgtcagtttttagtttcacaaaattagccaaatgagttgcagttgtaaattttggacatagttgaacccatttattgtgaagtgaaggaacagaaatatgttataattaaaaagtagatgtttaataagctgtcagcacttctaacccctcttaaaaaactgttttcgtatcatgaaatcttgaaatctaacatttagaagcagagctttactagttggatgttggttaatggccaggaagtccttgaggttacagtggcagtggttgttgcttgttttgggtttaatttgttgtatacttttcctgtcctctaccatgttgctattggcaaaatgcattcagtcacaatatataattggtaattttggggggaccattttatactagcagggattactgtacatcagctgtcttttgatctcagctatgaatgattctgaatggatttaaaataaaaatttgtaatcatgtatttaaaatgaaaaataactgtcagtatttccaaaataacgttataatttttattttattttttgttttcaaaaaatgctttctctgagggattaaaaacccgttgaaggtattaattaatcaatcccttctcagctttatctctgatatgtggtgagaagaggtctttttttctgttgtgaaatggaaactgaggtccatattacttaatgcaatattctacaatagcacctaccttatgctgagcttcattcatgtctgtagtcacaaagtgagtgggtgtgccccctttctctggaacttttgagactaagtcctttcataaaacagcaggagaaaaactaaagtcatttccagagttacttgcctttgggttagtgctcaccaaggagaaaattgaagcttaagggaaaattttagagagagagatgagtgtatgaaaatagttttgcagtaaattgactttctaaaagtttattgatggagtttgagggcccttctggctctgataataaaatcagcaggttatatttttcagagttgaaatggcaagctgtttatcaccctaaatttaactgaaatatgtttttaggttaaaactgagaaaataattgtaggatttaatctagagtgatgtgcatgtacatctgtgttcatagaagtgtgtactatgataaatacacatataaaaatatcagtgtgcacacacatagtaacaactgtttcatcattaggtgtggcaggcagtattccagctatataattgaattttcctgctgattgataccttaatttatctgtactttaaaagtaattcctccactttgttctagaaatatttaaatatttagacaatgtattatatttttcctgtcatttaaagttgaagttttttttactctgtagcagtaccataaacctgtgtctttttttacaattaaaacatttttattttactttattcatttgtccattgaagcattttatttgtaaatatgtattacatccatagatgaagaaccccaggattttctctcctgtgtgtttttgtgttgcttcttcatggtccatgatgtgagctgagtcagtacaatgaaaccaaactggtgggatgggagcagattagtctgtgatttttctagatttttctagatctttgagttggacatcaaatctggggctgatcacacttgctcacaacaacttgttcacactgtgaggttcccaataattttcccagctctgtgatcatcagtgatttcaaattcgctcatgtgcccatgctttgtcatcacagttgatgaagacactagacagtgactttggagcaaggtctaataagaaccaggtgtttgcctctcttttcggtattgtcgatgctctggaaagcagcaaacaggacatttatgcacaccattagggtggcacggaaagatggtggaaagagctctttgtgtctttgggcatctgtatccagggcctagggggacctgtgaagtgttttgtaattgtgagtaaaatgcaggtgaaagaggatgacgtcattgagaggaaaaaaatgagaagacaaaagaagtcataaaacatgaaagaatggacaaatctattatctaatttattttataaatagataaaccattatgaaaagttattggatttgaggactgttggattttcttaagatagtttaggctaggaacttacaggtttacattggtagaaaagagttgttgggaggatgccagttcaattcctggtaaatgctttctgttactttaatatcttatactccacttttcacattagcctgtgagtgattttaacaattggaaatatgctgtttggtttagttcatatcttagtcatactcacattcttagcactgagcacagtgccaagcacataatggatgctgaagaattgttcgagtaatgattccctgtttccctgtaacaagtcaaaagggagacgttaatgactgtcatagtgatcctcaaggcctaggacagtggctcctacattatttgtactcagtgaaaagaataaaaccttatgtgataatttcactctttaacacagtgtgaaattatcacttgaacccgaattatcacttaacaaactttatttttcaaagatctctgaaaaaacatgtttgttttttattggattataaatacacacatacctagcacatttgttccaaaaggagtgtgtgaaggagatggggatatattgctgtggtgggggcagatgttgttcccaattgcacacatccttccttccttccttccatttgaagaaatctttcctataggcgtggtctcttctctgcttcccctttgcctgctctagccactgctactgatgatgtatttcagtactaaaaagtgagaattatggcttccacttccctacccttggatttggcttcgaggggctcttctgttgtagatagtgtgcgagatgattccatttcttgagagcagggcatagggtttagttggcttggcatagcctgcattctttcacttaacaggtattttgagatgggaattaattggaaattttgttttttatagttttcatgatttaaaattaatgtgtttattttgaaggaagttgatttatgcgtttatttaaagtttattagtttatttaaagttaatcattaagatgaggggcttggccttcttaggaaaggtgaaatgggtaaatactgaattaacctgtttgagatccttaaatcattttaattgttgtgattgtccacgtcatgaaatttatgagtctcttttaaagaaaactgaatgtagtaaacttccggcatatgtcaaaaactatagcctgaaaaacacaagtaaacactagttaaacctttattcagtatcatggcatgttgtcatttgatctttctttgttgataaattaatatttaatacagatacaaaggaggacagtgaaattgcctggcatagtgttattacaaggtggttatccagttgatccagaatacactacactaattttttaaacagcattgaatgaaatgacaaaataaaaatttaagtacttggaacccttacaatacatttttatacccctgtctgtgacagtcacctctttattggaaatatactggggagatccagtatagtatatactggggagatccagttccagtgtaaagagggctcatgacaaaaacaaaagtggtaagggtggggctgtagtgggaggactttagttggttttgaagaaagtggtaactagtgcttcttttcccgttcagctccctcgtgaaagatgcttctgttcctctgattgatgttacaaacctccctactcctcgaaaattccttgatacctctcactattctactgctggaagctcaagtggtaagtatttaattcttcagccactaagctttttagtatgtcttagttcctaggtagatatctggaggagctttttgggggctgagctaggttgggctgggctaggtgggcctgagctaggtgtgttggaacctgtgatgagccctttgcaaccttcagagcaaataagatgtacagtgatttattgggctgttgcattatcagggttgaaaagtggcagctgaacctggcctgcctgctgaatccagctgcatctgtgttttgtttgaccagcactgtttttctttctttctttctttctttttttttgagacggagtctcgctctgttgcccaggctggagtgtagtggcacgattttggctctctgcaacctctgcctcctgggttcaagggattctcctgccttggcctcaagagaagctgggattacaggtgcctgccaccatgcccagctaatttttgtatttttagtagagacagggtttcaccatgttggccaggctggtctcaaactcctgacctcccaaagtgttggcattacaggcgtgagccaccacacccgggcgaccagcactgtttttctaaagttgagtttggatgctttttgatagagcatatgctttccattgtgctataatctttactactcctagtagcttttacttatttatctcatgtattgcattcagtgtctggtcctgggagcttctgagtgtgtgacctctgtcctatgccctctccacttctaaatgtgcatgcatccacgtgtgcactcatagtcgtacctgtaacacactttgaggaaatatctacaaacttatcttttcttctttggagatatccaatatcctattgaataagacaaagccattttggggttatgtttaaggttgagggcaggagggtatactttggatgcaaagatttaggggaatcttgtggattgccttaggcttgcctttgcagagggttcagctcaactgggcttggagagcttctgggcctctgcagagagtttctctgcttttgtaactgggttggggaagaagactcgatgtcttttgtgggatgcctcgcaggtgccttcttgtggcagccaaaatcttcattgccttttaacgaaattgtaatgtttattatcattgtcttttcagataaaaattagttcttatagttcttattagtgctgtagagcttgaaataatgaaaaggtagaaaaaaatagaaaaacaatttggattcaatcagtacattttgtgtaactaattggaaatgtttctgttgagagcttaatatattgttggggcatattttgttaccttaaaatgccacttaaaattgttttaggattatttaggcttggaatcttcaagtttattactttaactacaggaaagtatagaatttgataatagattttcctttgtttaattagtagccaagttttaaaaaattgcagtcatttatttttattatgatactttacaatagtttgtactccagcctcttcttggagctagaaaggttttgttttctccctctttctgatgtaatgttgcttttgagttttaacactgctctgaggggttgtagactgtggaattatgaaacaaaatatatttgtacctttgatatgtattttatctctgccttttatggaaattaccagttgttacatctttgcttttttgtaatgtgaatcattactgcttagcctggttatattaatttatgtaaatgttgccaagtcagtggccaagtgaaataaaaaatttaattatttatgaagaaatgacagggcaggctttgcaaatgagtgttgtataaatataaaataagctgaaatatgccagttacggcaaatttcagtggaagctaattttgctacatctattattcttactatgataggccttactttttgataggcactttatctgtcagcttctggagtttgcattcattacttagtggagttcatggtgacactctgattttggtattattaggaattactgttgaagaactgcttggtagttgactggggctaggagcattatggagactgcttgtagagatatgtataaaccttttatttatttatttatttatttgagacggtgtttcactcttgtggcccgagctggagtgcagtggtgcgatctcggcccactgcaacctcctccttctgggctcatgcgattctcctgcctcagcctcccaagtagctgggattacaggcgtgcaccaccacacccagctaatttttgtagaaacagggtttcactatgtcagctgggctggtctcaaactcctgacctcaggtaattgtccgccttggcctcccaaagtgtttggattacagtcatgagctaccatgcctggccagacgtttctttttagatgggttcatttccttgactattttgaagacttgatcgtgtgctttttttttttttttttttttgtgcgtgaccaaaaaagaaggtaaaaatattattgattaaagtcaataatagcagaggttaatatgtgtttagtgcctaccatatggtaaagcaatgtcttaagtgctttacatgaattaactcatttagtccctcaacaattttataacaatttattatcagtcccattttacagatgagaaaactgaggcacagggaggttaataattgataaaagtttacacagttgacaagtggttgtgatttcagcttagagccaggttcgactatgctcttctaaccagtttgttttgctgaaaacaagctaggtgtcctctttgtattaattttctactcacacaaacttagtggcttaaacaacataaatttattatcttacagttttgtaggtgagaagtctaacacaaatctgatagcagtaaaatcaaggtgttggcagggctgtgttcctttttggaggctctaggggaaaatctgttttcttgcctttctggctcctggaggccaccatattccttggttcattcatggtttccttcctccatcttcaaaaccagcaatggtgggtcacattcttctcatgttgcctctctctgacccactcttctgtgcctctttcctctttttaaggactcgtgattagattgattccacctggataattctggctaatcttcccatctcaaggtccttaactttaattacatctgcagtctcctttgccatgtgactaatcacaggttctagggattaggacatgaatatctttgggcaaccataattctgcttaccacactctacgctgcccattttgtgacttaagttatctttaggagcaagtgtaaaaaatttgactttcttcaaattatgtagcgaaatctttttaagtcattgcagtgtagtctttaggactctattaatctggatcacattattaaagggaattgtataaatgaggaagatgtaaattatgtagagaactgcacaaaatgttactaagtacatataaaagtatggggctgatgaaatatactataataaaaagcaggaattttgtcttattcttaataataaactggaagtcctaagagtctatttgtgaagtgctctgcaagtcagcctagaaagtaatagccgttttcagctgggaatttaacataggctcttaaagctcctctctcattttgtgaaacagtaagattgagggtgtaatccattagaattgacacttttatagaggaagttccattagggaatccctggggagtatggctctcccattgggataccataaattaagattggaggtgattcctgagaactttcaggttattttaattaaataagaattttgattgcttttaaacaagttgtttttcacgtgtcctattttgaggtagagttgtgggtgactttttttttttaaattatactttaagttctgtggtacatgtgcagaatgtatagttttgttacataggtatacacgtgccatggtttgctgcacccataaacacatcatctatattaggtatttctcctaatgctatccctcccctagccccgccctgaccgaaaggcccaggtgtgtgatgttcctctcctgtgtccatatgttctcattgttcaactcccacttatgagtgagaacatgaggtgtttggttttctgttcttgtgttagaggacatgaactcatccttttttatggctgcatagtattccatggtgtatatgtgccacattttctttatccagtctatcattgatggacatttgggttggttccaagtctttgctattgtgtatagtgccataataaacatacatgtgcatgtgctttatagtaaaacgatttataatctttgggtatatacccagtaatgggattgcagggtcaaacggtatttttggttccagatccttgaggaattgccacactgtcttccacaatggtttaactaatttacactcccaccaacagtgtaaaagtgttcctatttctccacaccctctccagcatctgtcgtttcctgactttttaatgatcaccattctaactggtgtgagatggtatctcattgtggttttgatttgcatttctctgatgaccagtgatgatgagcattttcattatgttggctgcataaatgtcttcttttgagaagtgtctgttcatatccttcacccactttttgatggggttgtttgtttttttcttgtacatttgtttaagttctttgtagattctggatattagccctttgtcagatggatagattgcaaaaattgtctcccattctgtaggttgcgtgttcactctgatgatagtttcttttgctgtgcagaagctctttagtttaattagatcccatttgtcaattttggcttttgttgccattgcttttggtgttttagacaaagtctttgcccattcctatgtcctgaatggtattgcccaggttttcttctagggtttttatggttttaggtcttacgtttaagtctttaatacaccttgagttaatttttatataaggtgtaaggaaagggtccagtttcagttttctgcatatggctagtgagttttcccaacaccatttattacatagggaatcctttccccattgcttgtttttgtcagatttgtgaaaggtcagatggttgtagatgtgtggtgttatttctgaggcttctgttctgttccattcttctgtatatctgttttgttaccaataccatgctgttttggttactgtcgccttctagtatagtttgaagtcaggtagtgtgatgcctccagctttgttctgtttgcttaggattatcttggctatgcaggctcttttttggttccatatgaaatttaaagtagtttttttccaattctgtgaagaaagtcaatggtagcttgatggggatagtatcgaatctgtaaattactttgggcagtatggccattttcacgacattgattcttcctatccatgagcatggaatgtttttccgtttgtgtcctctcttatttccttgagcagtggtttgtagttctccttgaagaggtccttcacatcctttgtaagttgtatccctaagtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagatcttgggctgagacagtggggttttctaaatatacaatcatgtcatctgcaaacagagacaattggacttcctcttttcctaattgaataccctttatttccttctcttgcctgattgccctggccagaacttccaatagtatgttgaataggagtggtgagagagggcatcgttttcttgtgctggttttcaaagggaatgcttccagtttttgcccattcagtatgatattggctgtgggtttgtcataaatagctcttactattttgagatatgttccatcaatacctagtttatcgagagtttttagcgtaaaggggtgttgaattttgtcaaaggcctttctggatctattgagatactcatgtggtttttgtctttggttctgtttatatgctggattatgtttattgatttgtgtatgttgaaccagccttgcatcccagggatgaagcccacttgatcatggtggataagctttttgatgtgctgctggattcggtttgccaatattttattgaggatttttgcatcaagttcatcagggatattggtctaaaattctctttttttgttgcgcctctgtcaggctttggtatcaggatgatgctggcctcataaaatgagttagggaggattccctctttttctgttgattggaatagtttcagaaggaatggtaccagctcctccttgtacctctggtagaatttggctgtgaatccatctgatcctggacttttttttcgttggtaagctattaattattgcctcaatttcagagcctgttattggtctattcagagattcaacttcttcctggtttagtcttgggagggtgtatgtgtcaaggaatttatccatttcttctagattttctagtttatttgcatagaggtgtttatagtattctctgatggtagtttgtatttctgtgggatcagtggtgatatcccctttgtcattttttattgcgtctgtttgattcttctctctttttttctttattagtcttgctagtggtctatcaattttgttggtcttttcaaaaaatcagctcctggattcattgatttttgaagggtttttttggtctctcttttcttcagttctgctctgatcttagttatttcttgccttctgctagcttttgaatgtgtttgttcttgcttctctagttcttttaattgtgttgttagggtgtcaattttagatctttcctgctttctcttgtgggcatttagtgctatacatttccctctacacactgctttaaatgtgtcccagatattctggtatgttgtgtctttgttctcattggtttcgaagaacatctttatttctgccttcattttgttatgtacccagtagtattcaggagcaggttgttcagtttccatgtagttgtgtgattttgagtgagtttcttaatcctgagttctaattcgattgcactgttgtctgagagacagtttgttgtgatttctgttcttttacaattgctgaggagtgctttacttcctactatggggtcaattttggaataagtgtgatgtggtgctgagaagaatgcatattctgttgatttgtggtggagagttctgtagaggtctattaggtctgcttggtgcagagctgagttcaattcctgtatatccttgttaactttctgtcttgttgatctgtctaatgttgacagtggggtgttaaagtctcccattattattgtgtgggagtctaagcctctttgtaggtctctaaggacttgctttatgaatctgggtgctcctgtattgggtggatatatgtttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccctctattttgagcctatgtgtgtctctgcacgtgagatgggtctcctgaatacagcacactgatgggtcttgactcttcatccaatttgtcagtctgtttcttttcattggagcatttagcccatttacattcaagggtgatattgttatgtgtgaatttggtcctgtcattatgatgttagctggttattttgcttgttagttgatgcagttgcttcctagcattgatggtctttacagtttggcatgtttttgcagcagctggtactggttgttcctttccatgtttagtgcttccttcaggagctcttgtaaggcaggcctggtggtgacagaatctctcagcatttgcttgtctgtaaaggattttatttctccttcacttttgaagcttagtttggctggatatgaaattctgggctgaaaattcttttctttaagaatgttgtatattggcccccactctcttctggcttgtagagtttctgccgagagatccgctgttagtctgatgggcttccctttgtgggtaacccgacctttctctctggctgcccttaatattttttcccttcattccaactttggtgaatctgacaattatttgccttggagttgctcttcttgaggattatctttgtggcattctctgtatttcctgaatttgaatgtgggcctgccttgctaggttggggaagttctcctgtataatttcctgcagagtgttttccaacttggttccattctccctgtcgctttcaggtacaccaatcagacatagatttggtcttttcacatagtcccatatttcttggaggctttgttcgtttctttttactcttttttctctaaacttctcttcttgcttcatttcattcatttgatcttcattcactgatacctcttcttccagttgatcaaatcggctactgaagcttgtgcattcgtcacgtagttctcacgccatgtttttcagctccatcaggtcatttaaggacttctctacattggttattctagttagccattcgtctaatctttttttaaggtttttaacttctttgcaatgggttcgaacttcctcctttagctcagagaagtttgatcgtctgaagccttctctaaactcgtcaaagtcattctccatccagctttgttccgttgctggcgaggagctgcgttcctttggagggggagaggcgctctgatttttagaattttcagctttctgctctgttttttccccatctttgtggttttatctgcctttggtctttgatgatggtgacgtacagatggggttttggtgtggatgtcctttctgtttgttagttttccttctaagagtcaggaccctgagctgcaggtctattggagtttgccggaggtctactccagaccctgtttgcctgggtatcagcagcagaggctgcagaacagtgaatattgctgaacagcaaatgttgctgactgatcgttcctctggaagcttcgtctcagaggggcagccggctgtgtgaggtgtcattctgcccctactggatggtgcctcccagttaggctactcgggggtcagggacccacttgagggggcagtctgtccgttctcagatctcaaattccgtgctgggagaaccactacaaacttcaaagctgtcagacagggacatttaagtctgcagaggtttctgctgcctttcgttcggctatgccctgcccccagaggtgcagtctacaaaggtaggcaggcctccttgagctgtggtgggctccacccagttcgagcttcctggcccctttgtttacctactcaaggctcagcaatggcaggcgccccttccccagccttgctgctgccttgcaggtcaatctcagactgctgtgctagcaatgagtgaggctccatgggcgtgggactctccaagccaggcgtgggatataatctcccggtgtgccatttgctaagactgttggaaaagcgcagtattagggtgggagtgtcctgattttccaggtgccatccatcactgcttcctttggctaggaaagggaattctctgaccccttgtgcttcccgagtgaggcgatgcttcgccctgcttcagctcacgcttggtgggctgcgcacccactgtcctgcccccactgtccgacaagccccagtgagatgaacccagtacctcagttggaaatgcagaaatcacccgtcttctgcgtcactcatgctgtgggctgtagactggagctgttcttgttcggctatcttggaaccacccctattttgttaaacttttccaaaaaccagctcctggattcattgattttttttgaagggtttttttgtgcctgtatctccttcatttctgctctgatcttagttatttcttgtcttctgctagcttttgaatttgtttgctcttgcttctcttgttctttcaattgtgatgttagagtgtcagttttagatctttcctgctttctcttgtgggcatttagtgctataaatttccctccaaacactgctttaaatgtgtcccagagattttgttgcattgtgtctttgttctcattggtttcaaggaatatctttatttctgccttcattttgttatttacccagtagttattcaggagcaggttgttcagtttccatgtagttgtgtgattttgagtgagtttcttaatcctgagttctaatttgattgcactgtggtctgagatactgtttgttatgatttccgttcttttgcatttgctgaggagtgtttacttccaattgtgtggtcacttttagaataagtgctatgaggtgctgagaagaatgtatattctgttgatttgtggtggagagttctgtagaggtctattaggtctgcttgttccagagctgagttcaagtcctgaatatccttgttaattttctgtctcgttgatctgtctaatatttacagtggggtgttaaaaagtctccaactattattgtgtgggagtctaagtctcttcctaagaacttgctttatgaatctgagtgcttctgtattgggtctgtatatatttaggatagttagctcttcttgttgaattgatccctttaccaatatgtactggccttgtctcttttgatctttgttggtttaaagtctgttttatctgagactaggattgcaacccctgttttttttttgctttccatttgcttggtaaatattcctgcatccttttatttgagcctatgtgtgtctttgcacgtgagatgggtttcctgaatacagcacactgctgggtcttgactttttatccaatttgccagtttgtgccttttaattggggcatttagcctgtttaaatttaaggttaatattgttatgtgtgaatttgatcctgtcattagtatgctagttggttattttgcctgttgatgcagttttttcatagtgtcaatggtctttacagtttggtatgtttttgcagtggttggtactggttattcctttccattttagtgcttcctctggacttttgtaaggcaggcctggtggtgacagaatctctcagcatttgcttgtgtgtaaaggattttatttctccttcgtttatgaaacttagtttggctggatatgaaatcctaggttgaaaattcttttctttaagaatgttgaatattggccctcactgtcttcttgcttatagggttttgcagagatctgctgttagtttgatgggcttcccattgtgggtaacccagcctttctctcgggctgcccataacattttttctttaatttcagccttggtgaatctgatggttatatgtcttggggttgctcttcttgaggagtatttttgtggtgttctctgtatttcctgaatttgaatgttggcctgtcttgctaggttggggaagttctcctggataatatcctgaagaatgttttctaacttggttccattctccctgtcactttcaggtacaccaatcaaatgtagatttggtcttttcacatggttccatatttcttggaggctttgttcatttcttttcactcttttccctccaatcttgtcttcttgctttatttcattaatttgatcttcaatcactgatatcatttcttccacttgatcaaatcagctattgaagcttgtgtatgcttcacaaagttcttgtactgtggttttcagctccatcaggtcatttaagctcttctctatactggttcttctagttagccatttgtctaaccctttttcaaggcttttagcttccttgtgatgggttagaacatgttcctttaacttggagaagtttgttattaccgaccttctgaagcctacttttgtcaactcattcatcaaactcattctccatccagttttgttcccttgctgctgaggagttgtgatccttaggagaagaggcattctagtttttggaattttcagccattttgcattggtttcaccccatcttcgtggatttatctacctttggtctttgaagtcggtgaccttcagatggggtctctgagtggccatcctttttgttgatgttgatactatttctttctatgtgttagttttccttctaacagtcaggaccctctgctgtaggtctgctggagtttgctggaggtacactccagattttgtttgcctgggtatcaccagcagaggctacagaacagcaaagattgctgcctgttccttcctctggaagcttcatctcagaggggcaccagccagatgccagccagagctctcctttatgaggtgtctgtcggcccctactgggaggtgtctcctagtcaggaggcatgggggtcagggacccacttgaggcaatctgacccttagcagagctcaaatgctgtgctgggagatctgttgctctcttcagagccgtcaggcagggacgtttaagtctgctgaagctgtgcccacagctgccccttcccctaggtgctctgttacagggaggtgggggtttcatctgtaagcccctgactggggctgctgccttttttcagagatgccctgcccagagaggaggaatctagagaggcaatctggccacagcggccttgctgagctgtggtgcactctgcccagttggaactttgcagtggcattgtttactctgtgagggtaaaacctcctattcaagcctcagcaatggcagacgcccctccccccaccaagctcaagtgtcccaggtcaatctcagactgctgctatgctggcaccgagaatttcaaaccactagatcttaagttacctatgctccgtgggggtgggacccactgagccagaacttcgctccctggcttcagcacccctttccaggggagtgaacggttctgtcttgctggtgttccaagcatccctggggtttggaaataaaaactgcagctagctcagtgtctgcccaaatggttgcccagttttgtgcttgaaatccagggccctggtggtgtaggcactggagggaatctcctggtctgtgggttgcaaagactgtgagaaaagttcagtatctagtccggagtgcactgttcctcacggcacggcacagtccctcacagtccctcacagtccctcacagtccctcacagcttctgttgggtagggggagagaattccttgtgcttcctgggtgaggcaacatcccatcttgctttggctcgcccttggtgggctgcacccactgtccaaccagtcccagtgagatgaaccgggtacctcagttggaaatgcagaaatcccccttcttctgcgtcgatctcactgggagctgcaaaccggagctgttcctattcggccatcttgccagcaatctgtgggtgacttttctgtgagaggtttttttttttttaaataatagtttataagttatagtttgcaaaatatatcatttaaatgatgcaacaggcctatgacgtagttagggcaggtactatgtgattactgttacaattattatatttagatcattaaatttaagtgcgatcagatataaaacatttacttataaaatgcaaagtcaaggcacaggttggcaaaagcaagaatccattaaaagaaaaatgattagcatccgcttagctttcctacatattaatgaagaaaagaaatgacataataaagaactgagcaaataatttgcaattcacagacaagtccctgtccgtggaaaaattggcatttatctgatggagattaagtatctagaatatgtaaagaatctctataaatcaataaaacaagctaatagagtaataggcaaaattatgaacagtttgcataaggggaatccaatgctaagaaatatatgaaaaactacttatattctggttaatcaggtattatcttctttcttttttctttttttttttttttttttttttgagatggagtctcgctgtcgcccaggctggagtgcagtggcgcaatctcggctcactgcaggctccgccccctggggttcatgccattctcctgcctcagcctccccagtagctgggactacaggcgcccgccacctcgcccggctaattttttgtatttttagtagagacggggtttcaccgtgttagccaggatggtctctatctcctgaccttgtgatccgcccgcctcggcctcccaaagtgaggtattatctttacaatcactttacagatacggaagctgaatgcaggaaggttgagtggttggtccaggttcaaccaagatgataattgttggagcctggcctcatgctgttcccagtctaaatatgtagggcatgtattttgcaagcctttctcttattctcctcagtcacagtattttgtaatgcacagagaaactaatgtctaatttagatgtagtagttcaactataacttaggtagaaggatgggagaagtgtggagaaaagccaataattgtagtaaaatgttggtttaagcttttggactcccagtatgtcttttcatttggcaaactgcctttggaacattttgactgagtagttactcccagggaacacaggcatttcatttgtggcctctttattcattttattcatgcttctgctgggatttcgtgaatatgactataatgaaactggacttcttagttcttttcttttgggtacaagcataggttaagcagtaaaaacctaaagagaacacaaattaaatgatttttatgctgctattttcttgatgtgcattttattccataaagtgttgctctgagactttatatatatcttaagaatttggaggccgggcacagtggctcatgcctgtaatcccagcactttgagaggccaaggtgggcagatcacgaggtcaggagatcgagaccatcctggccaacatggtgaccaaaatacaaaaattagctgggcatggtggtgcgtgcctgtaattccagctactcaggaggctgaggcaggagaatctcttgaacttgggaggcagaggttgcagtgaggtgagatcttgtatctaccaattttgttgcattattttcaaaattctaatagaatatttgaaaaaatatatttgtatattttcctggattttgtatgtaaacagtcagtgtctgcagttaaggcagtgttgtctcctttttgtaaagattcaacagttatttgccctctttttgtttatttgtttttaatttttgcatagctgggaacctatcatataacttgaatggtagaggcaatagtgtgagtcttgcccttaatggaaatggttctaaaatgtcatcaagtatgatatttccttttcatttttgactggttatttacccttctgggtgggaagttatagattatatttttgttcttttagattttaaccttaatttttagcacctactttgctacagagctattttaaagttatcaaatgtctatttttctttaatatttcaagtgcagtacacattccaaggtatgattattattcttgcctatagcaattatcaggcgttggccaaatcatgattttctttttctgtcattcttttttcatttactaatagaattctactgtgatgaagagctgtgtcttcttcatgtatttctatattcattaattgtttaaatcagtaaaaatttatggatatttactttgttctatgacttgtaatcaggtactgtcattatttatcttattgctcaaattgtcccaaatttggccactggtagctccttcaggttggttcctaggttgttttaacatgtccccatccattgttgaaaacttccttacattctggtaccacaagacatttcagactcatcttgtacttcccctccctttgccttggaattaaccatttctctaaggagatctggttttttttttattggagagtgatattttgaaacctagatttgtattctagttgaacacattgctgctggtgtaatgttgctgtagtccctcttagctgacagagctaggagatatgtatgtgcatgcttatgtatattacatgtgtatatgtgtgtacaccatacacatgtatagacagaaacatatacatctatatgtatctatttctgtatgtatttctacatagatctgtatctatttatttctgtatctgtttatttctaaccatgtgtatatatgagtaaaacatgagttcaactccaaatccatgtcaaccactgcagttcagctgagccttctttccttatttctagctcttttcaatagtgagaaacctggttcttgtaacaagcaactcatttttgtaatcccagtatatacatgaaatcattttacaattgctaaccaatgaaaaacaattcacggcagtgaaaaacaaatctataaacttgagtacaatgtttgtgtgcagttcaatttgcatattagaaggcttataatatttagtcaaaatagtcaaaatccagttacttaggttagttcttttcgaccccaacccactcacttatggttatgttatttatttgcaatacttttaggttcatttgttactgtttttatttcatttgagttctcctagatctcagttgattttaattatttattgtgggggtacatcggaagcattatcatgttgtaagcatctgaactataacacaaagcactcaggcaatgtcacttttccatctctatcttttatcccattcccagtttccttcctattttttccgtctatccctataggtcatcagtcacattcatttctgctttatccttcctgtaattctttttgcaaaagcaaggagttaaatatatcttttcttaaatcctttctctcttccatgaagggtaaggatactatagatactcctttatactttgctgtttcactctacaatatatcctggaaatcattctgtattagttcatggagattctgcttattcttcaatgttctttttatatctgcatagtactctgttgggttgatttatcataggtcaaccactctctgttgttgctcttttttatactctaagttcaggggtacatgtgcaggtttgttacataggtaaatgtgtgtcatgggggtttgttgtatagattatttcatcactcaggtattgagcctagtacccactagttattttttctgattctctccctcctcccaccctccaccctccactctccaccctccaatgggccccagtgtgcattgttcccctctatatgtccatgtgttctcatcatttagttcctactcattagttgagaacatgtgttgtttgattttctgttcctgcgttagtttgctatggataatggcctccagctccatccatgtccctgcaaaaggacatgatctcgttctttttcggtgatgtagtattcatgttgtatatgtactacattttctttatctggtctgtcatcgttgggaatttaggttgatttcatgtctttgctattgtaaccactctcttttgtgtgagtatttagattgttttcagtattttgccatcaggcaatggtggaataaataacatgcacgtgcattttcatgttgttggaggtgtatcgttaaatttctagaagagggatagctcaatcaaaaggtaagcccatatgtatgggatctttttgtttatagcttaaaaattttttttaatgttttaaaaaactcataaaatttactgtgtcaaccatttctaagtagacagttcagtggtgttaagtatattcacactgttgtgcagccaatctccagaaatatctcatcttgcaaagctggaactgtgtgcccattaaacaactcctctttgtccacctccaccaacccctggcggcccccattctactttctgtttctattaatttgactactgtggatacctcatataagtggaatcatatagtatttgtcttttgtgactagttatttcacttagcataatattttcagcatttgtccatgttgtaccctataccagaatttccttccttttcaaggctgaataatactccattgtatatatactatattttgtttatccattcatgtgtcaatggacatttggctattgtgatagtggtgctgtgaacatgagtgtgccgatatttccttgagatcctgctttcaattcttcttaatatatacctagaattgaaattgccagatcatatggtaattctatatttaattttctggggatctgccatgctgttttcacagcaggtataccattttatattctcaccaacagtgtgtaagggttctacttctctctatcctcatcaacacttgccattttctgtattttttttcttttgatagtagctatcctaatgggtatgaggatatatctgattattgttttgatttgcatttctgtaatgattagtgatgctggacatcttttcatgtgcttgttgctcatttttaggtcatctttggagaaatacctactcaagtcctttgcccatttcaaaattggattatttgtttttgtttccgttgagtggcagaggctctttatatattctgtatattaacacattttcagatgtgtgattttcaaatattttcttccatttcataggttgccttttagctctgttgactatgtccattgatgcacagaagttttgaattttcgtgtagtctagttttacttttgttgtctgtgctttttctgtcatatcctggaaatccttgccaaatccaatgttgtgaggcctacccccctgtgttttcttctgagagttttatagttttaggccttatgtttaggtcttgatccattttgggttactttttgtgtatggtataaggtcagggtctatgctcatatatagttttattacatcttgccaaattctccccccaaagagaaagtagtaccagtctgcattcccaccaccagtacatcacagtgcctgtttccccacagccttcccaacagaatgtgttttcattttacaattcttgccaatctgagaagtaaaaaatgttatcagtgttgtttaattttcatttctataattatgtataaaatttgaacaatttctggtatgtttaaggtttatttttagttattttggtgaattatgtatttttttcaatttttctgttttgtttcatttttattttatttattttattttattttattttattttattttatttattttattttattttattttacttagagatggagtcttgctctgtcgccaggctggagtgcagtggcaccatcttggctcactgcaacctccgcctcccgggttcaagcaattctccagcctcagcctccagagtagctgggactacaggcacacgccaccatgcctagctaatttttgtgttttttagtagagacggggtttcactatgttgggcaggattgtcttgatctcctgacctcgtgatccaccctcctcagcctcccaaagtgttgggattacaggtgtgagccaccactcctggccatgttttatttttaaatgtatcaatatgctatattaatagatttcttagtatttagacaatttttcactcttgaaataaatctctcttgactgtggtgtattgttttgtcaatgttgtgttgaattctatttgttaatattttatttagtatttttgcattgatgtttacaagtgatattatatgaatgatattgtgtagtctaaaccttaccacattttggtttcagtgtaataatttgctttataaaagcaagtagaaagtttccttcattttcaagacttggaacaatttatggagcattgggactatttggagtctgggaatttttctgtgaaaccatttgtgtttggtactgttcaacattttcactttttttcttataattttttctgtgttttttcctatacaaaattggtctttttaagcatttttgtctctagtgagatgtaattaacatctgtatttccttaggaaattactcatttcatctaatttttcaattttatttatatagagatctacaaagcattttcttatggctttaaaatttttcttgtatttcctttttgtcatttcttattttattttccttccttccttccctttttttttttttttttttggagtcttgctctgtcgcccaggctggagtacagtggcgcgatcttggcttactgcagtctcaaccttccaggcttagttgatcctcccacctcagcctcccaagtagctgggactaggtgtgtgccatcatgcttggctaatttttgcattttttatagaaacagggtctccttatatttcctaggctggtctcaaactcctggattcaagtaatccacctgccttggcttcccaaagtgctgggtttacagcattgagccaccatgctgagcccatttcttattttctatgtttgtattatctctctttgtgaaagtagctagcagtttgtctattttgttaggttttctttcttttttttttttttaaggaaataactaggattttgatttattgatcagttctactagttttctgttctctgtctcattactttctgcttttatcattatttctgtctttatgctttcttttggtttgttactcttaaaaaatttcgagctagatatttaaatcatgtatttaattctttcattttactggtaaaaatgtttagtgatacaaagttttcattcatcactgctttgaatatacctcatatacactaatatgtagttttcattatcattttatttttaaaaattttttatttcagccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgccagagcgagactccgtctcaaaaaaaaaaaaaaaaaaaaaaaatttttatttcattagtttttggggaacaggtggtatttgattacatgtataaattttttagtggtgatttctgagattttggtgcacccacaggagcagtgtacacggtacccaatggtgtagtcttttttttttttttttttttttcagacagagttttgctctcgttgcccaggctggagtgcaatggggcgatctcagctcactgcaacctctgcttcccggttcaagtgattctcctgcctcagcctcctgagtatctgggatcacaggcatgcaccaccatgcctggctaattttgtatttttattagggactgggtttctccatgttggtcaggctggtctcgaactccagacctcaggtcatccgccctccttgccctcccaaagtgctgggattacaggcgtgagccactgtgcccagcccattatatcattcttatgcttttacatctttatagcttagctcccacttataagtgagaacatatgatgtttggttttccattcttgtgttacttcacttagaataatggatcccaactccatccaggttgctgtgaatgccattattttgttcctttttatggctgattagtattccatggttttgtgtgtgtgtgtgttgttgaatagggtgtcctttctctgctttatgtttttgtttgctttgtcaaagatcagttggttgtaagtatttgggtttatttctgggttctctagtctgttccattggtcaatgtgcctgtttttatatcagtaccatgctgttttggtgactatggctttacagtatagtttgaaatcaggtaatgtaatgcctccagatttgttctttttgtatagtattgctttggctacgtgggttccatttttggtgccacgtgaattttaagattgttttttctagttctgtgaagaatgatggtggtattttgatgggaattgcattgaatttgtagatcacttttgccatatggtcattttcacaatattgattctgcttatccatgagcgtgggatgtgtttccatttgtttgtgttgcctatgacttctttcagcagtgttttgtagttttccttgtagaggtctttcacctccttggttaggtatatttctaagcattttattttatttttgcagttattgtaaaacaggttgagttcttgatttgattgtcagcttggtcacagttggcatatagcagtgctactgatttgtgtacattgattttgtactctgaaacttcactgaatttatcagatataggagctttttggatgaatctttggggttttctaggtatgtgatcatcatatcattggtgaacacggacagtttcacttcctctttactaatttggatgccctttatttctttttcttgtctaattgctctggctaggacttccaggagtatgttgaacagaagacgtgaaactggatatccttgtcttgttccagttctcagggggagtgctttcaactttttcccattcagaattatgttggctgtgggtttgtcatagatggcttttattacattaaggcatttcctttgtatgctgattttgcagagagttttaatcataaagtgatgctggatttcgtccaatgttttttctgcatctattgaaatgatcctgtgatttttgtttttaattctgttcatgtggtgtatcacatttattgtcttttggatgttaaactatccaagcatcccttctgtgaagcccacttgatcacgctggattatctttttgatatgctgttggaattcagttagctagtatttttcttttttttttttttttgaggatttttgtatctgtgttcattggggatattggtatgtacttttctttttctgttaggccctttcctggttttggtaatagggtgatactggcttcatagaatgatttagggaggattctctctttttctatcttgtggattagtgtcaataggattggtaccaattcttctttgaatgtctgatagaattcagctgtgaatctgtctagtcctggacttttttttgttggcaattttttaattaccatttcagtctcactgcttgttattggtttgttgtgagttttcatttctttctggtttaatctaggagggttgtatatttccaggaacttatccatctcctgtaggttttctagttaatgctcataaaggtgttcatagccttgaatgatcttttgtatttctttggtattggttgtaatatctcccatttcgtgtctaattcagtttatttggatctccttcttttcttgattaatcttgctaatggtctataaattttttctatcttttcaaagaaccagctttttgttttattaatttttttgtattttatttatttttgttgttgtttgtttcaattttatttagttctgcactgatcttggttgttttctgcagctgggtttgggtttggtttgttcttgattcactgcttccttaaggtgtgaccttagattgtctatttgtgctctttcagactttttgatgtaggtgttcaacgctatgaaatttgctcttagcaccacttttgctatattgcagaagttttgataggttgtatcactgtcactgttcagttcaaagaattttcagatttccatcttgatttccttgttgatgcaaagaccattcaggagcaggttatttaatttccatgtatttgtagtgttttgagggttccttttggagttgatttccagttttattccactgtggtctgagagagtacttgatataatttcgattttcttaaacttgttgagactggttttgtggcctatcataaggtctgtcttggagaattttccacgtaccagtgaatagaatgtatattctgcagttgttggatagaatgagaacataaatatctgttatgtccatttgttctatggtatggttaagtccattgtttctttgttgagtttctgtcttgatgacctgtctagtgctgtcagtggagtattgaagtccaccactcttatcgtgttgctgtctatctcatttcttaagtctagaagtaaatattttataaatttgggagctccagggttaggtatatataatttaggattgtggtattttcctgttggattagtccttttatcattatctaatgtccctctttgtctgttttagctgctgttgctttaaagtttgttttgtctgatatagaaatagctattcttgctcacatttcctgtccacatgcatggaatatttttttctacccctttaccttagatttatgtgagttcttatgtgtcaggtgagtctcttgaagacagcagatacttggttgatgagttcttacccattctgccattctgtatcttttacgtggagcgtttaggccatttacattcaacattaatattgagatgtgaggtactgttctattcatcatgctatttgttgcctgaataccttggtttttttttttcattgtgttattgttttataggccctgtgaaatttatgatttaaggaggttctgttttgttgtattttcagtatttgttccaagatttagagctcctgttagcagttcttgtggtggcttagtagtggcgaattctcttagcatttgtttgtctggaaaagactgtatctttccttcatttatgaagcttagttttgctggatacgaaattgttggctgataattgttttgtttaaggaggctaaatatagtacctcaatcccttccagcttgtaggtttctgtttagaaatctcctgttaatctgataggttacctgatgcttttgcctcacagctgttaagattctttcctttgtcttgactttagataacctaatgactatatgcccaagcggtgatctctttgctatgaatttactgtgtgttctttgagcttcttttatttggatgtctagatctctagcaaggccagggaaattttccttgattattccctcaagtaagttttccaaacttttagatttttcttcttcctcaggaacaccaattaattttaggtttggttgtttaacgtaattccaaatctcttggaagctttgttcatttttttttttgattctttgtctttgtcagattgggttaatttgaaagccttgtctttgagctctgaagttctttcttctacttgtttatttctattgttgaaactttccagtgtattttgcatatctctgagtgtgtcttttatttccagaggttgtgattgattgttttttatttgtggtatctatttctctcaagatttttccatccatagcttgtattaatttttaaatttaagttgtttgtcaccttttgctggtgcctccttgagtagcttaataattgaccttctgaattctttttctgtcaattcagtgatttctgcttggtttggatccattgctagtgagctactgtgatcttttggggtgttacagaaccttgttttgtcatattaccagaattgtttttctggtttcttctcatttggatagactatgtcagagaaaggatctgggactcaagggctgctgtttaaattttttttggcccccagcatgatcccttgatgtggtgctctccccattcccctatggttggggcttcctgagagctggactgctgtgattgttattgctcttctgggtctggccacccagcagagctactaggctatgggctggtacttgggggtttctgcaaagagtcttgggatgtgatctgtcttcaggtctctcagctggtctctcagccagcacttgctccagttaccaccaccacacctggctaatttttgtattttttgtagaaatggggtctccctatgttgcctaagctgaatttgacctcctgggctcaagcgatcatcccacctcagcctcccaatgtgacaggattacagacatgagccacgcactcgacttaatcttgtcttttagttccgttttttttttttctgagtttcatcactttcttctcactcgttcatgttttttgtccgtgtcttttcttagttttggaatttctggctcaaggtggcttttcgcatccctcatcctgcctatttctttatctgtattttattctctattttggtgtcttgtatttcctcagtgcttcctatgaattattcatttgagcccctctcttgggcatttaataatttattatttatctttgagatttttttttttttggttatccaggctggagagcagtggtgcaatcatacctctctgcagccttgaaccctaggctcaaagggatcctgctgcctcagcctcccagatagcactacagacgtgagcaaccacatttggccaacttttttatttttgtttttttgtagagatggggtctcactatgttgcccagaatggtctcaaactcctggcttcaagaagttctcctattttggcctcccaatatactgggattacaggcatgagccagagcacctggcctaattttgtcattttcttccatttcttttctgagggtcatcattttctcttcacactttcctgttttttgtccatatcttttcttagtttttgaatttctggctcaaggtagcttttcctatcccaaattcttgtttgagtatattggttccatctggaatgttgccttctagttttcttgtgcttcatggttgttttgttgaagggaatttacctctgttgctgtgtgttggatattctgtctttttaaaataatacttcagtatgagtctgttcatcatttttttgtttgtttttatgatattggggtgttttataggatttttagctcattggctccctcttctgtcactatagcaaagtccagatctttgttttggtagcatcggaaggtttgtggtctctgaattttagctgtcttgtcatcgggtaggattccaaattttcccttttttcctgtttctcttttagccatccaatagccaaagggcatttctctctactttttgtttccttttttatttcccagaagctacgtgtttcaaaaactggtcaagattgtgtctgcttttacatcccatccctatagtcagctctgtgatctgtctagatacctttttagtattttgaaacttagggttgactttgtctttcctctgatggttttagatcaaccttaagttcatcactaattcccttctctctttgttatagtttttcacattctacctttgtttgcaataaggccttctggcagatcagggacagaggaggagcatgagatatcacttgctgggattaggtgtctttttcttatttttatttacagttgttttggattttggtcagttcagttttcaagtgatcccgaggacatggtttttgtgtagttttgctgcttatttttcttgtcctctattgcttctggaggaaatattgaaagatggagacataagcaaccacctttgtcagcctgagagtttccaaagctgaatgttttaaaagtgcatttttaactatttttcttcattttgagttttgatgttacattttgtcacattatctcattaaatttgcacatctctgagctacacatactatctccatttcatgaatgaagaaatcaaggtccagcaagattaaatgactcaagggagatcacacaaccagaaactgatagagattctaatcaactctaaaattgtatgatgccaagctcttgttctttccactacatcttgccatctccctgagtaactgaacttagaaagcccatgcattaattaaatactgcaacctaaaacattttagtgattataaatgtaaactgtcagtttattcatctgttccttgtccctcctgttatcttgcagtcctgttatatttttagtagcctcttctccactggcttctactccttgaccttctaaggtacattttctttcctgtaaacgagatcatgtacattaagtgctatctcttgaaaaaaatgattcaacagatgtcaattttgtttatttatttattttcctaatagaggtttttactctatctccccttatagcagacctaccatcatttccctcttggcccactttcacgtacgggaggacccgtgcacactcaccttgctttcaaaactcactgccctccctgcgcaaactcctcacttcatggaaatgatagccccaagtagcagttggcaacaacttttggctcctcctttctggagtgggtgttgtattgtctgtagttttctttaaagtaatttaatctgcaccttaggggtgcttagttaacatttttgaagtaccttaatcatgaatctacactccaggggtagttagttaacatttgaaagaccctaatcaaaattctatactccagaggcaaccagtgcctcagatattgctctcaacctgtaccagtgggtgcattaattagaataaaagatgtaagaagtaatttttcacggtgaaggaaatgctatttaagatatgtagttggccagtttcctacacagagataagacatgagtggaggctgaggatacagatttggcaagggcaacagtcttccaacctaggtaggcccttgatttggtcctgtgcttgctgcttttagtggaggatttggtttggttggctcacctggcctgtggagcgcattaagtctttattaccctgcatgggccaaatccagcctgcttctgtctgcttctccatccagcgctcattggaactgtactccggctcctctccatgtttgcatttcttgtccacagagatgttattctcaatcttgagtcagatgatttctttttaatttcttaatttacatttttaaatttaattatattttgagcatattggatatgttaagagtgtgaatttatagtgccattttgatcagaagcactcacattatttttaaatggtaactttcttactattttctacttgagaatattgtcagtattctcaggccaggttctcatctgtggggcttctagataagtaacttgtttgatattctagtggtctaattaggctgggtgatgtttttgaacattcctttttatatttaattctattcaatagtgacagttctcatgtgatagagggataatattcttgaatacatgtgatttaagttacgtagattgaaatcatatacgtgatttttgtgtaatttgtgtatcatgcgtagtataaggaatgacatctaccaagagtttctatagtaaacattactattgtcctatatcttagttaacatgtacaaatataaatgaaataatgcagtttatgaagtaaaatactgaagtatatcaccagggcccttattttctggggtttggtgacgtgtatgtgtggtatggcatatattactgatcttgtcccatcaaatatactgagcaaaggaagcagtcatgatgaactggtggtctagattgctttctgtactcactaggacacgaagtaattttttaaataaaatatttaactgtataaatagtctatttagcttttttatatgttattttttaagtgagccatctataatataggtatacatgtaagtagctgtaggctgtgtaatcaaggatatatagacgtaaactatactttttttttttttttgtgaggcagagttttgctctcttgcccaggctagagtgcagtggtgcgatcttggctcactgcaacctccgcctcctgggttcaagcaattctcctgcctcaacctcccgagtagctgggactacaggcgtgtgccaccacacccagctaatttttgtatttttagtagagatggggtttcaccatgttggccaggatggtctcgatctcttgacctcttgatccgcctgcctcagcctcccaaagtgctgggattacaggcgtgagccaccacacccagcctgtaaactatacttagtggaatcatggaattgtagcgaatgaaaggaccatagatattatctagtcaatcttttcatgagtcccagagagttttagctaagccctcctttcatgattccattcttagcttcaatcacagagatgatttatagccatttagacatacataccaatatatccatatctatacatacaatgtgtgtgtgtgtgtagggggctgtgatcacaagcacttggggccaatagaattttagtagaaataattggttaaagggcattaaaatcttttaatatttagcattatcagtctgtgaaagtcttcgaaactaggtttgagaaatctttactcattaagaccctcagagcagaaaaatcaagggtaagagaactgggaaaggaagttaagtatttctaattttaaagtgttctaaaacctacacgttgagtacatattgtagcaatatagatactagggaatgatttggagttcagtagtttggaaatacgtatattttgttataattctgatgtgagactttactgaattcctgttaaattatttttgtgcagggcttttttcataaagcaccaataattctacctgacctcacagggttttgtgatattagactagtcatggttgattatattatccttttaaattgccttttaattttcagctgatgtaagtgaaatagataatataaattaattaatattggatctgttcagtgtttatgctctaggagatttcaggagacaaacagaaagagaaggttctaaacaagtgccgtttggggctgtgtcattttattattcatacctggcttatttgttgttctttaatgggctatctatcatattagtgtgtatgtaagtggctacatgtgacataatctcaagtcttattgatttaaactgcatttacctcatcactaatcactcttgtggcaggtagctgcagtgttcagggggcactttgtatgtgtcacgtttgtgactcatacgtgcttttttgtgaagagcattttgtctcacctaaattcctattactttttggtcctacctgaagctctgcttacaattttgcgtatttctacccgcagtccccaaacatgctgaatttagttggcttgttggccgctaaatacttttctctccttgctgtggggttggttttgctggatggagtacttctctttcctgaagtatctagcttcttcatgtgtaaaacaaaaccagtaactgaaatgtcaaatttggaaatataaatgactttttttgatctgccttcagagttgcgttgtcatctttataagcttaagacttcctggttttattccaagttttactaatattcaaaaagtttatttgttaaatcccatatcatcaaatgcactccacattgcaagtaaaaccaaatgaatctggtcattatacctctttctactcatggatttcagggatctaatgagcttagtaagatttgcatcatggataaatagaggacttattcttataagaataaaaattgtgtaagtgattatatcatgtatgtaattaaaatggttttgattcagatttaaatgttttttttttttattgtggtaacgtcacataccataaagcctaccattttaaccattttggaatgtacagtcctgcagtgttaaatacattgatagtgttgtgcaaccatcaccaccatctatttccattactcttttcattcttgtaaaactgaaactctgtactcattaaagaccaattccccatacccctcttctcccagctcttggcaaccaccattctactttctgtttctataaatttgactaagtacggcatataagtagaaacatacagtatttgtctttcttttgactgagttatttcatttagcataatgtactcaaggttcatccatgttgtagcatgtgtcagaatttccttcctttttaaagctgaataatattccattgtatgtatatatcacattttgcttatccattcgtgtgttgatggactcttgagttgcttccacattttagtgattgtgaataatgctgctatgaaaatgagtgtactcttcaagaccctgatatctcttcaagaccctgcctgcaattctttaagtgtatactcaattagaattgctggatatatagtaatttcatttttaattttttgaggaaccgcaatatgggttttcatagtggctgtaccattttacattcccaacagcagtgcacaagcgttccaatttctccacatccttgccaactcttgctatttcctgtttttttttggggggggtgatattaatagtagccatcccaatgagtgtagggtggcatctcattttagctttgatttgcattttcctaatgattagtgatgttaggcatcatttcaagtgcatattggccatttgtatatcttctttgaaaaaatgtctattcaagtcccttgcacatattcaagttgacttttttgttgaatttaggagtgctctatatattttgtatattaataccttatccgatatgtgattttgaattttttgtcctattctgttggttgcctttttactttgttcttagtgtcttttggtgcacaaaaattttaaaattttcatgcagtccaatttgattttttcttttattgcttgtgtttttggtatcatatccaaaaaaatcattaccaaatccaatgtcataaagcttttgccctgtgttttcttctgagagttttattgttttaggtcttacatttaggactgtgatctattttgagttaatttttgtatatggtgttagataaggatccaacttcattttttgtatgtagatattgtttccctgtacagcatttgttgaaaggccgtcctttccccattgaatggtcttggtattctcgccaaaaatcatttgactgtgtatgtgaggttttttcccctagggtctcttttctgttccattggtctatatatttgtctttgtgccagcaccacagtgttttgattactgtaacttctaagtaagtttgaaattaggaagtaagttttgaaatgaagtatgagtcttctagatttgttcttctttttcaagatggtattggctattctggatcccttgagattctgtatgaatttcaggatggtctctctctgcaaaaaatgtcattgggattttgatggggcagttgcattgactttgtaaactgctttaggtataatagtattggcatcttaacagtagtaagtcttccagtccgtgcacatgggatgcgtttccattcatttatttgtttccattaattataattttttaatttagcaacaatttcatagctttcattatatagcttatatatattatagctttcattatataaagctttcattacataagtttttcatctttttcgttaattcctgattattctttttaatgtaaactgaattatttttataatttccttttgagattgttcactgttagtgtatagaaatgcaatggacttgatcatagtgtatagtcctataagtatgctgctgaattcagtttgttagtgttttgttgaggatttttacatctgtgttcataagtgatattggtttgtagttttattatactgcttttatctggctttggtatcagggcaatgctggcctcatagaataacttaggaagttttattcctttttctagaattttttggaaaagtttggttttctttaaatgtttggtagaattgaccagtgaagccatcaggtctagtgcttttctttgttggaagattttagactacttatttaatctccttactagttatagatctatttggattttctatttctttgtgatttagtgttgataggttttatgtttccaggaaattgtacatttcatctatgttatataacttggtgttgtacgattattcacagtactctgtttaatttatttctctagaatcaatggtaatgtaacttccatttatgaatttagtcatttgagtcgtctctatttttttcttagttcacctggctaaagatttgttatttttgatgatgttttcaaagaaccaactttgatttaatcagtttttggtattgtttttctattctctattttatctctgctctaatctttatatttacttttttctgctagctttggttagtttgttctgttttcagattccttaagctgtaaaattaagctgttgttttgagatcttttttgttttttaccgtaagcatttataactataaatttctccttttttgctgtttttcctgcatcctgtaaattgtatttcatatgttgtgttttcattttcattaatctctaagtaattttctaatttcctttgaggtttcttctttgatacattggtttttaaagagtgtgttaattgacataagtttgtgtattttccctttttaactttgttattgatttctaactttatccctatttagttagagaagatactttgtgtgatactttctacttaaatctattgagacttaattggcagcctaatatatggtttgtcctggaaaatgtcccatgtgtacttgagaagagtgtgtgtgttgctgttttggggtagagtgttctgtatgtgtctgttagatctagttggttgattgtgttaagtcttctgtttccttatttctgtctggttgttctatcaattatcgagagtagggtattgaagtcttcaactgttgtagaactgcgtatttctgccttcaattctgtcagtttttgcttcatatattttgatagtcattaggtgtataaatgtttataatggttatatcttcttactgtgttgagcctttattaatatataatgtccttctttgtctcttgtaatctttttttgatttaaagtctattttttctgctcttgttttgctgctgttttcatggaatatctttttccagccttttactttcagcctatttgtgcctttgaatcgatttgtgcctttgtagacagcatataattggatcatgaatttttattcattctaccagtctctgtcttttggttggacagtttaacccatttacatttaaaataattactgataaggaatgacttatttcagacattttgctatttttttctatatgcattattttttttacccctcatgttctacattactgtattattttgtgtttagttgactttttatagtgaaatgtttaaattcctttctcatttcccgatggtatgcattctgtagcatttttctttgtgcttaccataggaattacatttaacattctaaagttataactctctaacttgaatttataccagtttaacttcaataaaatacaaaacctccactcctttaatggctctgtccctaccacttttggttgttgatgtcacagaattatatctttatacattgtgtgctcaaaaacataaactagtaattcttttaaatgcattagcctcttaaatgatgtaaaaaacaaaatgtggatttataaaccaaagttaacagtaatactagcttttagactaataattgtgttttaaaaatcttttaatattttaaattatgtagaaaacaatagttagaaataattgtcttgttgtaacactactaatttttataattgcctagacgtttatctttattgagatatttatttcttcatatgccttctagttactgtctaatgtcctttcattttaacgtgcaggactttataaagcatttcttgcatggcagtcctgatggtactgaaatcctgtagcttttgtttacttggcaatgtcttaatttttcccaatcacttttgaaggacagttttgtgtgatacagaattcttggttgacagtttttttatttgtttgtttgtttgttttggcactttgaattaatccactgccttctggcctcggaaatttctgatgagaaatctgtggataatcttattggggatcctgtatatgatgagtaacttcgctcactactttcaagattctctctttgtattttgaaaatttgattttaatgtgtcatggtgtaggtctctttgagttcctctcacttggagttttttgagcttcttggatgtttatattcatgtatttcatcaaatttgagacactttcttctattatttctttaaatattctctgctcttttctctctttcttctcctttcagagctcccacaatgtctaaattgtatcctgtgggctgtcttcacttctcttcaatcttttttcattctgttcttagatgataatttccattgtcctatcttgacgtttgctgattttttttcttctccctgctcacatctgcctttgaatccctctagtgcatttttcattccaagtatacttttcagctcaagaatttcttattctttttatttttttagttcttatatctctttattgatattgccagtttgtttatacattattttcttgactttctctttattttttgttatttgagcatctttaaaacagttaaaactttaaaaaaaactttttaaaagttttttttcttaatatatctaccattaagtctttttcagggacagtttctgttgatttattttttttcctttgaatgggccatatttgcctctctatttctatgctttgtgattttttgttgttgttgaaaactgggcatttgagtttaatgatgtggtgactccagaaatcacattctccctcttttcccgggttctctgggttttgatgttgttattgttttgttttataaattattgtagtcagtgtctatcctaaggatcagcctgggtgttaatttaagatctcctcaaataaagcttttctaagcctgcacctttacatgggcatgcacagtcaccttataattttttcaatacatgcatttgtttttgaatgtcctagtcctaatgtttggctttaaaacggggagcaagagaaaaataaaggcagtaggggaaggctactggctgtttaacttccctggaatttacttcagcaagagtaggaggggcttgaaaaattggaggaggtgcaacaacaattgtcacgtgcctctttgtacctctgtgattagaggaagcaatcagcgatcagagcatagattcttgatacttggcaggcagggttctttttgcccaccctgtcttcccaccaggtgtgtgcaaggtactccaggaacaggtacagggatgtctgccacagtgctaggtagctactttggtaagagctgtaattgaaatcgaccacaatttaccatccaagtgttcccttggaagttgcaagccttccatagactccagagttacaaaatagttacatcagacagattctgccagtacaatcgtgtaggtggggagattcctggtgcctcctactctgcagtcttcccagaatcctccttaagagcgttttataagctgggaacccccaaaatagggactgaggagaatgccctacagtggatttcacatcatctgaagtagaggttttatggactttgtgtagcagttacaagaactcattccatatactgggatgttttctttcttccctagtagatttcagtaccattctagtagtgctgaataacttagaatggcttgtagtctgagtttaaatctactaaggaagaatgtattcattctttcaggatattgcagatttttaaaatcttgcatttgttttgagagatggaggacagaggtggatggggaaaacttttgactattaggctccatcttcagctctgtactcacttttgcttttgtatatcttaatccagccatttgtaaaatgaggcagttacttttaagtcagagatttgtaacgtcctgttttttttggcagttgcgaaacccggaattcctatgtgaagttttgcatatgtatattcatactttggagagcaaggcctgtggctttcagtagataacagagatctcctatcagcagttctcccctctctccaacttgccacaggggttaaaaactaaagttttggttatttcttccatttcagtgccaaattgtttgaaagaatgctgtattctaaagatctacagaggcttttgacatataacattacttctcagaagcctttcatggattattagcaagatctgtctcctatagataattatgttgtagcagacatatgtttaaagaaaaataggttgttcttttgtatttatgaaatacctcttcgttaccctatttcctcaaagtcttgtctcacttgtatgtattgttttcccttaatctttttaaaaaatttattataattttaatttatttatcactcttccccctgtgtgtattcatgatgtctttttctccagcgacttaccacttttaactaacaaatacaaacctgaggctaggatccagctcttcagaattctcttgcagcgccacatatggcattttataaacagcgagtgcctaataaatgtcatgagccagtggactcatggcagaagtagtagtctgtggaaaacttcccatggtgatttgtttactaatttttattgcatctgcctcttattactaactgatgggtatgatttgaggaatataaatgttattttgtgacttttggatggttactgtgcaaatataatttaattgaaaaatcctctttaattctttaagagagtaatcaaggcagtgatttcgtttattagactgctctgttttggggtttttgagtggagtctgtatctattattgttattatttaatttttcagtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggtaggtgggagtgtattttgtatttttgacaactctatttattgcacattttctagggtggggcgtaagtaacttaccttctgttgatgttgttttcttgaacttaggatactatagcccatacaggccaggcgcagtggctcacgcctgttatcccagcactttgggaggctgaggcaggcagatcacttgaggtcagaagtttgagaccagcctgtactagtagtgaaaccctgtctctactaaaaatacagaaattagctgggcatggtagtgcatgcctgtaatcccagctgttctggaggctgaggcaggagaactgcttgaacgcaggaggcggaggttgcagtgagccgagattgcaccattgctctccggcctaggtgacagagcgagactccgtcttaaaaaataaaaaggatactatagcccatacaaactttgattggtaaaacagcttgactaggcataattcagctgtctgttttttaatgttgttgaaaaattcaaagcatattgtcactcaatgaaaaatatggacatatttatagtagagattgtcgatatttaaacatttaaagaataaattgaatcaaataatgtagcagctattgtacacatactaagtactcagcaatgttcaaggcaatttatgtatattatctcacttaattatcactacaactgtatgacctagttattagtatccacatattgcagttaggagaactggagctcagagattgaataattagcaagctcttagaaaaagtcttggtgttgaatactagtccatttgattctaaaatccatggtctttcctgtgtctcatgctttcttctttaatgtgtaatgatatttccaatagacaaatcagtctcaggaatttttaaaacaataagatttgaatttcataattcttatttcatatggagagtacggaaattgaattcagattctaactttgtgactatcatatactaacagatcatgtgtgacaaacaagaagaaatcataatcttgtagatacgttgttaaggaaatatctactgtttatacctagggctcaaagtttttttaaaagaagataaaattaaggagaaataataactcatttagtatagagttctctatagacttatttaaattttttggaaaaattaatactgtatttctgtgttcttttgcatatgtaaataacattgatttcaattatactttaacatttcaaaaattaatttccttgtaaacttgattcaaaagtactatgtttggtgaatggaactaccctttatccttctcctgccacagaatgtttcaaagtaaatatttggccaggcacagtggctcatgcctataatcccagcactttgggaggctgaggtgggcagattgcttgaggtcaggagttcgagagcagcctggccaacatagtgaaacgccaactctactaaaaatacaaaaattagctgggcatggtggtgcatgcctgtagtcccagctacttgggagtctgaggcacaagaattgcttgaaccggggaggcgaaggttgcagtgagccgagcacactactgcactccagcctggttgacagagtgaaacttcatctcaaacaaacaaacaaacaaacaccccaaaaaaccaaaaccaaacaaacaaaaacaccaaaagtaaatatttgatgggttttggagaacagacctgactttgtatccccactttgtgatttgcaaaaattaacctgtcttacagtgttgcttgctttagatgaggttatatggttgtggtgcttagtggaatagcaccagtaagtactataacatgcatgcctgcttgtataaaatgcgtgtgtatatgaatatatgtttattatcggtgccttccccaaattccatgttctatgatcacttacatcatgatccagagaagctggagaatggttctttgaacttttgcctttcttctttctttgcctggcacctggattttcgtgaagaccttttgactccttactgatgaatactctaaaattctggtttgctctttgcctgttgctgcaagttcctagatgaatacagtgaactttcctagggaaataacattgctgtagtatatattggaaataaaagggcatggattaataacttttctgcagatctcattatagtacctttaaaagcactgtgtctttcataggagtttcatctttttttttttccccttgcctaaaccccttccagaattcacgagtggaaattatagcactagaagtataatagaaattcagcacactgccctgggaaatactaaatgtttctctatgaggaatgagtcagcagcaggatttttttccctgttaagtgtctttcgtttgtccgtattttagaaagcttttgtaggcaggatatattggacactaacaagtgaatgagctgtttgccttggctgtatgtataaacataatcccattttataaaacatacaaattcaagatttgggacccaaactgtttattatgagacaaaatagtacagagaaagcaagtatttagagtaaaccactttgttagaagatcaaagattaaattttggggctgggattccaaaggactgataattttgagctagtctctagtggttatgtgctgtcaaatgctttaaaactttcaaggaattaattctcttgaattaagcagagtcattcaaaaatgatcagcattgttgcttctagaggattggaattttagaagcaatattgtcaaattatcatttgaagcttgtggtgcttttgtgcattgactcttacttaggaaggtattagtggcatttatttcagagagaagtaaaatcacaatacttggcattatttattattgtttaccattcaaggaattttatggctaaagatatatgaatttatttttttaaagaaagttggaacagagaccaaaaaatccatgaatcctgtttcccaacatgaaaattttctcccccaccctccagtgaaatatcctgttccaaaacattagttattctgagacaagatacccatactgtaattttccctaaaagtttcatcatcttattaaatatattctggttgtgatgcattgcaggcttgttttcatttgtctttatataaagagaattaatgttgtgtgctattttgctagaaatgtagaaggaaacaaactagtgaattctttcttgcttttaattcctacagagccaggatactttcccagccagttttttaaaaaatcactttggtgacctacttattattttattttattttgtttttgatctcccaaactatctgttgtctatttataggagaaatattttgtcttttctgttcattcataatctatcagtgtctttaagcctccacttactattaaatgaaaatattcaaccacaattattgccaacttgataaacattagggtaacatgtgccttgctaatttaccagaaccacctgctacccattatttctctagaaagacaggcagcgtcttcaacttcagatggtgactgtggcctgaagcctctgcatttcagaatcaatttcttcaactcctgctgcctaattgttgattctttcccaaaatctgattcatgagtatttttatattatttttatttgaaagaagctggaaggagttctgtacttaacaaataagaaaagcataaggaagagatggaagaaaaacttctcaaagatgtggtatcttgtcaagaatatggaagaaaagaatgtgggaaaagagaatggttggtatgtgtgagggaaatggacctgtttaaatgcaaaggcaaaaattcattgcaggaagggatggtggaggtcagcttcacttaggtagagctgtaggtcctagagagtgcagaaggcgttgagtgagttggagccgttgcttccagggagacctttctctcttttggaaggaaaccattttaaaaggttcattgacttctgttatgaagaaaaagattaaatgtcagatgtgaaaagcagagaactttgtgggttttgggcttgttgtaatattgaagaaagcttcatggaaaacatgggaaagaaatatactttaatgctaaaagtagttgtgtttggttagtagggttgtagtctttgctttttcatctctgttttgcacctcaagttatagtgaaaataattcattgtcaaaaaattaaattattactcaggttattttaatcacaagaaattattagaaataaaaatgcctgtgggggtatgaatgttcataaaactaaattttaatattgaaaaatataatacctgtttttaaaccaacttgacatcattcattaattttattatatatgtgtatctttatatatatttggttatttattggctgcctctagaatggaagagaagagagcactagtttgtcttgttcagtactggtgtatctccagaatctagcacagtgcccacctgacccataataaatatttgttgattgcaagaataaattccacatttatgaaatatctgccatggaccagacattgggtaaaatgcccaacaaattatatgtggtccctgtcctcatggagtttaaagcaggaaggaaggcgttactcaaagaacgctaagatgtgagaatgaaagcagccagattcttgatatgccattttcactgtttttgcttacctctgtattgattaaattttttcttttttttggagacggagtcttgctctgttgcccaggctgaagtgcagtggtgtgatcttggctcactgcaagctccgcctcctgggttcacaccattctcctgcctcagcctcccaagtaactgggactacaggtgcctgccaccacgcccggctaattttttgtattttttgtagagacggggtttcaccgtgttagccaggatggtctccatctcctgaccttgtgatctgcctgcctcggcctcccgagtgttgattaaattttaactgttgccaactgtgctttgcttagagatgataccaatttttcatgtaatggataatgtttgagagttcctatatccccttgccaacagattgtattatcaaatacttttatccttgccaatctgagaggtaaaaaatggtatttttggatttgcatttttattgtaaggttacacttcttttcgtttgtataaaagtaacttgtcatgatatctgggttatatatggatgtattacttcaaaataaaatgagttgcaaatgagtgaagatatagatacaataagccatgaaatgatactgaagcagggtgataggtacaaggtggttcattatcctattatcttcacttttttaatgtttgaaattttcaacagtacaatgtttaaagtgtttatttccttttcaatgaattatttttctaacatgtttgtctcattgatttgtaggaactctttacatatataggaaatttgttctttgggatttattttgtaattttctgccagtttctttctcttttgacttcatgatgtttctgggcatgtagacatttgttttaattttttatgagggtatatttatcaggttttatagcttctgggttttgtgtcatacttagagcttccctactcttagattataataaaattttcaacacttttctagtacttatatagtctcattcttaatatttatatctttgatacatctgggatctgaaggagtgaccaaacgacttttgagcacacctgacacatactatactgtattgtaaggggttgtacacccttttcttttctgtcatccatgtgtctgtcatgtaattgtccatgttagctgcataattgctgaataattctaacgctgagtcgtttatcatatggtgatggttcttctcaaggttggtatttgccacattttctaaaactctttttttcctcctggtttctcagtctgtgaagactatagattttcagaaatacgttgaattattgctctaaaattggaaaaatatacttttgaaatattttttataatttggaggccagaattcagaatgagggcatactgctgtaatagaactttcttataaaatggttttatctgtgaggaagactaaaggctcaggcctcaaggatagttttatagtatgaatacaatgtttatggaaggagaaataaatgaaatattgctcatgattttttttagacctgtggctagattcaggcatgagtttctatttcacataaatagcatttcgttttatctcttctttctatattagttacccttcttctaagtatccgaaatgcaggacatggtggaattggtcattttattttacagaaaagtcattcaagagcagctttgaagcaaggtcaggcattttccttgtggcttcttatagccattcccaggcaccgcatgtagcacctggacatgcttggaatcaggaagggcctccgtgtaatttagatgagtagttaattcgaatcaaagcaagcgggaagcaagtaaatttaacttcagtgattatgattccatttgattaaatctctacttttgattacacatatcatgagaacatgctttaaatatacccaactatttaatattgaaggggatgaataggatgaaccagggacatatagaagaaattccactattcttcaactaggatatgtcccctgcagcttaactgaaatatttttagaacaaatgaaaggataattttttttacatatgggacttgttactccaattgttaactaaaatatataactcattaccatgaaaggtcccaagtctatatactttctagtaagacttaaataaattaatggataatagctccatcacatatacagtgtctgagaaatgtcaataatgttcatagttcttttgtaaacatgagtttggacagctatcattctggttgtgtattgtcctttggttatagtcattagagaaaggcttcttggctgaataggccagagatgttactcaatattacatttcttaaacctttgtgttttatgtggcaaagttaaaaaaaaaaaaaaaaaaaacctactctcgatttctcttgttttacatattatagtaggttcaaattaaagatctgaccagtcaaagaaatagagacaatctgtttcatggactgtaataactttatttagatggcagccatcatgctgtatcaaggccacttctctgtttgctagagtgggagctgccttaggttttgtcatttttgtgcacttgctattgttataataggaaaggcactccaagttcaaaataatactggatcttttcattgcaaaaatgaactaacaaacctatgtcaaaagaaattcttacgttgatgatgtgtaggggtggtgtcatatatgattaaagcaccttcatgtgtctctcaggctgtatttcaaattgtctgggtcttctagctcctgccccatcctcttgctatagtctctaatcagattggactgtgagtttataaggggaggtaactttgtgtttgcagcctgatttagggctgggcacatacgaaatgcctacaagtttatttttatggagatgtggtctcactctgtcgctgaggctggaatgtagaggcccaatcatcatggctcactgtagccttgaccccccctgggctcaagagatcctcctgctttagcctcctgagtagttgggactacagttatatgacacgatgcctagctatttaaagtattttttttttttttttaagagatagtgtctcacagtgattgcccaggctggccttgaactcccggtctcaagagtctttccactttagcctcccaaaatactgggattacaggtgtgagccaccatgcctggccagttttaatgaatgaatgaataagaaaaagatgcaaataaggtcatttagtggaagttattattattattttcagcactactcacagtgggtctatggacccacatcaccagtgtcactagagagttggaaatgcaaatttccccaagaagcagtggttattaaattggaatgtttggatgcagggcccacaggactctatgccttagttgattcttatgcacactgaagtttgagaacactctttagataacatcacaaacatcatagaattttgcagttttgtagtattcacgctttgcaaagccatctgccatctggtatctcacctgagtgagcctcaccacttgcctcctcacaggcaggggcattattattaatcccagatttacccagagaaatgtgaaagctgaaataatttgacagttcacaaagcttgttcgtggtgcaattaagattagaagtagtctttttccaccatgtaagtttgctttctggcttatataaacatgatgtttccaacccatgtcatgggcctgattttgtttgtcctcagaaggacgatatctgtactaaatatccattttcctgcccatacctcacactgtggtcagtggcaggcctcagagatagctggacatgttgagaagcgtgaaaagcagccacagagtgcctggattttaattaggtcacttgagaatcaaattttattatctaaacaattcctctaggggcattcttgtactaggaacaatatagtactaagaacaacaaagcacttgtactaagaacaacaaagcactaagaatatgcacctaaaatcttaacttttgttatccctgggaagtggatttatggatcatttttctaatattccactatgatgaaatgttatttttggaatgggggaaaggatttcaaaagaatgatactgatactttaattcaaagaaatagggcctgggtttattttctaattttagccacaaatttggcatacatcaggattagacgtttgaggtcatctctccagaactcagaaacctgacttgacaaggagggagtaacacaggaaggaagtgactagcaccaggccccacttcagtattcttgttatttttactgtgtttcattctatattactactaattttttcttgctcttttcatagagcagatggagaattagtcagcactctttaaatagtaacccctttttacatgaagacttattaataagtggtaaaacgtatttctatcccttagaagtaggtattagataaccttgaagattaaatgggctccatgtcctatttgaaatgaaaaatagtagctcagccaggcttattaaggaaatgtgtatgagagatatgggcaggtaaaacaaagaccatttttatctaattatacgtttctttttataaaattataaagtttttatataaagtctacgctctgagttcactactttcttaccttttagagcataatcgtagggaaataaacattctatggttattgcttttgtcagtggggaaaagcataaccctgatattaaagtctcagcagacaagtaatagaacagaactaattcttctatcttgtgtgtgtctttgcttcgtgaccaagtaaggcagcttcttggctgcaaacgtgggttttccagccaaatgactaattcaaggttccctggatgttaaatttagattcagatagtcttatctcaccttaaatattgagcatttttcacagcttgatgatgtagctttacactgttgatgcttcttgccttctgcaactgtgactgttccttaatatgtgcctcttcttagccttctgccttttttcatggtagcacttgaagatgagatacctagggatcacttggggctggaagttaatagatgatctgggagaataagtaacattttacttctctaggaagtctggttttaaaacctgctgggtaattagaagtgtgtttaaagaataaacactttcttcatcctgttacttttctgttttttaaatataaaatagattttattgccatattattaaagttggctcttaaagtttgtatctttcagttcgtaactgtacttcatgttctcatgtttagcttggtaaggttacctttttgagagcatggttttgtgtgaaatattttttattgtgggcttctaaaatcaggaggttataatctataacacttactttcttaccacctcttatctgtaatcaggcctctctcccattttgctggagcccactttttcattcctttatcaacaaatatttattgcctatcatatgctattttgccaatcagtgtcatgccaaatattggaatacagtaataaatcagaaactcatacccacagtgagcttacagtagaggggaagaggaaaggactggagggaaggagagactagtttgaagacagttttaataatcctggcaaaaggcaacatggccggcatgagcaaggtaaccgtggcaatggagtgaaggaggcctatttgagagagagtaaagaggtagcagtaaagagacttggtgatggcttgggtatgagggaggaggggaggtaaggattttttgctggggcaagcattaccatttactgatgtagagaacatgaagaagtagatttggggaagaatatgatgagttccatttaagtcatattaagttagcggtctacagctcaggggagtaatctggctaagggatatgtgtgtgagttgatagcaggtagataattgaagattaggggcaaatgagctcagctagagagagtatgagggggttgagaagagtttaccgcatttaaggaacaggctgaggatgaggttcctgagaaggaataactggagaggtggcaggaaagcagaagagtggagggttgtggagccagtggaagacagtgtttcaaggaggcacaagtgggcagtagaaacaagtgccgcggctatttgattagaggccaaagtgggtttcttggatggagcaaaataattatttgggacttttagcaacagctgttttagtagggtcccaggggtgaaaacctgtttgcagtgagaaggaagaggcagtacagacagttctgttggctctctttctagccttggcttccctagcattatagagtactaatatcactttggcctctcttctaaaatactttccctgttttctaacgcccctaaaaagggacagtctccagaactgtgtcctttgttctcttatctttgaacttcagtttccttgtctataaaatggcgataaagtagtaccttccttatagggctgccctaaggatgaaatgagataatccaagtaaagtacttaacacagtgctcggcatgttgtgagtaattaggaaagagtggctgttatgaccatagttctcctttttgttgctgtcatgatttcattgtcattgtcactgatacttcatttcagtcttactttcttagggatctcctccattatgacaggtagctaactacctgccccttgtagaagaaggaccccagatcatcatctttcatcccagacttctgcttatattgccatcctgcattgctcattcttttactcatgaactcgtttgccctcaaaatttgactgttttctccattctggacattggtccatgtgttgtaggagagatgtgtttacaaagaaccataaaatagggattctgcctacactttctggcccaggaggccatgcatacctgttttgtcacttctctcagttcattgtaatagtttgtttggagggactgtagaatcacagaggaaagagagaattggttcttactctgtggattaggcctcttttggttataagtgccaggaattgaaatcacctaacttaatcaaagaggggctttttattagaatgatacagaattattattatggaatataagcaggactttactaatcaagctgtaagaaggagagagatgcagctgggccttaggaacatccagagtatctattatctcctttccttccctctagatggtaaatgttaaagatacaggaattaattcattgttacttttaatttgcttttttttaagtgttacattcatatatatttttgtatgtagctctcacagtcaatttctgaggaacgtgaaatttggagaagtctatgatgtcttgaaagtcccatgtctatttaatagagagctggtattcaagtccaggtttctaactggtatttataccacattgccatctaggattaatattttctttcactaactgtgatgctgcattgagtattactacatactgttttgtggctttagaaataacttgtgagagaggggtatgtgtgttatttttttctgaagggtagaaattgcaattaattgaaattaaaatctctaaagttcttgggcctttactaattcaattcagcttaaggaatcctgaggtaatttaatgatcttgcctgctcttttgtcttttttagatcagtggtgaaaacctttatcctagcagtatgtaagcaactgagctagctgcaacataatgttttatttcttttatttaatattttctgttgggagttgggcagggaatgatttcactggggcattgtgttttcatccttagtgtgtctgcagctaaaggcaaacaactctttctcaatcttgtgttgtgggcagtcagagagtgtatataaatattaacaacatatttcagtttatttctggtagctttaaattgggacaagctagtgcagatttacatcctgtttatgtgaatgattcctaatctcttattctttgctgcatcagaggagcgtcgtcttcctttctccttttctttttaaaggagtgtacgtgctggtgagggacaacatatgattgactttggtttctttttccttattagtcattcactgcttatcccactactgagttccactcaatgatccactgaaacccttcttgtcaaggtcactggggaccttaagttgtaaatttctctctcttagccttaccatagcctttgactctgctggtattctcttctctttggtcctctgcaatgttccctggcttccttcttcctctctagttactttctaaccatctttttaatgatactctttcctggagtgttggtcctggacctcacttgcttttcttattctgcatattatccccgagtgatctcatctcctcaaatatttatcacttttaaaatttccagtatcattctctctgctgagctccagacttgcatatctgactccctaaggatataacaccttaaacttaacatatccagataaaaacccagcatctctccttctactagatttcctttttttttttttttttttttttgagacggagtttcgctcttattgcccaggctggagtgcaatggcgcaatttggctcacccaacctttgcctgccgggttcaagcgattcttctgcctcagcctcccgagtagctgggattacaggcatgcaccatgacgcccagctaattttgtacttttagtagagatggggtttctccatgttggtcaggctcccgacctcaggtgatccgccacctcggcctcccgaagtgctgggattacaggcgtgagccactgtgcctggcctccttccagatttctaatttcactttaattctctctcccccccgcccaccctcccccccaaaagcataaaccaaagagtatctgagacaggtctcaatcagtttaggaagtttattttgccaaggttaaggacgcagccatgacatagcctcaggtccttacgaaatgtgcccaaggtggtcagggcacagctagttttttaattttaattttaatttttatatttttattttatacattttagggaggcatgagacatcaaccagtatgtgtaaaatatacattggtttcgtccggaaaggtggggcaagtcaagcgaggaggggcttctgggtcatagatagatagagacaaacagttgcattcttttgagtttctgattagcctttccaaaggaagcaatcagatacaaattaatctcagtgaccagagggatgacgttgagttctgtctgttctttgtccatgaggaatttccgtgtggacaaaatgtgagggaggtatgtagctttttaaaaaaatcttggtagctacttttttaaggactagaatgggaggcaggtttgcactaagcagttcccagcttgacttttccctttggcttagtgattttggggtcgcaagatttattttcctttcacacaggaaaggtaaccattctcctcagtgttgctcaagccagaaatttagacgaaggaaacttgaacctttccctgtctttagaattgtaccattacctcagctagttctgtgcatttcctaattcgatttttccagcagtgttgtgagtctcttagaacagttattaattaatactttcactttgcagacggggacacttggagaagttgggagaatttttttcataacgaaagatgtaggcagtgtcagtgctgggaaagaatggaaatctattgtttcttacatgttacttaagaaagagaaagaaaaaaccaagtgaactaaaagagaaaagttgatgtcctcctggtagtaagaatgtaaaggaatcagctttcacaacacctcgctttttgagatgccaggtttcatttttcactgtttcatgtatttcctcttcagtgctagagaggtgttggatcttcactctccccactcagagccatagctgctgttcttttaacagctaattgaggtataattcactgctgcacgattcacctattgaaagtatacaattcattggtttttagtacattcatagagttttgcacccgtcaccactacctggttccagcacgtttatgtcctccctaaaacaaatcccgtatacttatcagtcagttcccacccacccccagcctaagtaaccactaatatattttgtgtctctataaatttgcctatcctgaatattttatataactataatcatatagtatatggtcttctgtgaccttttttcacttaccatagtaatttcaaggttaattccagttgtaccatgtatcagtacttcattcctttttgtggccaaataatattctattgtatgaatataccgcattttatccatttatcagttgatggatatttggattgtttccacctttgggttgttgcgcataacactgctaaggacatttgtgtacaagtttttgtgtgcacgtatgttttcatttctcttgggcatatagctaggaatggaatcactggctccatatggtaactatgtttaatgtcttgaggaactgccaaactgttttccaaagcggctgcaccattttacattcccactggcactgtttgagagttccaatttctctgcatccttactgatactttttattgcttttgtttttgattgtaaccatcctagtggaccgaaattctagctcattgtgattttgatttgcatatctctgatggctaaagatgttaagcatctttttgtttgcttattggccattcatatattttctttggagcaatggatatttaaatcctttgtccatttttaagttcagttgtctttttattatgagtgtaagattttagatttgtcttttatcagattaatgatttacaaatattttctctcattttatgtattgcctttttactttcttgatgatatcatttgaagcacaaacattttaaattttggtgtcagagctgtgggttttattaaataatatgacaccgttgtgcttcggtaaggcggaagagagctttcctctcgttaaaatggctggaggtctcaaaaaaggtagagctgcaagttcctagctactattacacctcctttccttcctccctgtgtagcctgtcctgtggctatgatggccacactataggaacaggcctgttttggctttgagcctccaggagtggcagaaactggaactgtgtcagcattttattaagagattgctatttccaagatgttaatagatactgtgaatctcatcttacacctctattctctactggttttttttttctctaaatgtagcgctgttcctggctgctgagcagctcttgtccttgactgacaggcaaggtatgcagttgtggcactcattggccctggagataaccagataacagcacccctaacaagaggagccacttttctgttaaaactttgctgctggttcacaatcctgtatctagaacttcatgccattgggacattagacaccagtgtgcctcaggcatctgaatgtcatggatcaatatggtttcaaaccatattttgaataccccaatatttaccttaacatacattaagttttaattttctccggtaaggacatttggcaacataactgccattcatggcagaaaataactaagattttcctatcaagagagtacaaaagatataatgttaaataaatttacctttgtgaagagtcaatatattattcatactttgctatctaccactcaaaaacatattacagtctgtagattcatatttgagaactacagtcttacatacctaggataaatctttgttggaaaaggagaaccttcacttaatcaggtatttactgattaagttactgatctgtatgatgccagataccagttttataccgattatttccctgcaccacattaagtgtttcagttggtatgtttagacacatgtttctgtattttgtatgtatctttgctaatatttgagtagttcttcagtaacacagatgagaaagaagaattattttagatatatgtgagtataaatatgaatttgacctttaaggattaaaaagaatcatcaatcaaaaggtagaatggcttctatttataaatacaatgtgtaacttctggattatatatgtatagtctaggctgggagtactacataaattctattgattttgtctcatctgaattacaatgtcaaatagatactagggttttaccataagatagttatgggctgtctcattgtcacattaattacaataattaggcagtaaagaagccataggaatagataatatgttgtatgtttggatgagattgtagttataaccccttatttatggtaataaaaccttgttaattgacactgctgacaagctcttttgctttccttttcaactttccaagttggtttatcagtctatttaggaattacaagctgagagccacaaaatatacaataaagctcacattgcaagattttctgtacttgttcatgctatacacattaaattcattcagcagtatttgctaattattgttctaagtgctcttaagtattcagagatgtataaagcagtgcctactctgaaagattaataatggagaagtgaggtaaagtatctatatataaagaaatatgactgacatttattgagcagcatatgtgaggctcatgtgataagttccttaaaagcagacaaaagagtatacaagttcagaggaagaaaagatgattccaggcctgtgtgatcattgaaactataagtctcagtggtagaggaattattttgcatctatgccataaatctttgagctatctattctagagctgtagtgaaaggtaggtggctaaatgtactgacatggaaatcaacttttgttctaggcttagctgcactgcaaccttattttgtgtccttgagtatataaaattgatgtaataatatgtgtccagcatatctcactgtgatgaatgagataatgtggatgcctgagcttctccctgtggtgaaagtcagattgcttggcaggtgtatgttttttttttcaggcaactcaggctgtacatttggatggtagtaagcatagctttccatgactaaatggattaatatccttatcaaagtgcctaatttattgctagggaatagcatattctgtgtaacatctgagctgttgtctgaaaaaattacatgaattccttggagaagctgcctgtatgaatacatagtagtagtattgtaatccgtgaactatgttaaaacggcaacatatgtttattgagatgctattgctggtttaggggctttacaattgcttttaaaattcttacatcatttacatgttatagcagaggaaactgaggcttagataagtttttaaaagttgcttagataatacagttgtttgaattcacatctgctgaaatctaacgttaatgctgtttacattgtagaatgctactttagtttgatgtttttcttgcaggtcactgtaagccatttatctgcgtgtacgtatgtgtaaatgttatttatttgtttatgccactaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacaggtaagagccttttacaaagggtgtcatcttgattcagagtaacagtttagaataacaacaacaacagcaacaacaagccacctaaaacactatcttaagagtcataaacagggtgagaaagtaatgcttgcatttgaatgtgatgttgctgatggcattaacttctactatcttcaaaaaactttttaacaggctgtgtgcagtggctcattcctgtaatcccagtactttgggaggccaaggcgggtggatcacctgaggtcaggagtctgagaccagtctggccaacatggtgaaaccttgtctctactaaaaatacaaaaattagctgggcgtggtggcgggcgcctgtaatctcagttacctgggaggctgaggcaggagagttgcttgaactcgggaggcagagtttgcagtgagccattgtaccactgcactccagcctgggtaacagagtgagactccgtctaaacaaaaaaaaccttttaacagacttcttttttttttggcagactttaaaaatagaagcatattctcaatatgtatagtgtctggctttctgtcgtagtatactttacttgactggaattagtcatatattaaggtaaaaaacattaaaatattcttaagcattattttataaacatgtacatagcttaattttgttgactatttccttacagtcaacttttgcatatattgggttatatgacagaacaagagcttattttgagagatgagaatagatctgtgaggtataaatgtatcactttgcttgatttgttgaagattagaggaataatattattctttggtatgatgctgctgaaatgatatttagaaattgtattatactttttctccatatgtgagcaaaatatatttgatttagccagatggaaattagaaatataattaagagttagctgaagcaagctttgacataactaaatagaagtaacttagttagatagtttctgctaatatgaaaaaaattaagtatatgtggggaattggaaaatggaactgtgtaggaatgaaattacttgcatggcaaataagagtctttgcagaaaaaagtaaatcatgaatgtaaattatagtcattttttagaatgtagacatgctcttggtggattgaatggattgattcctggtttttcattcattagacaacttttggtacagtgtatatgctttactggtggttcagtagaaataatattggttgaaactttttactgctttgtcaattgccatgcctgtagtacatgcttggtgaatatttttgtattgaataaaatatctttatgggttggaggctggttatttaacattttgcatgttgatatgtttatccgtcttatgtaaataatgtgtgcctttcgtatccatgtttaagtatgaaataatagattctaaagctagataaaaaataattagaaatagggacttctgtttctcatcttgatgaagttaccctttgctgtaagcaacttaggtagtcagcacagtcagctgagaaaaaagaacacactaggtgagctttaccttcatccctgcatcttcctcgtgaatactttccaaactattagccctttggtcagatatgaagctgtgtacaccacaaggcttggcaggaaacaactactgtgggactgtgagctgaatgaagatttcagaagttggaaacttctcagcagtgttggagctcagaccagccagtgtggggaaagcttgctgaacatactgtgctttcagctgtgacctcagaaaggtcacaccttatgagtagggctattctaggagtagaagacaggctactatagatctcatacagcaaagccccaaaccaagcctctattttatcatcttgatccacctgtaaatttattgtctgatagaacaaaactctctctaaagtaagacaacataattcagtttctcaataacaaagcacctgcaatgtctagcatagaattattatgcttgttaaaaagcaggaaaatgtgactcttaaccagaatgaaaaagttgatagaaataaatatctaaaatgaaaaatccaccagggagtggtggctcacgcctgtaatctcagcactttgggaggctgaggtaggtggatcatttgagggcaggagttcaagaccagcctgaccaaaatggtgaaaccctgtctctactaaaaatacaaaaaaattagctgggcgtggtggcaggcacctgtaatcccagctactcaggaagctgaggcagcagaattgcttgaacctaggaggtggaggttgcagtgagccaagattgtgcctctgcactgcagcctgggtgacagtgtgagactcaatctcaaataaataaataaataaataaataaaatgaaaaattcaccagatggatttagctgcagataacatactgtggaagaaaggatcagtgaatttgaggatagatcaatgtaaaccatccaaatcaaagcacagagaaaaaatagacaaaaggaaaatgaacaaagctataatatcttcaaggatattatgcagcttaacaattatgtggtttacaggtacagaaggagagaggacagagagattggggtagaaaaatatcaggagaaatggtgaccaaaaagttttgaaatttgttgagaaacataaacccacagatgcaagaaacgtaacaaatcccaagcaagataaacacaaagaaaatcaacacatacgcacattatgaaaaccaaagaaaaaattcttaaaaatagccagaggaagaaagacacattgcctacaagcaaacagtgataaaaattatcagtgacatctcatcagaaacaatgcaagccagaaatcaatgtatgtcaatctaagaatgctgaaaagaaacaaaaattgtcaatctagaattttgtgttaccgaaaatattctttaaaatgaagctgaaatagagacattttcaaatgaactaaaacttaaagaatttgtcaccactagactttcacttaaagaaatgttatagaaagtttttcagccatgcgcgatggctcatgcctgtaatgccagcactttgggaacccgaggcgggtggatcacgaggtcaggagttcaagaccagcctggccaagatggtgaaaccctgtctctatgaaaaatacaaaagaattaactgggtgtggtgtctggcgcctgtaatcccagctactccggaagctgaggcagagaattgcttgaactggggaggtggaggttgtagtgagctgcgatcgcgccactgcactccagcctgggcggcagagtgagactccatctcaaaaaaaaaaaaaaaagagtttttcaggctgaaggaaaataataccagatggtaacttagatctacagaaaaaagtaaatagggccagaaatggtgaatatgtggacaaaaaaaaaaaatgcttttcccccccacatttcttgatttatttttattaaaagaatttttaaaatttctaagtcaaaaacaatcatagtgtatgtgggttttataatatattttggaaggcaatatatgacaataattagacaaaagatgggagtagggtaaatgatactatgctgttgtgaatttcttatataattcatgaagaggtataatgtttagggtagcctatgataagttaaggatgcatatttcaatccctagagcaaacattaaaattctaagatagatacgtagctgagaagccagttgaggggataaaattgaacagtgaataaatatttgattaatccagaagaaaggaaaggaggaaaaagaacaaggaagaaagaaacaataaaaaacaaagataggatgaatagaacccaaaagcaagatgatagacttagcaccaaccatatcaataattacattagacataaatcgaccagatactccagttgaaagacagagatcatactggatttaaaaaaaaccaagacccaaccatgctgtttcaagagatgcattttatgatattttattactttaaaaatttttaaataattttaaaattgtagaaaagttgtgagaataagaatagtacaaagagccatatacctctttatttggattcagctgttcttaacgttttaccacttttttcctgttttctctctgtatatatggacacacacatgcatttttctttgaaaaatgggcagcaagttatctactctgctgtctatattcttgttttgttaactgacccagtaatgttctatatagcagtatttttgcccctccagtagagaaaccagtttagaatcaggtgtttcatttagttgtctttaaacttgaacatttatagtcttttttttctcttttctgatagtggcacttttgaaaaatatgtatctctccccttttaatacaagtttgtcattttgggtttaaaagatacactttaaacataaaattaaatgtatgagaatggaaagagataaccatgaaatactaataaaaatagctagtattacacaaatacatcagacatttttagaatatataaatgtaattatttgtattatactactatgacatttagaacttgaatacatcaaggcctagatagtatgttatggactatgtaattttacttatggcaaggtcataaaatactttgtgaataagtttttatgacccccccccatctttggcttttacttatgttctgaactgaaaacaattattaaatctgttaggatcctatttagaatactaccatgaggaattagttatgataataaacaaagtaagatatcatgtcttccctaactctgcttactttgtaattgtcagatgtatataattcctgtacggctgaaaacgaaacccattatttcataataaagatgattgtaatgaactaagcaactttaaattccatcagttattaacaggtgaaatttacagattaaaaataggtttttctggcatattaaatgagttatacgtttcatacatgtagtttcaaatgagtgatttggccacatgttctcactcataggtgggaattgaacaatgagaacacttgttcacaggaaggggaacatcacacaccagagcctgttgtggggtggggggatgggggagggatagcattaggagatatacctaatgtaaatgacgagttaatgggtgcagcacaccaacatgtcacatgtatacatatgtaacaaacctgcacgttgtgcacatgtaccctagaacttaaagtataataaaaataaaataaaataaaataaaataaaataaaataaaataaaataaaataaaatgagtgatttggggattctgtctttaagttacggaatgagttgtttaaacagctttattgaaatataatttacatgctataaagtttacctatttaaagtatagatttcagtggttttttaattatatttatggagttgtacaaccatcacaatcatatcattttagaacattttcatctatgccaaaagaaaccttgtatctattagcagtcactcctcatatcccactccctttacctctaggcctagcctgttaggtactgatctactttttggaaatgacttatttttatcatagatctatgatctttatttttttatttttctaaaatatgggtccttggaaattttatagtttaagagaaagtagacaagatgaatttaagacactaaaagaggtatcaattatgtgttatatctctcagaaacttgtagtctccacattaattatacacttggcagtgctgttgctgttccacgttaatgcatacatgtaccaatggcataagctatttgacagagaaagaacatagaactgaaaccgttctaatgaaaggtgagaggtctgacatagaaataacattttatttcatgtattttgtttaattgctctgaggccaagatatggcagtgttctttgcatttttgcttgctttctctttccgcacttttcttcgcctcttaactatctacctttctgcccttatcttttttcttaagcatgttgtggaagaatggccttagtcatgagttgagttaatctgttgattgtttcttaactatgtattctactcatctttattattgccctataaatttgagcatagagcatttttgaataagaggttcatataaatattttaatttgtaattgctatgcaataaaaattgttatataacttttaaattatttttagatttccatgttttctagttctctcagaattctttcaggttatacagtactgagtattaagctatatacccatcaataacctagatggctaatggcacagacacacagacagactaatgttgctgaatgtaagaagagtagtagatgtaatatgtaatgttattattctgagacatgttgaatggcccaagaaaggttttggagattgatgatgagttgatccttggaggatttgtagaggtagaggagatgggaaatggcactccaggcagatggaaaggctcatgagatagtatttgcaagtggcaaaaaaggaatgaatagacaaggatattcagggataggtaagaagaagagtttagcataaatgaaggtttattttgtggatctgatgaaaagcttggataggtagatttgggtgcaggttgtgaaaacctgttagggttatctaagtggtttgtgatttatctttacagtaatagtttctgaacctggttacacatttgacttatctagggattgattcttagctccatcttacaccttatgacagtcactgtggataaggactacattctgtttttcagctcctaaggtgattctgatatatttgtttaggatcttgtatttggaagtctttgtgttgggtaagtggttctcaatgtatacctcttggaccatcatcagcattatgtgggaacatattaaaaaatgcagatttgtatccccacctttgattgactgaaacaagaactctgggggcgggaccttcaggtgattcttatgcacactgaagtttgaggacctttgctgtaggtaatatgggaactttggagatttatattggagtgtgatgagatgaaggaagattaatgtggtagcaatgaaaaggactgagtagagagggtagagactaagacaggcaaactattttgtaggctagtggagagtctatgcatatattacttgaggtattgtttagtagagaagtaaacaagacaggctttggtgtatgctaaaggaatacaaagaagggagaagaagatttctaaaccttttcagagtcttttagaaaatctgtaagatgatatggtccatctgccagcctagtttccagtatgacagatattttaatgatggtttagtgttaaattattgggaccaactatgtactgagtactggggaatagaaaaaaatacatgaacaccagagacccctggctgggaaatatttaatgttcatttatatggagggtttaggatgaagatttttggttaagtttctatgtacagttttacacatggggctgatttagttttcatgtacttgttggaggagtgttctttaggttagaaatcattcctggagaacaaaataattcaacagaatactagaagcctttagttaaatatgtaacagcatgaatgaagatgatgggatattatgatgaatagagttataagtgtttagagttcaaatttctgtatttctttgaatggaaaacatttcctgctgaaaagttgaaatgttccttgtatattaaattctttgtatagtaaattaattcttggaagagagaatactttttgatcttttaatgacttcagcagtttttttccactgcaacttgggctttccctggcagccagaacccatcctttagttggaaggctcatttgtctcagcgtgtttttgtctggagacagacagtgaggagacaaggctatagctatcatagtaacggggtgttatagtttttccctggtgtcagccctgtgaccacacaccattgcactcctttttcagttttcactctttttgaaactgtgataatagaaatacatgtttttgcccttttgagcagcggcagtaccttccaaaatgacacctacttggtgacaagtgtgtcatattgttggctgtgtgttttcaagtgtataaaagactgaggtacactagaaatacaaaatattcaatcttgttgaattctgcatagcaaaggaagaggatcactttgaacaaacccatcctccagacgttatgattctgtaaaaaatctaaatttttttcacatctcatttcaaaacacaactgtcgatttagccattgttgacttaaatgtgtaactccttggcatgctaagcagtgtctacagatggggacagtgggttctgattatactgtttaccactagcagtgacacctagaacaagtcactttactttttttagtgccttgatttcttttttctggagattaatggagacagaatgtaaaatcgttttacttttgttaactgccatataaatgtttagtgataaaattaacctcttgcagagagagcttgaagtttgctgtcaggtaagagaatccacaaaattattagtactgatccttgacctggaggggattttcaaggagacagatgtaatttctattttgaattcaggtctgaaactaggttattcttaggttctgtcgactttgatattttggttacctgaggattctataccttaaagtaaaacaaacctattttagtatttcaggccagaaaacgtatgagagtattctcgcagaaatagtttttcgtcatttctcagcctataaaactttttgataacctctattttgcgtggcatcgtgaagtcatgttgttggccaggccattgaatctccacaaaagtgcttgctcctagaatgtttcttctgtctcgtcagtggataatatgctgccaaatgaacagaatataattaacatttacaagttaaattaaaaatcttctaaattcgagtttgtttctgtagcaccaggactctccctgtgttgttttatgttcactactaattcttcaagcaggaactgatgagcagccagggagattcctctggcttctagtacagacgtagcaaatgcccaaatcagagtgctagggtgtctaatgcatagtgaagtgtgatgtcaatgtcatggacatctgaatacattgcggcaaactttagaaaatagtagcttggcaggggataccccagaataggttgatctggtaggaaggctgttctccttaaattttcacatacctaggatgggcctgctcgggcctcattacgtcttggcctagagaacacaggtgtagaaatggcaggtcttccttctccctcactgcctccaaagcttatctctgtctggttttgtctgatattttagagggtgaactgttaaaagccaagtgtccgtcagactcatgctgctaccgctcctttaagtgtgctcatcaagatttggtgcacctgggccaaggcaagaatgttgctaggatccaagaggccataataagttgtggtgattaatagcatgaagtgaaatagtgtgatgtagaaagtgtcattctgtgatttgagtgaaattaaagctactggcatgaccttcactgacatattgctcttgcctacttgagaaggttttagagcaaaggtaattacattttcctgaattggtcttttttttttttttaagcgtatttaaaaaaaaaaaacgttttctgattgtggaagcaatgagtatgtctgaatccttgagtatagcgatagttcttctgatttttttttttttctgtatgccaaattcttcagaaacttggtggcttaagacatcaaccattttatttctcatagttttgtgagtcaggaattcatgaaggctccaatgcacagtgcttctacttgacatggcattggctgagaacattcacttggccacgcatctgcagcatggactggttagaaggtccaagaagactttattatgtatctggcaccatcacgcttctccacgtggcttctgtttcaccatatgaccttgcagcagcgttgtctcagggtagttggacttcatacatgattgctagctttaactagagagcattctaaagggtgaaggctgcaggtcttttaaggcctggccttggggcattacttggtatcacgtctactgtgttcttttggtcaattgggtagctcagatttaaatggagggaaaatagaatttatttagtgtgaagagtggcaaggaatttccagctatttttttctgccacttcgttgtggactttgtaagtttgcctttatagacccaccagtcagacactggcatgaagtcattgtctttgggtttgtgtcacaagatagaggccggtatttcattgtctactgctcttaatttgttagagaatatttacgtgattaccggattcagcaacatttcaccagtttgatcacattaaagaccattcaagatacatttaggaaaatacaagtctttcacagaactcctttgttcaagtgagttaattcttggagtagttacactttgtcactttacactcaagtactgaaatgattttttatatgttattaatccctttgatctttctgttgttacagtttgtcgtattgctccccattttagagatggagaaactgtgatgggttttaaatcatgttttttagcaccaaagagtcaaatatggaagtcggcttgccctagctttcttttgcaatttttaagtcattgatttaaaagcctactttggcttatactttggcatcttgacattttacttgagaatccgtgataactttcaactgattcatttaattgaaattatttcagttcacatatttttaaaatcaaggctttgtgttgaggaatatggccaaccagggatttgtttgtatatatagaagtgtgtttaccactatacatgtgtttatgtattcatgtatgattgttttctaattgtgaatattcaggatttcaagttttttttttttacattgacagatataattatacatatttactgtgtggatttcaagtttaaaagaatagccatctctgcatagagatttgtcttttcctcttttaaaataccaaatattttgataaaggcactgagattggtctaagcctttgcattaccctatacagtcaagaaaggtgaggctatgtcttttttgtttttggtagtggcttcagattagatcaactgaatgttctgaatattttgctaattacggctattccagtggtcactgggcctcccaccattcctctccagagctgatggtaattgcaatagctgtgacttcctctctccctgtttttagaaggtgttgctttctcttgtatatcttgcttttatgaagtggctgtcagcagggagcacaaagagctctctggcagttgctgttccttcgagagcatgcttcttttgcctgtttgtcactccactgagtactgcattctggtagtgaagggagcaatccttcaccactttagtttgtgctgcttatactcttgttcagggttgaaggctggaatatagaatggagggatattactgatacgtgtaccataacgtgtatgcaaagcttaatttaaaaactgagtggaagtgaaattgtaggatattaatattttatgcccttgactttaaaccttctgtggtaaaaggtgatgtagaaactgttattgcaccatttcttctaatcttggcttgtaagatctccattagttggaattctgcaaatgaaagacgtaatgaaaggagagtttttttttttgtgaatctttgctgtcctgggcaagactcagttgttctggtaaagaggtggcaataaacaccaatgcagaagtcagacagtgcactataatgtattgaaccccattatttggtctattttaaatgtatgtataatctggttgatgaagtcttctggattctgttatcctattcatggtcagtcttagttttgttatctttactatcttaaagcagcaaatctcttttgggatgcacaattagaatggcctgtggaccccacatctctagagcatgcttcagtaggattctaactgattctaatgcacactcctggttaagaggcaggattagtaagtgatacaggattggtcatactaaaatcaaatccattaaagtcttaaggggttgaagaggtttacagaaggcaaattttgattcattttgaaagatatgtcatgtttaggagagtgtttgtgttctgcaacatatagtaaatgaagatagaattatgaaacttcataaatatgggaaggtgctttaatgtacattactataaagggaaaagaaaaactagacatcggtgctctaactgatctccatttacagattttggtcagttttatttagagtagcagcccaaagttggcaaacatagataattcctatttctgacttgaacagttgagaatgttgacaaatgcattatttcatccaataatttcttggactggaaacaattatatcatcatgttaattgtctgttattaagaagggggttttctaggttgcttcccgcccccatttgttacttgtatgaatttttaaggcttatattgatgagattttcatgtaatggaggggagaaattttttcctttttaacatgttcatgtaaaaggaatttaggaaattattttaatcttgctgggagctaagacaaaacacaaaacaaaaacactgcagaacagtttatggtcccatggacaaatgttcagtctgaacacaagtactagagaagaccttggaaggctgaggtcagaatgggttaaagtagttgagttcatgggcaaagggggacttggcatgttttcacacagttaagtataaatgtataatatgaacagcactataaagacctgggggagatgggctttggggggtttgtttgttttcttagaacatgttaccaaaaacaaaaaaaaaagattgaatacttttggatgatagggagacctttgaagaagagattgggtggcttggactttgccttttaagccacgggctgcgattatatttttgttttgtttttactatggaaaatttcaaacatgttcagaaattgaaccagtagaatggttccccatgtattcattatccagtttgatcagtttcagcattatcaatttatgactgatactgttttctatccctccgtatttccctctcctttattattttgaaacaatcctagaaatcatactgttttatctatattttaatatgtatctctaaaaaataagaactctctttttaaaattatacctaaaaattggccgggtatggtggctcgcgtctgtaatcccagcactttgggaggccggggtgggcagatcacttgaggtcaggagttcgagaccatcctggccaatgtggtgaaaccctgtttctactaaaagtacaaaaattagccaggaatggtggcctgtgtctgtagtctcagctacttgggaggctgaggcaggagaatcgcttgaaccggggaggtggaggctgcagtgagccgagattgtgccactgcactctagcatgggtgacagagtgagactctgtctcaaaaataaaataatacctaaaaacttaatttctttatcatcaaatatccagtcagtgttcacatttccagttgtctcaaatattataattattttttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgatttttggggacgtaattacttcataggtattatgcatttttggatagaggagtaaagtagtgaaagtaatgtttttaggatggtttgtctggcagcagtgtgcaaaatgaattggtagaggagaaatggagagctgcgaattagaaggcaggttcaatcagtgcaggaaggaaaggctacagtaaggcagaggcagggaaaagaaaggcaatagagatgagagagattttgaaagaaggaattttcaataccttttaggcttaactataagaaatggagagtcggctgggcatggtggctcatgcctgtaatcccagcactttggaaggccaaggccagtggatcacctgaggtcaggagttcaagaccaacctggccaacatggtgaaaccctgtctctactaaaaatacaaaaaaactagccgggtgtggtggtgggtgcctgtaatcccagctacttgggaggctgaggcaggagaatcgcttgaacccaggaggcggagcttgcagtgagctgacattgcaccattgcactccagtctgggcaacaagagtgaaactcctcaaaaaaaaaaaaaaaaaaaaaaaaagagagtcttaagtcaggttgaagttgtgaacctgagtgattgggagttggggtcaggaagatggtgctttgtgcatgttgaattgaaggtctgtgtattggtagactatccttgcagaattgtgttataggaagtgtattagtctgttttcacactgctgataaagacatactccaaactgggcaatttacaaagaaagaggtttaattggaatcacagttccatgtggctgggcagcctcacaatcatggcggaacgcaaggaggagtaagtcacatcttacatggatggcagcaggccaaaaaaaaaaaaaaaatgcatgtgcagggaaattcccatttttaaaaccatcaggtctcatgagacttatcactatcatgagaacagcacaggaaagacctgctcctatgattcagtcacctcccactgggtccttcccacaacacgtgggaattcaagatgagatctgggtggggacacagcgaagccatatcaggcagctagattgatcatgggggaccaggggagaggtaagggcaggaaatagaaatttagggattctctgtctgcctgggaatagctgaagccatacaaatggaccagctcagaaactcgtgagtgaactgaggagcactttccttaagtagttcgtcagcttaatcggctttctatagttgtcacagcaaaatattacactgtctttagagactggagtttctcatgatgatgccacattttgcctttctttgcttctgcggtttttcgtcatttataggtgatatggcagcagatttttgagcagaatccagctgctttccgaagctggagattccactggggatgtagacagcttgggaggaaataaaagccgagtccataagtgagcctgggaggagtgaagaagcagagcaagcaggacagaaagtgggcggggccagctatagggaaagaccttggggttgaagggatttgatagacttgccttagtgtcttttagttccttcagaagcccagcctgacctccatcatgagagaactagttagtgagggtggggcaccaacagttcccttgtgtcctctcctgctgtttctctcttatatccagagactacagagaatgtggttaatgggaaactacaaaacttatatgtaatcatttcaaaagtcctccctagctgaaaggattttaagaaaatgtgctattcagaaatatcccttaacctgtttaacagcatcttatttactcatctgtgttttatgaatacttttccctagttgcagaaggatggcaaaataaatgtttgctatcaaatctatacctgtaattcagtgaagcattgaacacaggtgatgtacccttcttcacaggggaattgtgttcaaaatcattttaattttttatcctcagtaagattatatagaaaatcttatagctctcaaaggtgcagattatatttttctgtaatagttctgggcttcccaaaaatttttgttggtgttgccaaagagttgtgtcacataagtgagtggcacaaacattttttgactagccacctgaaagttgtgaagggttttgaaaatataaagtaaaatataaagtgaacaccaccactgtcaacaaaatccactgctttggatatgatttcacaggaagatgacggctgtcaccaattgaactacagcaaatgacgaaagctcagcacgaattagccagtctcattggggtgataaacgacagcacattaaatatgtgttagcaacgtgatatggcagtgaaaaaagccaacgctatttttggctgtgctgcacaaaacagcatctcgtcaccgagctgggctgatcattactttctacccagtacttgtgaggcagcatctgggatgctgtcttgagtgtaggacacgtgcgtactggaaggatagacaaacgggtaggagtcccaagcagagcatctgctgtgactaaggactttagatgagacaagttttagaagtggcatgtttaggaatgagcatggaagtaaagagatgttaaccttttcagagataggatgatgttgaggaaatacatcatagactcctcattagttggcattagtttagtacagtgcactttagaggaattacccaaatactttcacagacagcatatcagcaaaaaggggctctaaagcaaaattaagcaaggacttatttatggtcaactatgttttaatcaagagattaacattggcagtgcttgctataatgtgagaaggaatagaaagtaatagattacataagtcaggtgcttttgattggaaattcaaatgcaaatattaaacctgggaacaatgggggtgagactttatagttatctttagaaattcaagtaacaaataaaggaattacttactttccgcagtagtataggcaagcacaacagaaagaaataatttaagaaatacatagtataaactgaatgtcagggaacatttctgcagtgagaactatcggaccataggatattcccctaggaaaattgggttgaatttcattggacatttgatcctgacagaattgaatgtgtatcagtagggaaatagactgaatatccctgtaggcatttttcatttctctcttctctgattctgggccctgttgatgatctgttcacctgctgtgattaggaagaaattttatctcttgtttttctacacccaggcacattttagatgctttcctgattgacataggctaaaaatggagcttcattgccctgaggttgacctggtaccatccctcctggtgttgtagaaatttctcctttctgtttgggaggcagtgttagggtcctttacctaaggtgaatacatgtaatataaaatgggcccatgtgtatagggtcagtgtcttcttcagatatatctagtaacctaacagggctgcaagctggcctctttgggagtgaatgatggttttattttcccctcttcccccaggacttgactttgaagaaaaaggatatttagcagactaggagaccacagacttttactgtgtcctgtagaaatgtgaaaaatttcaggttcctggatgggaaagggctactggagaagagcttgactccttatgctgtgacagtggtgtgtatgccagtctttccctgtagtagtatcattgtataatcaaagaagtaaactaaaaatgcaaatttaatttcaggttcattacaaatggtctgtatttccttgttataaactagtctattggataagattgttagatagattgttatccaatcttagtctattggataagattgttttcttagcttggcattcaaatacctgtacaattcggacaaagtctctgcttttccaggcttagtttacccttttctatagtaatgctgtattccagttaaatcagcctttctttctgtcctctaaatatgactctgtcctttcctacagtagtagttttgtttattccatacatctttcctactgtccttgccctcatctctgaataccttctctgatatgctccagtcctctgtcttacctatgaagcatccattgatcatttcccttcaagaactcattgcatttcttgtttttaccactcatttgacatatctaatagttatatttttcttcctctactgaatccacatctttcctttttaatcagattaaaaaggctctcttgaggaccatttcttacatgtctttaaatttctcacaactagtctttaagcctttggagagaaggaactatggcttatttatggtgcctgtctcttcccctaaactcacagagtttggcagtatgcacttaataaatatgttttgaacaaatgagtagtagatactctatacatatctattgattgatttaagatttgctatagactgaatgtttatgtcccccctaccccatattcatatgttgaaagccagtccccaatgtgatggtatttggagatggaggctttgggaagtaattaagtcatgatagcagagccctcatgaatggaattagtgcccttgtaaaagaggccccagagagctccctcgacagttctgccacgtggggttacagcaagaatatggccatctatgaaacaggacaggggtcctcaccagacattaaatttgctgatgcctttatcttggacttcccagcctctggaaatgtgaggaatacatttctcttgtttataagctactcaatctgtggcattttgttgtagtggtttgaactaagacaaggttgaattttaaatgctttgtaaatgtgttgaactttgtagatttaaaaatcatgtagcagaagactcataaagctacgaaggtttgctatattcccaggagaccagttcctcctgctttctcctagaccagcctgcacttaaatcatccctatatgaagagtttctgttggccaggcagattgttagctcaggtttccagatatgaaatgatgtcatgaaataatgggcatgaaataatgttggcaagagaaaccattaataattgggactgtcatagtattactattatatagccaatgctcgtgcatagataatatcatttctatcatgggtgtgacaataatagatttggaagaatggtgaaaaatttgataataggttaagtgaaattaaactatacaaacttgtcctttattctttgaaaacgatttaaatttttgatttttcattttaattttcttactcgtatttaaaaatttttccttcatgtcttgctagtgaaatgtacttgctgcaaattaaatccatttctttcagtgatagctttggtttgtaattaccttctttaagtgttaagtctgtccttagaatcatcagagcttctattatgtaattctttggagtaaaccctagttaatcagagcatgcatttcactggaggggcagctcagtgagtgatgtgaaggtgtttcctctgagaaacggaaacagttatgaagtgttttgtggtcctttgggagttgaggtgctatagaaatgtaaggcttttattacaactcctgacctactatacagaaccatgctaacatcattgatgattcttttgcataatcaaagaattaaacataaaagtcatattaattttcagcttcattagagatgcaagaatcaaaagagatgtttgccaaatgggaaggcactaaattggtaggagaaagaattttaatttcaagcttcaagtgaatgttataaataacctagcataaaaaagacactaccaaaagcgcctgacaatgtcctttttaaagatcagcaacattaaaaaggggaaaatgtaaaaaagaaaaaaaaagggaaaaaagaaactataaaaatatgaaattaaaattgctgtatttgagtcagtttatggtagtaaattacttctgagagcctcaatttgaagatcaccaggtagtctatggtaattagtataattttgctgtggtcaccaaatctttatattatttttgctggtcaaacagcaatacttttgcctttttttttttttttttaacttggtcgcagttgaagatgatgaaaaatccatttactcgtgaaagggtaaatgcaacttcctgatgtgaaataggggcatttaaagcactcacattaaggaaagtttgcattttaaatataaagtagtcttaaaatttttctctacccacatataaacaccattccaatatgtgtgaagagctgttgttcatcttgtaggatcactaatcacaggattaaagcgatgaggaagtatatacagtgaagaatgatgcccttttctttaaaacaaaaatctggaggcagccagaagagcttgggaaaattcttgtattttatatctattatgctcttgattttatatctactgtatctccctgatctgtggccagctgggatgcaaatacggcacaagaagttcacagtatcaaaggagcaagtgaataggaccccagaatgtgattgttatgaaagtactgagattattacatttaggccctatgtgattctggaggaagtgagttttactgctcagtagaaaattatatatatatacactgtatatataaaacacacacacacactgtatttagaaagaaaaagaccatctgttcattctgtctgtatttctgtggggatttaatctgacagtgaatcacttgggatttgtacagaataaacttgtgctaacatttttatgaaaaagggtagggaagacaaccaaaattttctctttagggattgtttagctctgctttttttgttttttttctttacagcatacgaacatggcaatatgatgattgattttttttttaatttgttttatgttagccttttctgattctacaggagaggttcattcctttgtcttagcatgaaaatttctcaggatagacagtagcatcaggaatgatctttaatagagtagtggttttcaaagagtggttcccagaccagcagcatcagcatcacttaggaactagttagaaatgcagattctagtgctgtatcccagatctcctgattgagaaacttggaggatggagctctgcagtctgtgtttagtaagccctcctggtttttctgatatgcaggagaaccatggaattagacacagactgtaataatgaaacgctagtgttatttcaagaaacttcaacactcagactcacttatgctgatgaatatgacctgggccaaaccttaaatatcttatttccttccaccctcataacacttcggagagcctgccatcattattcttccgttcagatgatgacactgttcatgctcatttgattggtaagcagtgaaccaggctttgaatcttggtctggtttcaaaatttattttcttaactgctgtagaataggaagatttaaaaaggaatgattttcaagtggctattcttgtgactttttacaactaagtatgtcatcaattaggaaagtacctgaggggttgagtggcaagttgggtgccaagagcaaaccagattataatctagaactcagttctagtcctgactctgcctttactctctctcattcatttagttggcctaatgtcctctgaacaggcttcctcctgggacacttgattcgttagatgactatacttttcctgtgaagtgtgcctattttacagagaagcttcccacttcgaactggaaaaaataagcatagtggagtgactttttcaaggtcattatcccctttcaatgggagagctatagtttgcttctattcagtaccatcctgttgtaatggaaaaagaaatacaaaccaaccaagatgctgaagtttgcttttacctgcattatatttaggggttcatttgcaaacctgaagtatttcattgacttgtacctttgctgtttgtcacaacaataatcatgattctttcatctcaagccttgatttgaaacagcctggagctggtccagacaaagcccatctagtcattgtatctaggcctgtcgatatcctcttgtttgtttttgtttcatttggttttcttttctttttttttttgagacggaatttcgctcttgttgcccaggctggagtgcaatggcgtgatcttcggctcaccgcaacttccaccttctgggttcaagcgattctcctgcttcagcctcctgaagcagctggattacaggccaccacacccagccaaattttttttttttttgtatttttagtagagaaggggtttctccatgttggtcagggtggtctcgaaatcccaacctcaggtggtctgcctgcgtcggcctcccaaagtgctgggattacaggtgtgagccactgcgcccggctcatttggttttcttacctgtcacctaaagttgcagtctccttaactgaattattagttcttaggcattaaggacagcttctttgctttttgtctgtaaactattgctgtgtcattttcacagtacatgctcaataatgtcataaagaattaatattttgcctcttccttattttattgtcctttcccataattttccagcctatcttctgtatattattccatttaacttttctgtttgtgatttttttcctctgttccctctgagcatttgtacttgccattcctgtactgcagatacacctttgttttcttctctctccatttattctctccattaataacaaaattaaaaaattacagctaacatttgataagcatttaccacataccactgtgcttagtactttatatgtattatctaatttaacccccacatttataatgccattattattcttagtttgtaggtgacaaaaatgaaatttggagaggttaagtgccttgcctcggctattaagtggtgagactgagattcaaattcagctgtatcttaattccagttaaacttttaattatagtattttgcctccattgttttcaaaagacataaaaaaacctttatggctttgtctgctttgctttggtatgacgtcttattcatgtattaggcttaacctgcttattgtaatctggaaaaaaaatatgcagagacctctaggctgacaggcacctatacctagaataaggattttctgctagagggaactgaatgtcatatggggctgtgatgggctacagcctcccaggttaagacttatttcacatggatcaagctatctcctcactccagcaatgacacagttagtatatatgttcataactaagcttaaatgccatttttaataaatattaataccagtataaggtaaggacaaggatgcacatacagtcctattatgaaatagggctgtagcagcatttttctagtttagttacttccttccagtatttcaattcctttcaatccaggatcttagtgattttgcatgtaaacctttttcctatttcatgctctctctttgcatttgctttattcagttgtattgaatttctaatgtggattagagcacacagtagggctggttcttcattttaataactttcctttccaggcacttctcagtaatcctttctttttttaagccaggtttagagagggagctaaaagcagaacaagacatttgagtttgtattgttctgctttattttcataagttccacattctcaactgaatttctagggacgaaagagaactcgattacttttagttcctttcagtgccactctaacttagtgacttgacttccatttctctaagtggaaatatttacatgtatttcaaaggatgctctctggcttagttagtatctctacactgattagagaatgtaaagcgatgtttaagtgcttattattttttaattacatttataaaggttaaaatatagataactcaaccattattattatcctcatttagaatttgtataccatttacatttccaaagtgctttgttcatgtaaattagttggtcctcctgccattcctataaattatgtcagtactatcctctgaaatgttgccattttcagtttatagttattatttttatttcagacaactacaccttgttcaaagggtgaaagtgattaatagctttaaaaccactaaaggtaaacattcttaaatacccttgaagttaagtagatgccggaattgctgagatggctgccaagccaatgttggagaatttatttttttgtacagattatatatatatctttgattttcttcttctcctctctgtttattttgtattttttattcatataggaatgtgcacacattgtatatttttcacaaaatttcatgaactaaacctacccactaaacacttgtgtcagggaacaacacagtaccagcatcactcgttcattgaatctcgatttgagtgcgcgattctgtcttacagactgaatctgtctaaacatcagcatagctggaattatggacacaatgagtattcatgctcagatgttgcttccattataaaactaatttctgtatgttccaaaagtgttatcttactgggttaaaataacactgagtagtcacagtaagagatgcacacaagatgtgcctcatgagtggtgtagacaagatatactgttggacatcacaggagcaaagttgtaccttttcagaaatgcttcacatggaggtgaaattagagctggactgcccactagggatagagggcttagacataagtgtaggctttggtaagagaaacaaagaagagggagtagtggtggcatgtgtcccaagcagggaagatagctatgtcttgcatatgacatgttttgatgcagggagagttccagtttgtttggagtaagggttcatgtatgtgtttagtcaccattcaaatttgagagttaagtagaggtcagatatctaaggactttgaatgctagctaaggactcatagtgaactaaacacttactgaataccatctatgtgttaggcacaatgctcagcacttttatatgcattttgaatttatgctcaagacacttggatctgcgggggcaggagttagtggcactgagatatatgagcagcctgggtagaaatggagagaccagagatagaaatcgcagaagactattagggttgatgacaccttggattacggttggtcctaaaatttataatttcagctactaaagacctggttctagaggactgaaacttcatcttttcttggttattctacatataatctaatgcaataagaacctgaatgatgagtacttagttggcagatatttatcagttgcctactctatatacatctctttgttagatttgatgggctgctcactctgtccctctgcccacctgatgttagttaatctgggggacaaccatgtaataagttacttcctagtatctatagtgaccagttatttgggagtcacctgattgaccaaagactgtgtttttacagtgttgtctcctttatttttttcttaggattctttttgcttttcttttttacaacagcctactgtgtcgcatcactgaatctagtttatagtttttcgtttctctacattccatcattttagaaacaaaagccacatctctttgaagaagtacttttgactttttctcccaattttagcacttgtccgtaacaactatgtaaggtttgttttgggccctcctttccttctatcacccctttgaggggctcttgtgccctgttttgtgttacgtggtaggttaataaacgaggtaatgaggggatgaatgtagagataggtggaacatatagattggtagattagtggatattttggaaaatgaattgtgtaagagaagacagaatttgaaaacagaaggacagagaaaatgaaaaggtatgagacctcagagtgggggcacgaggagctgtttgtagccagaggtttctggttgaactcaggttcctaaactctgagttgtacaggaagtagtaaaagttttttaaatgtccttctagttctcttttaaccaactagaagagttgccaggatttttaatttccactctggggtgtgcctaagaatcttagttaccattaccatttgtatacagtattattccttgagaataattccagagcccactttttttttttttttaaacttggcagtctgaagagatttggcctctttgtagtggtttttgtgctaatattgatccaaatttagtttcagtgcctgttttcttctctttcctattcagtcaactatttaacctctcagtgattttagttgtcctgaaatttggtctttcttagcaaggacagtttgttttatgttctttaatagttagaggatgactgggttcattcccgtaataccagaactttgggaggcttgagataggaggatcatgagctcaggaattcaagaccagcctgtgcaatatactgagacccccttctctacaaaaaataaaaacattagctgggtgtggttgcatgggcctgtagtcccagctacttgggagtataaagtggaaggattgcttgaacacaggaggttaaggctgcagtgagctatgttgctgccactgcactccagcctgggtgaccctgtcttaaaaaaaaaaaaagaaaaaaaagataaatcatcactctgaatcttttcattgagaattttttttaatagcctaagatgctaagtagtctatacagtgatttctgcatgattttcctttttttttgtctaaatcttgacataagtttaccttcttcaaccttttaatctattcctgaatgcattattttaatagatgtgctatttattaatattttggaactagaatattaattaccccttttaaggcaaatcactacccaaaacacattaactgtgccttcactaagaaccttggtaacacatttgcacctgacaaaagggagtgggcagaaaattagctaatgaaatagttgttctggagtactatgtaattaagggctttgcagagagcccttggggaagctggaagactgggaatgagttaaatgtatatgagttttctagtgctgtagtaaataaatgtgtggtagaaatgaaaattttcttgcggaaagtatttaaaacaaggacaaactgtagttatattagtttgcctaagtattcaggtgtataggaaattctgaagatactttttgttggctaattgccattaagtacccacgtgtactgctttgtaagtggtaaaatttgaaggctgctgttgagtaactgtttcaaacaggtatgaagtcagcagtgcttatgttttcattttatctatcgggaataagttgtggacaagtctcctaattcggtgcttctcaagctttaacaagcatatgaatcacaatcactgggggatcttcttaaaatgtagactttaattcaggatttcttgggtgggactagagaatttgcgtttcattcattcatttatttattttttgagacggagtcttgctctgttgcccaggctggagtgcagtggcaccatcttggctcactgcaacctccgccttccaggttcaagcagttctcctgccttagcctcccaaatagctgggattataggcatgcgctaccacacccagctaattttgtttttgtatttttagcagagatggggtttcaccttgttggccaggctgttcttgaactcgtgacctcaagcgatccacctgccttggtctcccaaagtgctgggattgcaggcatgagccaccatgcccggtggagaatttggatttctaaaaagctatcagatgataccagtggtgcatagaccacactttgagtagcaagagcctaatattttttttttttttttttttttgagacggagtctcactctgtcgccaggctagagagcagtggaacgatcttggctcactgcaacctctgactccctggttcaagcgattatcctgcctcagcctcccgagtagctgggattacaggcacgcaccaccatgcccagctaatttttttatttgtactagagacggggtttcaccatattggctaggatggtcttgatctcctgacctcgtgatccacccgcctcggcctcccaaagtgctgggattgcaggcgtgagccatcgtgcccggctgcaagatcctaatatttcttagaaggagagaaatcctttactcacaggaactgtacacacatgttcacacatatgcacaagcatgcctgctatccataagcatttgtcatctttcagatgatggaagctgtttgagacccttaagggactgtagtcatgactcctgtcttttcagtatccctttccccttatcactgtgatcctactgcatttatggaaaaactgctggcgggccatcatgtttgacccagagctgaagttcagaacttccttgttgattgtcagtgttagtaggaatgaatttagcccattatagtgattggcaattagaatggtaccaacattatcagttaaatcctgtctgtttgcttaactcagttttgggtgctaaggcagctgtattctccatttcagtaacttctgaatattaccattcaggtgctctgcatcaaaaagccccacattggctgggttttgtggctcatacctgtaatcccagcactttgggaggccaaggcaggaggattgcttgagcctaggagttcaagacctacctgggcaatatagcaagatcccatctctaaaaaatttttttaaaattagccaggtatgatggtgcacacctgtagtccttgctgcttgggaggctgaggtaggaaggtagcttgagcccaggagtttgccgtcagaaaagtcccacatcagttactaaagtctaacagttctacctctctctgtctctaaaatcctcttaagtctctctgtctctctctaagaccacagctttagttcagggcactggtctctctccctggctcaccataccatcctattaactgatcttctggccctattctgatatattctccatagtgcagctgggatcagctttctaaatgacaaatccctccttaacttttttttgtttgtttgtttgatacagagtcttctctgttgctcaggctggagtgcagaggcacaatcttggctcactgcaagctccgcttcccggtttcacgccattcttctgcctcagcctcccgagtagctgggactacaggcgcccgccactacgcccggctaattttttttttgtatttttagtagagacggggtttcactgtgttagctaggatggtctcgatctcctgacctcgtgatccacccgcctcagcctcccaaagtgctgggattacaggcgtgagccaccgcgcccagccccttaacatttaaactctgaaagttaagtccaaattccttgacatggcacacaaggccttccttgagtctggccttggaagctgtgcatctcacattagtttcttggtggggtcctttctttcttgcctccaatcttttgcacatattgtaccctttgttgtagaattccctaaagtgctgtgcacatttctttcttgcagttttcatcttatgttgtcattgccttttcttggctcaactgggaactttcttggggccatgactctgacctgtgcacagctgtcttactgcctggcacattagaaatatttattgaataagaggtgaaatgaaaagaaaaggctgcgtgcagtggctcatgcctgtaatcccagcactttgggaggctggggtgggaggattgcttgaaggccaggaattcaagaccagcctgggcaacatagtgagactgcgcctccaccccctgcgcccccccccccaatacacacacacacacacacgcacacacacacacacacacattagttgggtgtgataacctacacctgtagtcctagctgcttgggttgctgaagagggaggatcccttgagctcatgagttcaaggctgcaatgagttatgatcatgctactctactccagcttgagtgatagggcaagaccctgtctctaaaaaacatttttaaaaagagaaaattaaaacttaggtaagtactgtttctttattttgtctgaggtagaatttaaaatgttgaggttatggaaagtttatattaaaatcatacaacattgatttagtaataaagctttaatgatgtatgtagagcaaatatcaataaaacaaaatttgtaattttatattagtatgtaggcaatgattcatattaaatatggaagaggagggaaaagatctggaataataatcataaaaccaataataaatatttgagtaaagatagagatgttgtagaaattgtaaaacgttaaatttttccctttttgtggtttctctatttagatcatggtaaatggatataagtattatcaaaaaatattgatataattttttattttctgaatatgatttttatttgtctttggtagcaaatgtaccacattaaggtggtatttggattataatttagggctagtaaacaggaaggaattgccttaatccaaatatacagtagtcttcccttatttgtggggataatttccaggctcctcagtggatgccagaaactgcagattgtaccaaaccttatatacaccatattttttcctatacataactatgataaactttaacttataaattaggcacagtaagagattaataacaatgatagtagtatgctataataaaagttatgtgaatatgcgcttgggaactctttcatgcacacactgtcttgctctctctcaaaatattgtactatattgaaggtatgtactgtactgtgggtaactgaaaacatggaaattgaaactgtggataaggggggactatccatttacctcacttagtaaatatttgagtgcctactgtgagccagacactgtgttaggtgctgggattataagcaagatatacatgatctgaaagataaactatgtccattatttgcaaaaacaagttacatgtgagtgttctttgctgtctgtagataacaaatatgtgtatagtgatttactgctcatagagctcttttgtgcgtcttattgcctttaattccacgtaacaagctgagggaaacagagactgagagtaatttgtagaaagtgacattgctgtgtgatagagaaagtaaacttgaacccaggataggctccaattccaaatcccatgccattttcttacaccatactgcactacatccatgggcgattgtggaataccttacagaatcatatcaagtttttaagaacatggtttgaaaatcactttttttttgtatttataacacaaatgcttaataatttttgagcgttggggatgagcacaacctaacttatatccattatattactattgcgcctctgacactttaaaacattaaaaacctggttttacccttaatgttttctggaattgtatttttttaaattagcagtaaagggaaggtatgtattttttgaaatttcttcggattctttctgccttttgcaatttccttgctatcttgatgaaatacaaagggtgaaattcttatagctagaaggaactttagagaaagaaatatattattggaattacagcacataaataaaatacagttctcataattcacctcggtttaaattattctttgtatctgcttctgcagaaagttttcatttaggcaacagtcattgatattgacagtgtcagttgataaaaatgaatgtaactgtggtttattaaatgcaatgtgatgtatgaatgtaaggtggtattactatagtcctccacttggacagagagtgagaggggacagtccattgccactggtattgatgtcctaaagtgtgtgccatgaaccttatgctctttattaggaaggctactctggcttgtttactcttggatttgacaaagactgtttccttgacagaacttcagttaggttcctctgagccctcttctcaacgtggggtcaaccttgagtttctgtgtttgtccttgctaagtccagctttagcaagaatcctgctgtgtcggtttaatcagaatccaccctcccctttatacctgatcaccctgatcagatgtggatctgatcaagttccacatcccccacctttgatctgtaagtccttgacctgcctttagaaacaatcctgttaggttagtttaataagaatccccctactcttaatgtgtttcctcttagtacttttccatccaccatcctcttactttgcttcttggctataaatcccacatgtcttagcttaatatgaagttgagcccagcttctctcccctattggaatatctccattgttgtggtctcgaataaaatcttccttaccatttttaacatgttttgagaatgactttttttctttaacagattctcagcagcaaaagcaattcaagtaatcaagtctacgattgggtatagaggttaaggtctctatggcctaaaggtaaaagaaggggatatcagccatattcaaatatgtaatgtttaaataagctatgaaggatagcaaccttgggtaagataagatgtgtgtaagatgtagtccacagcaaactgaaaagcgtggccataaattctaggagtgagattaatttaaataaaatgctgataataaataccaatattaccaacctatggaccatttctccttgaaggaggatgcaaaaacatttaaaatcaagctggaataagcaaaataagaatttaggtaagaatggagttcttgttgagctcctagatttctagatgcacacctggtgacactttttttttgtcctctcaataattatggaaagccaggaccattaattatttttcacttttagatgataaacctgtggttaaaaatggtcaaataatttatttgaagtcaactagaacttaaacctgactccaaaacttgtaaaataatggtggtggtaatgatgaaggagaaggggaactggggagaagttagtggtgatgttggaggtgttgatggtgtaatagatgatgatggtggtggcgacggtagccatggtagagatgttggtggtgataatggaggtggtggtgctggtagtggaggaggtggtagtgatgatggaggtcatgttagggtgatggtgatgatggaggtattggtggtgatgatgggtggggagggaatgatgttggtggggtgggactggtgatcgtgggggtcatggtagggtggtagtgatgatggaggtattggtggggatgatagagctggggatggggtggtgatggtggggtggattggtgatggtggaggtgatggtggtgatgatggagagattggtagtgatgatggaggtggagagaggttggtgatggtggagtgggattggtgatggtagagatgatggtgatgatgatgatggaggtcacagtagggtggtaaggatgatggagggattggtagtgatgatggagttgaggagggggcggtgatggtgaagatgctgatggtaatgatggaggtgatggtgttatggtggtggcagctgccacttacttaggatttcttttgtcctaacctctgggatgatctaatttcacctacacctctgcatccataatttactacatgcctattaagtggcagagcttggatttgaacctaagtttgtctgacaccaaagtccacatacttcacaggaatgttgcgttgcttctcacgttatttccagtccaccatatgtgaattctgtgtattttcacagaataatgacacctgtattctggtactgtgggactagtataagatggtcaaactgctatcaatgattctattctctttgcatatttcagtatccaacaatttatttataagaccaaaagacctttctgaactatcataggtagcctgtgttaggaccatcttatataaacaattttctcttgctggaactatctggagtgactgcataaaaaaagaagtataatcaaaatcggataaacctcccagtaggttagtcaatagataaatcaccattgttcttacttataggctgtacctctgtgttgttcataagggattgtacagtaaccagcaaatttgtaaatgtttagctaaaattcaataacagaatgatcaagttttattgccactttattgaggctttgttttccgttagaaagctaccatttgatagtctactaaaaatgccagaatttagctgtattaggtttattcttaattcattgccattatggaatgttcctatagcacaagtgacaggagaaatccatgtataaatgtctgtgctacatgctataagcacagtgattcccacctccaccctccatcttctcaaagcaatcatgtgaagtatcaccagctatgagagacagaatatgctggaggctaaatttctttatctttaaaatgtttccaaaaatggccagaggagttgatttgcttttgtttccatgagtattttcgctattacctttagagatcactaactcagagcagttcatatgactttctgctgtcatcatcctgacccctgcctaaacttttcttactgtggaaaatattaacaattgaccttattcagacatttggcaggctgtggtcattattaattccttcttgcttttctacatattttaattgccctcgggatctggtattctgaagaatgctactattggccagcttgataagtttgggaaatactctcctcttcatagctctgagttagttagccttataggactagtaatgagagttgaatgaaagaactagaaattactagatctttcttataagggaaagctcttcttagctaacattttaaaataattttgcatttttttgtttttcaatagttaggctatctgtatgatgttcttaagagaatattcagaattattagcttgattttaccaataaagattagagactgagtatacagatttgctgggagtctctttttcatgctaagaaatgaagttatattttacccaggcctccctgcttatcatcttttcattttttcccttcctccagacagcccatcctgctgagccaatacacagttttgaaatggttttatgtctatgagcaccacatggttagtctgcaggaatcataataatgtcttggacatgtgtttcaagatagctcagccttcttatcaagacttatatctcacaggatatcagaggagggagggaataaagcattatattagggaaaaaagcattacattagggaaattaagagttttgtgcagggttatcaaatgaacgttaatattgaggaatgtatatctgtgtgtgtgattttttttctccacctgtggctctgctgcgtgcattcacattgtgcatgcgtgggcatctctctgctgccttattttatctgatttattttttacaacacaatcatttaatttgactcacctgaggggttatttcattatcagcatgttgtccacttctatgttaggtctattttgattgaaaccttggatttttcccttcaggattgtgtgttggggtgggggcatactggggatgacagagggagaaagaaagatttttatttttccttctaataaatgttcattgagaaagttatagaatatggagaaaatgaaatttataactctcctgcgcagaaatactgttagctgtgagtttcttttctatatatgcttatatagttgagattatgcatgtatacagttctgcatcttagctttaaaaataatgtcacatcttgataatttcccagtcattaaaattatttgaagatatcattgatgtatcaccttattttatattctatttgaataatacatccaaggtcaccaaaagatgacagtgaaatgtattgtttgtaatctacattagcatcagtaaatatggaccatttaaattgtgttaagtcaacctctctgatcttattttattaaagtttaggataggcactacattggatgggactgtgatcttaagagtctcttaagaggctatagttacagaggctaactatctttggtttacttaactttggccgcttttttaatccatatactataccccaaattatggtcagccatcttaaaagtatccatcttttgtatcaaaaggaatttagcaaatagatgtatgtagattagtgcaaactcattctcacttttgtaaaaaatagttaaacttgatgtcttacatctgtagactcatttttggatacaaagtcttaaatagtttgtgttagtcaaatataaagaagttgaagcatctttgtatattctgtagatcatagatcctcattgaatcattttactatagtgtagtctttaatagtttgtaatgtcattagaagtaaactcaataattcttattactatagaataaacatgctattaataagaatagaaatattgttagtcatttatgcgttgaaaagacatttccatttcctgtgcttttcctgacctcagccagtacattagcacattcgtacactggcagaatgctaactagatgttatcacagattatgtatctgtagatttaatcttttcaggacttagcatcagcaaaagtaggacagtttttttttagtctttgtattccatctaaacatgtattgacattctcaagaaagtcatttgaacaaaaatcccaacatcaaatactccagagaaggcatctccaggtgcaaattatgatcagattatgggagatttatcttcaaggtcacaaaagtatgctagctttgggggaagctgtgtcatagtgtcaagtggaacatgcttgtttatttggtactcacgcagtgttgtttatactgaaatacttgaatgtatgtgctcacctgctgtttttcttctgccttttaaaagtcttggagtacatcattataacaaagcaatttttttttgattttgcattgcaagtttttgtttctctctaataatgcagtttacttctaagtgtggctttgataggaagatgtcagaccttcgagtggatcactaaataataatcacttgtctatcagtgagcttgttataaggtgtgttgcttttgatgggctattacctgactgctgggtcaaagttagtcttgctctgtattgggcaatctaaatttaagccttgaagagtgtccagattgtacagaatttctgatttgtatctggtcaatactgtcagaattcagtttttttttttttttttttttttgccagtatttggttgatgggcattagttagctgataaaagtggtatgttgtggtggggcattgtgggagattagacatacttttattggaatatatttgggtattttaatattcccatctttatttgggataatgtccaattatttttttcactttcaggtataaagtgttgtgtttttcttcagcatttgtctaatggtagcccagctctgcaaccacacaattaatcccaaaccgccatgaaaaatcaaatattctttttagctgtggtcccaattatgctggagactgaggcaggagaattgcttgagtctagttgagtccagcctgggcaacatagtgagactctatctctaaaaaaatcagaacaaaacaaaagaacaggaccgggtcataagcctaattcatgtgacaccatcaagcatcagaaaaaagtagtaatcatagagaagtttttcataaataaattctgaatcatattaaaatttaatgggagaaatgaagtttgaggttttctttttttcccatgaaaataaaattcagaagatgtttacaattactctgctatctttctcaaaatagtggtttaatggcaaacctctcggaaggactctgtatctttcttagaggtgctgaaggcattgctggtgctcagttcatgtttaataataatgttattctggattgaagtgtggctagtataccagggttaatgctggtgctttaaggagaagggtgattggcattttaatcagtggaaatgttcagaacctttgtctgaacgactgtatttccagctgttcagatttctcagttctggttcagtaccaattcaaagcggagagctccatctactgaagacctatttcggaatgatttcttctgttgagttcagtgattttctgtttgcacaggtcattgaatttttttctgatttatgagctccaatgaaggttatgatgaaactggcaatttggtcatttcaaaaccaaattccttgtcattttgcttagtgcctaaatccaaaggacttaccagggggcattcttaattaactgtatttaatagtcaggttttcttgggaccaatgtagatagtaagactgctcttaagaaactgttgctatagatggtctttctttagtcttccgtagctgaatcccctttcatagactcacattgggattttattgacgatgtcatagaactgcagtgactttggtgtcaaatttaggcttgactttcagtcttgctactttggatggctcaagtgatggaagtgcaagtgactcaatttttataaacctcagattccttttggggacttatagccatgtttaatcagtctggactttgctggaagcgcagaagaatcttcgaagggttttaaataggagatcattcatatttgcactataggtcaaaccagagattttggtacccagaactttagctgtcacttcatttagagattaccaaagctgctgagagctatgttgtccaagatcatatactttcctggtttggcccatagtgactgatcagtgaagggggtataaagtccaggccatctcagacagactctgaataactttaaagggacatactttcatgacagtgtaacagagaagacacttgaagcagatataaaaatcacaagccctaaaagactgacttaaaaaaatacattaacttaaaaatcttaaatataacaaaagacattaaaacaaaacaaaatgatagaccacagactggttgtatgtatttgtaactcttctaagtggtcaaagagaagtatccaggatttgaaagaagtcatacaattcaataagaaaaagataaacaactcaatggaaaatggataaagaatatgactaggcaattcacataggtgaatgcttgaatgaccaattataaaagatgcttaactttgctaatagggaaatgaaaagtaaaaccctggtgagattccattttacacctattgattgacaatacctaataagcttgataacaccaagtgttggcaaggatgagaagaaacaggaactcttgtatattactgatgagaataaattactacaatcttttaagcaagcaatctagaaatatctggtaaagttgaagatgtccatattctgcaactcagccattctgcctttatgtgttagcctaggaaattgtcacacatagaaataaaagagacatgtacaagggtgttcattgtagcactgtctacttcaaatagaaagaaagcagaggaatgcataaatgtagggtgatgtttcctccatacagtagagcagttaaaataaactagttgcacatgtatccacatggatacatctcagaaacatactaagggtaatgtaaactgtaaaagagtatataatatatgtaatgtaactattatatatgtgatatagtgattgtctatattctgtattatagataaaccttttttgagatataagtttgataccatacagtttaccaattcaaagtatacaattcaatggctttaaacatgttcacagagttgtgtatctgtcactgcagtcaattttagaaaattatcattactccacaaagaaagtccgttctcttagccatcagccccctacccccaaccgctgccagcctgtcatattctccagccctaggcaaccacaaatctactctctgtctctatgtatttgcctactgacatttcatataaatgaaatcatataatatgtggtctttaatgacaggcttctttcagttagataatgtttttgaggttcatcagtgttgtagcatgtatcagtacttctttttttattgctggataatatttcattgtatagatataccacattctgtgtatccattcattagttgaacatttgggttgttttcactttgtagctattatgaataatgttgctatgagcatttatgtttaagtttttgtgtagacatgtgttttcatttctcttgggtatatacctaggagtggaattactggattcctggtaaccctatgttggaatagccaaattgttttctaaagtggctgcatgcttttacattcccaccagcagcatcagagggctccagtttctccatatccttgttgatacttgttactgttcatctttgattataaacattttagtgggtgtgaggtagtatctcattgtagttttgatttgcatttctctggtggctaatgatgttgatcatctttttcatgtgcacattgactgtatatagatttgtaaagcatgtaaaacattggcatatattgtttctcgatacacacatgtatgatcaaagtataaaaaaatgggaagagatggtgagtggagctttagctatatttgtgtcattttatttcttaaataacaaagggcattaagcaaataaggcaaaatattagcatttgttaaaattgtggtgctatatacatagctgttatattattttctaaaatatagatatgtatagttgtagtcaacaacctcaaaataatagttgttgtaatgagagtagaaaattttgccaaggaacaattaaaacataatacaagttgcagaaatgctttggtgcatgcttacattttgttgagatctgacaaacgggaagtaaaatttggtcataaaagtctaagttggagaatcatttattagtacagatactaaggaaaggttgtcaaccatgtcagatcacacagagagggagcaaatgtagttaaataaaaaacaacaaaactttatatttggcaattcttattaatatcctcctaggatgcagttttcattttaggagcaaggttcaaaatcaaattgtagggagtatacaatatatgctctatgagaaaaaaagactgtggtgtaaaacacattaaaaaggttgtcagtgaattgaaggagagaaatagggcttgaaaggaaagatggagctaagaagtttgccttgtgcatcaaatttggtgtagtacttgaccatcacccatgtgaacagtttgaaatttcaaagtggtaccacagcaacatagttctgatttagatacctagagtgacaagttttttattcatactttctctctttcctctcttttaaaaagatgtaatttgcatatagggttgtttctctttctagcactcaaagatcctttgagtaaggaataatggtttctataatagcactgccaaccacagaatatagtcagatgcataagtaaatatatcttgaaaaagaactttatccagcatggagagactttgtatgtgggaaagctgtgaaaaacatgggaagatgagacaatgtgtacaaagtgccatcaacactacctcactcatgatcggtcaatcttagtattccctcatgtctcctccactatcagatatttgagaagaaataattgaggaaaacgtttcagaacactctgaaaggaatggagagaaagggcaacagtacattttttaaagaaggatggatgaatgactctctgcttgcagggagggaagctaagccgatgttggagtagaggaggagctgaaggaatgcacggtgagtgccctcctgttggtaggaagagggcctggtggtgatgaaggtagcaatgtgggatattacagggaaggaacaacatttggagcatctttggatgagtgaagaaatgaaagacagatgtctaaatgcattgtctaacaacattgaggattcacatggatttagatagtatgaatgatgaggtctatatgattatgtgatttttataccttggaagctgggaatgaagaatagcatacagggtgtgtaatagaagggatttgcagggctgcaaggaaagatttggtggcgacatggcaatttccttaattgtttgaacagttcttttatggttaagtaattcttttaattctgttttatcataggacagaacttaggcactaaagagtctaagaaaggcaggttcctgcccagtcaaaagaaatcaccagtaattagagctatctaatcatagaatacactgtctttagagatagggagtttcctaacaagggaaggattcagagagaggctaggatgtgaagatggaaggtctgactgcgtgtcaactgaaaccttttttacacttaaggtgttaaatggttttgtactcagaacattgatggggtaaaaaaatctcatttataattaagagcagaataaatgtagtgactataagaaaccaggcgaggttagaatacatgtagtgactataagaatcaaggttaggttctacttgtacacagaatggagccaaggatctaagacaattggggaacatctatgccatagtttacgtccttttttctgcctctgtactagtgacatcaaggacagatcatatgagtaatatcccctcttgcttgctgtgatccttgaccagtctacctcatcagtacctttagtcaccatggtttttttaccctcatttaaaatttcatttgaaacaagtcattataattggcttctttaaaataaaaaaccaaggagtgttaaatttatttgtagactgtgcatgtgaaacattagaattctttatagatttctagtttttgcatgatttttaacccttggcatcaatcagtagatggattttttattttaagtgaaagccatagtattaataactaaatgtctcttccatgttttactaaaaaagtaattcctttctaccctttcttcccactttcatctccacttggtaatagaaagaacatagcagatttattagtttcactcatctcataaagataatgtcatcaaacatgttatgaacatagttcaggacaagagacaactatatgtattgattcctttctttgttccgtgctttacatatttagactataggctacaatcttggagaatcccagactcgacactttttttgttgctgtggcacattagtgcccagaaatttagtattgattactgtagtttctcttgcctcatctgaatgtgaaaggaatggcaaagtggcttcattcataatgttggccagttagctctttttgcttactgaggttgtacattggttttggagaatacggaataatcaggctcagagttactttcacattgtactgctaagatactgttgaattaaagtcacagtgttcatggaaaataatgtgtcagaaattactaagaagaatgtctgaaatgtgcacaggttgtgaagtgctggagagaaaaaaatgggtcagtgcattgattctcttggggtaagggtgaggaccacattctttaaggggtgataacaggagctctagttaaaacgtttctaaatatacacgacccacctcctgaggttctgctgtagctgtcacccctagggtttgttgttttcctttattctgcatgcatcactctgtgtactcactactagtagttacttttagggttattgtgaatattgttagatataagatgaattggtgcatatcctctgacgctgggagaccattgtaattgattggtcaggtattttatagcgaacttctatgtagaatataggattagataaagcctttgtatacggtaagctttcagaatttaaattaaaaatgaaaaagtcaatggagatttatgggaatatattgtaaggatgacagataatttcagtggtgagaaaaaggtcatctttgactatgtttcaaagtcataaagtggttcaatatgatattcctggtgtaagtgaattcaaggagtgttgtacagcagaggaaataggggagacatcctctgaataactgttatttcaagaggctgggtgtgtaggcagaattaaagaaggtagaagtggagagatggtttcaagaaaataacaaggtggtttcaatttgagagacattagatgaatcatgtaatgaggattttgggtggttatggacttgtagcaccaccagcagcatatgagctgatgtatggttagtaggactgaaaaaatgtcaaggaagaggaggaaaggagactcatggtatggaacagattaaggacttatttacagatgcagtgaaggaagacgtttgaaatgctccaattcttcaagttggtattcatgattaaaataattaagaagtcagttttgagaactaacagtaaaggaattgaccacctgactggtgttttgatgtgaagcagatttaaagggataaaatctgtatgatgggagatcaggaaggcagcagtggtgcattcatacacagccaacactcaagtatttatttgagtattgttctggggagccatggaggatatggtttttgtgttttaaggggatcatagtctgattggcacagggataacatcaaaggccaacccaaatagaagacagcaaatgttggtgtgtcaaatgaatgttagtgctgtttgaagtgtgaatcccagatcccaggccccaatccaaaccgactcttattattttcctatggctgcctacaaattaccacaaacgtaatgatttaaaatagcacacacttattatctcacagtctctgtgggacaggagtctgggacgctgagatggttcctctgcttcagggtctctcaccatgctgcagtcaaggtgttagccagctctgggttcacctgagaggctcaactgaggaagagtctgcttcttcttttttttttttttttttattatactttaagttttagggtacatgtgcacattgtgcaggttagttacatatgtatacatgtgccatgctggtgcgctgcacccactaactcgtcatctagcattaggtatatctcctaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgttggacagagtctgcttctaagctccagttgttggccaagttctttttcttgctgctccaggattcatgacaacttgcttcttcaaagccagcagtggggttggtgggaggggttctgctagcttcagagtcttgtatagtgtcatgtgacagcctatcatctttttcatattctgttggttaaaagcaagtcacagttccctcccacgccgaaggggagggaaacacacaaaagcgtggacagtaggaggtgaggatcatggggccaatgtaaagtcttgtctgtgacacctgctggatcagaatctacatttcagtgacattccttagacgattacattttaagaaactgttacagatggtaggtgccaaagaaggttgatttagagggagaagaaagttctttgggcttgacctggccaggtgaattgttttatggtcagcaaaataatttgttgtgtaaaagcttattcacatcagggaatttttggtattctttctccctgccacttctgcttgagtatagtgtttttcacttttgtagtgctgttgtactctctgagagagtttgtaatttcctaacttgggcttaagaaaaaaaaaattgttcctttcccttttactattccattttgatgataggggttggtgtaaactaatggacatgctctgccctaatagcagaacaatcttgggaaagacattgaactatcctttgcatcaattcttttatatgttaagttctgtcattcttctcttacagggctgttgtgtgtgaattgaatgagttgaagtaaaagttcttggtaaagtgtaaagcattatataatgttgtggtggacttgttttgttgtaatgccttattcacagagctgcccccttcctaccaatagtagtgtgtatccagaagtcatgattgttccttgattgtgtctaaccacagtccttcagagaaggcatggatggctgatccaaactgggtcacacagattctccatcttgggaatttggatttgggaccaaatgatgacagtttagtccttgctgacctaacgtaaagagattagaatccaaggaaattgtggtacagctgacttctactgtacgagtagcagagaatgttccttgcagaggacagagggaactcagatctgaagagagaaggaaagttatggagaaagagggcccactgctgggggcctgtctgcttttgatttcctgcttgcttttctgggtccttgcagcatttttgcctttaagttgtataacacataattctaaatctgtatattagtaataattttccctcttttgttcaagctattttgagttgttttctgttactttcaactagagagctgaaatgggagccaataagtgtgtacttaaaaatttttaaaaatctcctaactactcattcatttttcccccaatgcctacataatttgtttttaaaggccaattatattgcttcattcattgaatagtcattgagcattttttcaggatactttagaaataccaaaatgaagaatatgatccttgccctgaagcaattttttaatttactaagagaaatggacatttaaatgactacctataatactaggcagaagaaagaaataagaactatgtgcaattcatttgaggtaatttttatgttatgcccagtaacctgattgaaggtgattaaaaatttcatttttttgcaaagaactgagcccttttgtccctgattgatgataaggtcctgacatgcttttgggcccatcatttttgcttacgcctctgaacattgcaagtaggctgggcagtctggccatatatacctttcttcattaagtaggcagaggacaatacaatgagataggcaaaactgaaaacaaaacagaagtttaaatcggagatttttaaaaaactcgcttagtgaagttatttgatttcttgattaggtcatcctttagctctgggtgatttccatgtttaagcttggttttagaggttttgtcttccttatagcttgtatcatgtataaaaagggtacttatataccttatattatacaataaagagggtattgatattgcttgcattgcataataaaaagggtgcctaacataagagttctgtgtttcctatagtttgcattacataataaaatcagtgcttaaattagatgggagccagtgaaattatagtcaaactgcatgaagctgattttagaaccacattttcttaaaatggaggttatgtaggttacatgttttactggctcatggagctcttcaaaatgacccagttcagaatgacattcaacttagagctgattgaaatgggcattggtggaaaatcccttggggatttgtggagcaattaaaaataacctaggaatctaattctttttaataatagaaaaaaaatctgtagttagaattttagagaagtatgtgaaagttttatcttactacagaaattatgggaaatgcttactttttaaaaggagaaagggaaagaatctcatgttgaaaattgtcattaggtaaagtaatagaattaatggagcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgttgaacccgggaagcggagcttgcagtgagccgagattgcgccactgcagtccgcagtccagcctgggcgacagagcgagactccgtctccaaaaaaaaaaaaaaaaaaaaaaaaaatagaattaatggagcaatccaaaatgagctaaataagtttctttgtgagaattcttctagagattaattctagaattcttctagagacttcataatatatggtaaaactaatattgctgcttagatattctgtgtcgtcttttgtcctcactttaggtaagcaatatgtacgccatagcactctctatcttactttacatcactttgctcatttggtgattgtgtaggtgtgagtatgtgcatgtgtgtagacttttgtcagtttccttcctgctaaattttaagctcattgaaagtaagaaccatgtgattagcttattattattatgtaccctgtacctagtgctgttcttggacataatagtgagaggtgacaacgtgctagcagccctcggtcgctctctgtgcctcctcagccttggcatccgctctgggccctctttggggctggcagaggctgaagccggcttcctctgctcgtggggaggtgtggagggagaggcgcgggtaggggccagcgctgcgcgcaggccttgtggccggcacgggatctgggtgggcacgagctcggagggcccgcacttggcacagccagctggcgcctgctggacttgatagggggacgagctccctctgggctgcggagtgcctgggctaggtgccgcaaagtcctgtggcgagtgctagcgagaggtgaagccggctgggcttctgggacaggtggggacttggagaacttttctgtctagctacaggattgtaaatgcaccaatcagcactctgtcaaaatggaccagtcagctctctgtaaaatggaccaatcagctctctgtaaaatggaccaatcagtaggatgtgggtggggccagattagggaataaaagcaggccacccgagccaacagcaacctggtggggtcaccttccacgctctggtagctttctctttgtaataaattttgctgctgctcactctttgggtgcctgccgcctttatgagctgtaacactcttatgagctgtaacactcactgtgaagttgtgcaccttcactcctgaggccagcgagaccacgaacccaccagaaggaatgaacaactccagacgcgccgcctttaagagctgtaacactcaccgcgaaggtctgcagcctcactctgaagtcagcgagaccacgaacccaccaagaaactccggacacatctgaacatctgaagcaacaaactccggacacaccatctttaagaactgtaacactcaccgtgagggtccgtggcttcattcttgaagtcagcaagaccaagaacccaccaattccaacacaataggtgtttagtaactactcaatgaataaatgaatatttctcataaccttgtaccctacaagcgttactcataaaaagatatgccgggaatatttagaggtaacattatttttattgtcagaatattgtatattcgatgtgaggtttagcactatgaatagagtcagtaaataatccataaaaatgtgatcagcttgactcttgtttcttatattctctcagagagaagctaaacttaagagagagggagatcaatagatgagacatttaaaatgtttagcctgtgacttggtaaatgactaccaaaattctctggaggcaaagcctgtataaactaggttggctagcacacagaaaatgttaggggagttcccaaagcttcagactaagttagtgatggcaaccagttcagtgaggaaacaacagtattttcctagggccagagctcaggatggggagacactgccatggtaccctatgagggaaggcatggactccatgaactgcagttacggtgggcagggacaggaacttcaaagacagtgagctgagcagccatggaagcttcaggggatagggagatgttggtagggagttgctttttcaagggaggacagaatttagaagtcggtagtctggggaatgtaaaccaaaaataaaattctaaggcccccaagtcatttgaatggacttcctcctcagccaagacactttttttgttcgtttgtttgagatggagtctcgctctgtcacctaggctggagtgcaatggcgcaatcttggctcactgcaacctctgcctaccggttcaagcgattctgctgtctcagtctcctgagtagctgggattacaagtgcacactgccacgtctggctaattttttgtgttttagtagagacggggtatcaccatgttgcccaggctggtctcgaactcctaagctcaggcaatccacccgcctcagcctcccaaagtgctgggattacaggcgtgagccaccacgtctggctcaagacactcttatcatttaatctgaaagactggctcaggtcatgacgggaacatggggagttggacatgccccattatacctctccagcattaacatcaacacagactttaagtctgaggagaaacattttacaccttattctctctcaggcctacaacctgaaggcttcctctgcaaataggaactttgatctccacagttctttctcctaaccccgccattcatttctattgatcccaggtctttagataaactcaaccaattgtcaaccagaaaaaatttaaatctacctataatctggaagaccctgctttgaggtgtcccacctttctggaccaaaccgttatatttcctaaatgtatttgattgacgtctgatgcctccctgaaatgtgtaaaaccaaactgcacctcgaccaccttgggcacgtgttctcaggatctcatgagggttgtgccattggccatggtcactaatatttggctcagaatatatctcttcaactgttttacagagtttgactctttttgtctacaggaaggagatgatcagcacccacttcccgtagatgttttctgtttctggtaatgatgtttttggtgttagggaattcagccttggctattctatgttcattttaaggttggtaacatcatgccccagttaggggttatgtgtctgtaattgccacaggagcagccctgtgtgttatgcctgcagctggctctgaatctgttaaggaaagagcaagtaaatattttcttacaaatataaaaggaagagttaaacacttattgtttggaaaccaagctgatgagcatattatattgtctgaggccccagaaataagcaaattaattacatgcaaataacttgctcatgaagtgtgggataataatagtatctgtttggatgtttatggcaaatttatttacatggctcaattttctgctaattttcctgtggaaaataataaatattggttccttttgcctttcttttagaaatacatcattgaaattatgaaaactgttaccatgtcttgctatctttgctttgccaagggcaattttaaagacagtatttgtaaatacatggtgaagaaagaactattaatgtatgtaggttctttctgctgtaaacagatggttgtcatcaccaacatcattaaataatacagaggttattattgaatattaacattcagtagttcagttgacttcctgttgatctttttcatgaacatcttttgatgtcagcttcttgctgagcttcagacatttcctctcttaaggtataacagggaattgagcagtttatattgacagtgtgatccatggtctctgtctttttcattaatgagtaattggattcacattgaaaagatggctctaagctctgcctagtgctccatacactctaaaggaaccttagcatccaatgtgactctcctgatgctcccatatgtgtggtttttttttgtttttgaggtatatcaaaggtgattcgatgagttgttttatttttttcaagataatcatttttttgcagttcattaacttggattgtatgtcaggcgcctcataagctaggggatgagtgtgggattgagtctttagttgggatgaggagtatttgtttttgtatccaactttataggctgtgctgctcgactcccagcctttctcagtagggtgatccacagctctactaggttactattttatttgtttgctgtctgtatgctaaggctcaggcattgacatcacctctatacgttttcatcaacaactctgacattttgacatgacaaccttgaaactattatcttatggaatgccagacacatgatctgttgttcataaagcagtaagtagaatggaaatggatttttcttttaatttttggtagagcaggaattttaacctccagtcagaaaggaaaacagagcagtttgtatcttggattagcttttatcagctactctgcaccctcatttttgccatctacaagtgcgttggggtgcagggagatgtggggttggcacaggaaggttgagccacccaactctgtactctgtaaattaatatcttgcttttgcatgaactctctttgccggttttctccatcaattgccgtggtagagatgaggctggtggccaaatattttcttcttgtatttccagtgggtaagggggtggtaccacacacactttgggtattccattgttcttcctttcagtttgaggttcccatgtagaaaaattacactgtgttttgataatctgattaacagaagggaaaaaatcaattggtagattttgaagagagaatcaatttccttattacagaaaaagatgagagacataactaccttgtgtttgcaaattatttgcttcagtctgtgatgctttcaagagtttgagaaatagggtatttaacttctcaacttatgcctgataggatcacggtaaaagtgctccagcctaatggaagcttaaaaatgcagctcttagaattgctggatcacacttgacagtgatttgtatgtctacggcttattaaacctcagcatagagaatgtcctgatttaaaatttttcaattttattcacttggtctgatgtgaggagcagccatccttcctgttgtcttgtgtagtcgaatgtaaatttctcagccacagttaaatttctggtcaaggccaaccacactgagcgttaaggagttctttctcccttggacttctcaatcagagaattgctaacatttcacctttgactttgttctctattgacatctaaatgccatttgttattccagtagccataagcatttgccatcaagcagagcacatgccttagagtgatcaggaagaagcaatgtcagaacaaatggtaatcactctgtgctaatattctattctgttctattctgttctgttctgctctattctattcttattttattataatccttggagcatatccagctttggctagttatgcacagactcaatgcttagaaatttgctgttgtagaatttgtaaatcaggaaacggattcaataattgtggcttgaagacttgtttagtataatattcgggttccttcagttatattctacatcagtgtgttttctggtatgccacttgctttcttttatgccacaaacatctgttgctgcttattgtagatgttagattttgagccagggtataccaggacttactaaagttaattttggtaaaattgcctgcagtaagtatcatcatttttcttaaatttttttcttttgtgttttgtttttccctttttctctgatcagaagttaccttatgaatgttatacatatgtgtagattagaaaattcttataatgagtcagaagttgactataggaggattgtggaaatattgatgccttggaaaggctgaagttgcagggaaagtattaagcaagagaggcgtggtttgagaatagggattgaggtgattgacagcacgggttggaagaacaatgatgaaggagaagtagtgaggatattgatttagtaagtgaaagggcactgaaagaacgaagtcttagaatattagagaaagaattgatggaaacatgacttttaatttttttttgaatcaatcttgatgtttattttggatctaaaataaggaaccaagtataagactgctttgaaatcataatctgaacattattttaaacatttcactagcaaatcatctgctttctgtttcactatgccgttttctaactttgctaagaaattgattctgttacgtattaggacctaaattttttccataatttttaattttttaaaattaaaagcattgcgatataattcacatataagtcaccattttaaagaatataactcaataggttttagtatattcacagggttttgcaactatcaccactgtctaattccagaacatgttcgtcactccaggaagaaaactggcctttagcaatcactcaccattagcagtcactcccattcctgcttctcttcagcctttggcagtcaccagtctactttctgtctctgtagatttgtctattctggacatttcatgtaaatagaatcatacagtatgtggcctttctgactagcttctttcatttagcataatgttttcaaggttcatccatgttatagcatggcagtacctaatttctttttattgcttaatcatgagacaggagaattcccttgaccccctcatgggacttgtgatgggggtgtggcccacttactgggctgctgctgagctcacacctcttgtggaatggggaacacacaggcaaacgggtgccagggctgggacaaacgcttttgggctccagccccatggcagtgtctaggggtgtgttaaaattaatgctcttttagcagttgccatctctggacagcctcttacaccctgccctcttggtacctgagtttttgtctagcatccaggaagaatcaggtcacatggacttgaaggatgtggagattttattgagtgatggaagtggctgtcagcgggatggggagctggaaaggagatggagtggaaagaggatcttccctcatctccaaccgtccccagctgaactcctttcgacattcagttgcttcttctcttttctccttctctgctgcaatgctctgttcctctgccaatggagtttggggtttttgtgggtacaagatgtggggcatggcgggccagggtggttttggaaaaagcaacatttgagcgggaaaacgggataactcttctcatttagggctgtggtttccaggcttgcgggtggggcctttgctggggaactgccctcttctatctaatatttccctgcttctggtccatatcaataatattccattatatggacattttgtttatccattcatcagttggtggacatctgggttgattccatattttggttcttattaataatgctgctataaaaatttgtatgcaagtctttctgtgaatatttgtttacaattttactatacctaggaatggaattgttggatcatatagtaactttgtgtttaactttttgaggaactgccaaactgttttccaaattagctgtaccattttatattccaccacgcatattgggcatattatttgaaatgtaactgatttactaagaaaaaatagttttaccctttctatcttgccttttggacatcatctatactggaatgagttactgtctgatactttgaaaggccataaaattgtagagcttgagaggttctaatgaatccatctttctactggaatggaaaatccctgaagtttaggcaccttgtccattttgttcacttctgtatccactccacctgtgtcagcactgtaaatactaggtgcttagcaaattttactgaataatgaatctaatccaacccgtttgtttcgtaatgagaaaagtgatgcccagagatgtcaggtaactttctaaaggtcactaagggatttaatggtagaacaaggactagaattctggtcctgatttccttgccaaattcttgccttcaaagtcatcttgaattcactgttcttcctgaacttcatggtccattgctgacctgatacagaattttctgacagttttatagctgtgctttgggggtttattgacatttaatgagtgtttttgttcttgtgaagtcatttacatgtttactgctgaggctagcattcataacaagaaaaaaacatttaaataactgcattttacccagggaagataaattacagttgcctatcaataagtagataactttcattgctgccaagattattagattgtggaaggcaataaatttgtaccctcccttgtgagtcacttgccttaaaaaattcacaactaattatctgaaagtgagacaggttagtacaggtttgctatctactagtattcctttctttcctaatcactcttgcagatggaggaatccattttatcagcctttcctccttattctgctcttccagagtaatatatgtgtaaattaaatgtagcatagcttaagtaagcatagattaccctgtatctgaggcgttgtttttagagccacatttgcatgttaagtggagttgtgtgccatgagggataggtttatagaccggacccgtaatgaagttgagaatcattgtgcaaaagctgcagactacaggtagacattgagagcctttgaatgtggagagcgtatatttcacttccttttgacaaagactttattttataaggctttatgggaaacagtgtgttcaattacctcagttaaaactcattccagggagcagactattaaaatactacttgaaagtactgagatttccccctttttgtaacttttgatcaactgattgatacctggtatttaaaataacatgtttaaaaaagattcctgaattttgttgtatctgtgagagataccctagggaggatcataagtctactatgatcataattgtgttcctggtctagtctatccctttaatgttgggagttgagaatgggagaatataaaagaattcttttggttcaggtaaaaaagacatttttagaaagttagcatgggatagtgaggaaaaaaaaacaaaacaggcttttatttagaagatttgtgttcaaattctggctctacatctaattagttatataactttattaactttaccaaggctcactttactcatttgtaaaatgtggatgataataataaattcctaccttacaacacagctttgtatttggtgagctaatgtatgggacatatagtaggcatttaatagctgatagtgaaatctgaacctggggttcattggaccttcttaagaaaattttggtagatagatatataaatataagtatcatgtttatgtaatatatgtattcctctcccccctttatatctgcatcccatgtcttgtttccagtaggatttaactggtatgtggttgataagttaacttttaaatgtatgtaatagccagagccttttaaagttatcttaaaatgttcactgtaaagcttcgttaatagctgctgtaaatctgtttgtcaagtgctttccactctcttccagtttctgctaatgctactactattgcttactacattatccaagttggaaaccttggtatgatctttcctgctttctcttttctttgtaattctgctgtctagcaggctatttctatgcaaaactaatactgcataaaatattgtcaatgccaatgtaaggtagacagcttagcaagtacatggacttgaaacaccagagtatgctaagcagcactctatagctgtaatgtattaccctttgtcaacagatttctgagacatcaatgaaactcctaatcatgtccgtttatacgatataataccaattttacagtttttttctgcttaattctcattcttattttcgaatggtagtagtatcaatggcagacttctgtaaaactaggactgacatacttagatgatgagatcttgttattccataagcggtaggataccagatgtggtaaacaaataacctctagcagcctgaatggaaggatgtggtaggttggattattgttcagcaaatattcattccctaacctaccccactcccaatagccccccacccaacctatgagagcagtctgtttcgtcatccaattgctattggacttggtcgtgtgacttgatataaccaatggaatgttagcaaatatgccactagcaaaggcttgaaatatgcttgtgcagttggacttggtctttgcacttctattgtttgccgtgagaagaacatgcttctagtagctgctaattcaagaaggatgaaaagcactggctctggacctgatctgcagcttggtaccaagcccagtgtagtccagcctacagccaagtcccagataatgagcatatatgtgagcaaggaagatatacttgttgtatgctgctgaattttgaggtggtttgttactcagtattgtggcggtagctgacaaatacagaaggatactcatttcttttaaagaccttctttaggcactgttttggaagctgcagctttccatgtagcatcaagaactttattgttcaatggcacctattttaatgccagttttgtctctggttactggcaaaactgttcaggattgaaagctcactttaaagaaatgcttacaattcagatgggaagaagagtgctggttgaccctggctatctccacaaacctgtctgtacttggaagttgtttctaggaaaatataatggccagtggctcctttttttgttgttggatcagctagttgtatgtccttagtggtacaaagggcagtgaatacacaaagatagtatctttaattatggaaggagcctattaaaattccattttatcttaagaaataaacatgtaaaggaatctggaggaggccaaacacctctttaaaataatgattgtcttgggctaattcctttactgtgccttcagcatcattagatgccaatcctactgtgtaggttcatttgcaaacaaaactgattagagactggaggctgtgtgcatgagacctccctaaagcagaggtttcagaaacctgcacattgtttaaactggttaccctcagcactacttttatttattttctctctacatgggggggaaaaagaaggttgtttatttcaaagggtattagaacccattcttcaaaagagaataccgaaaaagagaaaaaaagatattgtgtaaaagctcagaaggttttcagaatttcccttttttgcccattgtaaacatgatctttccctttgctctgagctcccccctctggcattaatggtatatttctctttctgttactacaaacttcaaagctcccctccaagtcattttgcaaactgtaaagtaatggtgggggctgcttttatttcccagagtttgtggtgggggtggactgagaaatgtagaggaactgttggcaacatttattaacttttaatttggtgcagaaaaaatcggaaaccaagtaccatacaccattgatgttgcttcaaagatactttgagcttgtttaaccaattttttaaagcttgtgtgccggactgaaatgaggtgccttttatacagacctcaggattgtgctgtcataatagataaatccatatgtctctttgtttttgtaattaaagctttatccttcctcttttttgtcttcaatggctatctttgttctgatagagaccgattgctttattgtaagtaaactcctaactattgtgtgatattctctttaaaaagaagactggtgatgcctaatttatttagcaccatctaggaatctgattttcagtgtggcttaattttccagaaaatagtctctccccttttagcattaaagattgtattttaacatctttaatggaaattttataaaatacatttctcagatttggtccttttgtcacaatatactgagcacattcagactttttctggtgactgaaggactgtcattttgaacctggttaatcgatgctttggttgcacttttgcacactaccctttattgaatgtattgtgatacgtcagaggtcatcttgtcacatgtgaaggcacggacaacgttccatcgtgctgaaccagtcccagacttccattaaaaaaaaaatcatacttgttcactcttcataccctctgtcttttttttccttgctttttgggggtaggttatcatgtctagctattgatcgtgtctgtttcagacaagctcctcttgctaagttgctcaactattgtggtataagctgcaaaggcagagaaccaaggtggttagaattgtgtgtagaataagcgaccagaaagcactctgtggcatcatgcacatgaattctcagctatggattgtataacataaggacattttgcccctggaaatgtcccttttttcttaattctctcttccttagtttctgctattcttagtggtccaggctgccaggtaaattaggtattcttctgttaacaatggcagtcaaatgatacctaaaacacctttattgtagaattctctatcctagtcccatccatctgtatttgtgttacttaagttttagctattccatgaagatccatttctgggaaaaatgctccgttatctagtgatctgttaatttctagaagtatctaggttgagggtaaagtttttgccgtttattttgccacctagattgtgctgaatggataagtgaatgaatatgtttcttttgatactgaagcaagtgggttttttcttttattttttgtgattaaatatttggttagtttcttttttcctcttaatttgttcttacttgtcctttattccttagagccacataaggaagggcagggggaaagaatttgaattatctcagtgtttttttttttttgtttttttaaaggagatagaatttgctcttgctattcatttcaagaaattggtgatcttgcatcagccggcttgtttttgaaagatgtttttcttggcatccatgcaaactaacgatatgaactgtatcaaacccagagtggcgtgggccttccttgtactgccttctgacttcttcagctgctatgtctgtacttgccctcctatgtgccctgagctctgccctctgactgagaagatctagaatttgactgtcctctttaggccagagctatcattactcatataaatgatattctttttgagatagctttctcctttcctcttcatttggcatcaaaactaataaatgatgaaactaacttcctttccagtaattagaacctttctctttttctcttttttgtctctcttttcctgagtgaaggcagtgtggtgttaaaaaaaaaaaaaaccctaatattatccatatcttatgggatactctactggcataatacttctttactaaagcctagaaccatagacttcagttttggggacctgatcaaagaaataagacagacctatgaaataatcagcctctttaagtatcatcacatacccttcgtgtgtacgagccagtggctttcaatttgatttaatcagtgtatggttattaatgtgcactatatggaatgcactgtgttctatgcaaaaaaactccaaaaatgaaatcttcataccctccccctttattttagcttgtaggaaatgcatttcttctgttttgcttgtgtggataattactttagagtaacttatgatcttttcccatgagcttagtgtcaatttcctggaggcatataattttatataaatttacctgtttgccctgtctataaattgaggatgaactgataaaaaaaaaatacatctgagtgactatggatgggtttgtgtgggagtgtgtgaggatgggagaaacttccatgattcattaagatatattatggtcatagtaaaggctcattttaaaattttttgatttctttttaaattttgcgtgttatccaaacatgttagaggatttcattttaaagaaagtactgaaaatatttgcccaaattaatatttgtgttctactttttttctcttatagtttctcaaatttactatatttgtgttactagagtttttagatttttattctgattatggcttatgattatccaccagatgtttaagtattttaccttttgctattatttatgagagaaaaaaatggactgtaagctccctgtggtacaattttctgttcagaagaaatggaaaagtttggtggcattcattttctagctcatggtcttttcccattttcgattatctggtgatcacttactatttgctctaaacttcagactaatgctggacaatgaagaagaatgcctgtgacctcatggagctcacatctggatgggaaaacagtgctattggtttcaccactaaaattttccgtaatatttctttgttaccattttaagatcgataggatattttattatctaatcttttttccacttcacatcttttatttccccgtttttctgtgatgtttccatactgattgtaaatgactccacaagtgtgtgcatgaattcccttaagctcctctgcttcccatcatccaggcctgctgattggtatgagttcagtattgtcaagtgttccccatctgctttttgtcagtcgctatttttgcaaagtcttccttctctctaattatacaaatatgtctttttcatttttcttgtcaaagacaaattaaaaagaattagttcagtttcttagctagtttagtcttcattaattccaaaccccactccatttttagcaccatttttcttttcctagtctttgtcccgctttttggtaattttaaaagctcctcttctcttgtctgacttatttaagtagcatgaattaatttgctacctctgactcttttctataagttttagctaactctaacaagatactttttcactcttctccatatttagttcagatctgtctttgtctgtagatctttgaagagtcatttgtgaaactacattaggtgtttcttgttcattatcattttccccaagaggaattttaatcctatgtgtgttaattatttaattatcctaatgatgtctcatatggtacccctggcctcttgcacactgatggaattaatcccttatcccagggctcctcagagttcctgattctttaatgtttgtacatttatatttaaatagttcttatattagtttttaagtaactttcccctggtttttccttgccatcttgattttgtctcttatttctctaatgccctatgttctttcgatttaaatattatgacattagtttcttcctttctgttgcctccaatgggggttgttattatctaatatactctggtttcaagctttaatagccatgagaatcgtctggaatgcttgttaaaagtccagatttctgagtcttagcccagaaattctaattcatttggtttgtgaagagcctagatatgaagagccaaacatcccaagttttaatgaggtggtctactgaggcagtccactatgactaccacctgctaactgccatcctttatcttaaacgcagcagccagatttttcatctcagaacatttataaaatgcctgctctctgtaaggcactgtgttgggcactcagaatatcacagtgagcaaactggacattgttcctgatcttgcagtgcttatagtatgttgaattgttttccttatctcaaaaacttgattacctgttgcttacagatgacagtaggtcagttcattagtatattttgctgaggtgctgatagaacataagaacaatgactgggaatcaggaaatttgacttacaggtttggttttacttctgcctctgtacacgtgtgtgtttgcctatgtatgtatatgtatgtgtgtgtttcacttgtaaaatgaaggagattgggttggattaccactgttcctttcagtcagtatttgaacctcggttttggtttccatcttcaagatgttatagttgtttaaaggaaatataccatatttcatcagttctttttttttttttttttttttgagatggagtctcgctgtctcgccaggctggagtgcagtggggcgatctcggcttactgcaacctccgcctcctgggttcaagtaattctcctgcctcagcctcccaagtagctgggattacaggcccccgccaccacgcccagctaatttttgtatttttagtagagacggggtttcatcatgttggccaggatggtctggatctcttgacttcatgatctgcctgtctcagcctcccaaagtgctggggctacaggtgtgagccaccgcacccagcccatatttcatcagttctaatgtatcatcacttatcagacccctcccaacttcagagatgttaaaatgtgaaataatatgtatcatatatccatgaagtatagtgtacgtatttatgtgtgagtgtgtttgtatttgtgaggataatgataccacacaaagctaccttctgactactgacacatggttacttgggaccaaaaaagctgtatcactggtctgacactcctgaaagactcaggatttattaagaaacataaagcctgtaacacaaaagaagcaaagatgtaggaggagattatcagtctctcagcccagatgacccttcccatgttttccctggacctgcctcactgttgaattgtgtaatgtgtagagattcctaacaatgaagccatcagggagactataactcattgggtaactcttccatctatcactcagctctgacatctccaagaaaccaaactcagatgagcacattgcttattgtgagttatagcttctttattttttactttttaattcaatatattcatttaaaggcattaaaaaaataaatttagtgattacattgaataatcacttactggcaaccctctcccacccccacagggacacacagtttaaccatttctgagtcaaggccttgcataggtaacattaactactgtttacactcttcaggaagttgtcatagttcttgaacactacaatggctttcttatttctcttcatgttttcactggatctgagtcttcctgggagggacagtgacttattcagggattcagaggaaagtaaggtactggaatcaattctgcatttttgtaaaagctctcattctgttatttttcccacctttatctccacccccacccccccattacctattcaattctgtcttccttccaagtacttttagccttagaattaacttctcatgctacagttggtcatcagtgttcatgatgtgactggaaatgtcagagacatttgaaccagagcaactccatcttgggtaagggctgggtaaaataaggctcagacttactgggctgcatttccaggtggttttaagtcacaggatgtgatcagaggtcagcacaagatacaggtcataaagaccttgttgataaaataggttgcagtaaagaagctgggcaaacccactaaaaccaagatggcaatgggagtgacctctggtggtcctcactgctacactcccaccagcaatgtgacagtttacaaatgccatggcaatgcattctaacttccatagaggaagttaccctatgtggaagttaccctaaaaaggggagagatgaataatctaccccttgtttagcatataatcaagaaataaccatggaagtgggtagctatcagcccttggggcagctctgtggagtagccattctttttattcctttactttcttaataaaacttgctttcactttactctgtggactcaccctgaattatttcttgtgtgagatccaagaaccctctcttggatgtggatcaggacccctttctggtaacagaaatattttagtactattgggagattttggctgaggtcttctatttcagaagttttaacatcaatagccagtggcaaatgctaaataaatgatacagactgtaagtaccaggggagttacaggaaagtagagatcactgagttgttggaaaatgcttcaagacgggagagatatttacagcaagtaagatttggagaagtagtaccagaaagagagttaggaaggtacacggaatatgtggaaggaaggaatgtaatgaagggactagcagaaggtaggttgggactggctcatagagggcctagaaattccatctgaagattttcagttgcatattttatggagcaagggtttctaattgtctttttgccttgtttttgagacatagtctcactctgtcacccagtctggagagcagtggtgcagtctcggcttactgcagtctctgtctcccaggttcaagtgattctcatgcctcagcctcccgagtacctgggattacagatgtgtgccaccatgcctggctaatttttgtatttttttctgtagagatgtggtttcaccatgtggccaggctggtcttgagctcctggcatcaagcaattcacccacctcggcctcccaaagtgctgggattacaggcatgagccaatgtgtgccaccgtgctccgcctctagttatcttgaagaggcatttatcacttcctctaaggttccagtcatcttctaagatatatggcttgcaaatgatacagtggggctaattttgactcacactgttaagcctgtgtgtttgtgtgtggggggtgtgtgtgtgtatgtgtgcatgcacatacacgcacacatacctatgtaaatacaacatccctgctggtgcttattcctgagatgggattccttgagcagagttggggacagtgcattgctgctggctgggttctcctccagtgaacaatcctggaagactgtgaaatgaaattctgaccacttggtcattcagatctaccagtaactaatgattgacccacttacaaggcttgccataaacaatggcaaaccattagaggttttttggttagcttatttttttgtgtattatgtttgttttcatgtatgttttttaatacctgccattgatggtttgaaattattgttttagaaaggatatactgggcatagctggtgaattggaggtgataaaaacttaagtcaaattaaaaagacccttttgaaagcctagcgtgaagtgaggggaacagaataaggacaatgagaatagaaagaggtggttattagacagtagaaaggatgaattacagaatgattggtgggataatttattcatttattaaacatttattgaaatttattacactgtggagatttaaagctgaaaaagttggactccacttcagagagcccccaagagcgggcagtctgacaagttaagtagtgatggtatgctgtgcttaaggatgaagcaggctgaaacaccctcgaggcatgaagtgatgcctcaggctagtggggatggggaatggacaagagaagagcttgtggggtggtatttgagcctatttataagcaaaaagaaagaacctagtagagaaaaagagatttacatatgatctgggagagagaagggatgattaataaagtgagttatggaggaggtgggagtagatggattttgaccacaaggagaagggatttgaaggaatcgaagatttgctggatactgaagaaaggaatgaatcaaagatgaccaaggaatcagttttgtgtgttttgtgtgactgaaagaatggtggtcccatttgtaataaagagaagatgaatctgtttttaaatacatttgagtttgagataatgggagtccaataggaggcttgtactgaaggttgataaggttgacctgtgaaagatgagggtgaacaccattgattacagaggagtgtaatgacaatgtaatctacaatacaaagtgcctctctgcaggacttgggtgtttgtgaagtagtggagtgagaagccccagttgctgtgacgggagccagggagtgagatttacaacagtttatttccctgtaggggtggtgttatagctgctttttcttcacatcttcttccgtagtcgcatttgtccaggatctcaggcacaggcatggttgtggaggctagacctcacatgggtaatagaagcactatcagacacagaaatgtccttttcaaggctggggttgggttccgaggagaccctagcaggagaggcccagggcaaggggaaagatgaacagttgacacacctgcctcttggtaaagtctcttgcgcagtacagaatgtgggcccatctctgctttctccaccagagagcaactggatagccttggatggagtcagaaatcagcctgtagatctgtgaaatgcctaatagttgtccctgagtctattgtcacttcagtctggtggtagaaactcaaataccaaaaactcctcagtgaccttccccatggtcaagcaccagggtgtagaatccagcagatgctttgggtgagtgtttgtctctgcagctctacagattcacttccatgcaggttgtcttgacctcctgggggcatcagtgggtggtgtgagtggcctttatcaaaggttctcccattttcctggctgtgatgaggagtcagaattagttacagtatctaaggaccccagagctccatctttctctctcaaagttatattcccagaaaggtcatttgggaaacaccccctctcaaaggggcatgtagtgcttaagtgttggcttctatacacaaaaagctcaaactgtataagaagcacctgtgttggaagatgatgcccagatgaggaaagcttggagtgtggcctttattttggccattatgccaggcaggaccagggacaactgacagaccgcaggaactatgtagttcagggaattaggagcatttcctattctcttgggtcaggagacctgtgtgtactgatatcctggcccaaaaggtatgctgaaaaccaggtcctcataagagtggagtgtagctcactttctgattgtgcatagccatgggttcagtctgagtgtttcttcaggagaagccaaattataaagtcagcctagctgaccagaggaatttcagtccaaaggggcaagagagattctgaatgagagccagcagaatggaccaaggagaccagcaaatgaagaatcagagcacagggtagcaagtggggcttggcgttttctccaggctctttattcttcctgaatctccctccttccatatgcatcaatttggacatatacttagctaggtggagactaacatttattgaggattgactttgtaacaggtaacgttttatgtgttggggccacagcagtgaacaagatagaacaagatagacagtcttacaaccccctgcttcctgccccacggagcttatgtcttagtgggcatgtggagacggtaaactacacacatagggtaattccttactgatgacttcctatgaaaaagatacaattagagaaacagcactgtagggtgtgatttgttctggaggtgttaaagctagggtggtcagcaagccttctttgaagagatggcatttgggttgagtcctgagtgaggagaagaagagtgccacattaagattgagggaacggagaagaaaattgggtcttgtattttggctatgttaaatgtgggatgcctgtgggacatgagatcatgagcaggttggtcggtggtgtcagcttgtcggtgttcaggtcagaggtctgggatgacagattgcagggccttaccagatagattgtattttaaagtcacaggactggatgagatggcgttttcacacttttttggagctctttttaatcatgtatatttgcctagagattaacaacacgtaagattcttattttaaatagaacagattttttgttgaatgaggcagaactttgggggcatgaatatgattttgtgtgtgtatgtttttttcatgtttctggaccgtatgtgtactgattgacaagttcctcctgtcatgtacttgatggctaaaagacagcaattctcaaagttttcagcttctatcctgacaaattgaaaattttctgaactcattatagaatctactcaagtgtacatatgcagtcataggtttctgatcttcagatttattaagagtccctgaaatctttcttagtaaatattgtatttgaaagagatggctggaacgtgtgtcaagtgctttatagttaacacacatctgaggttccaaaacctgtgtgaggtaggaagatgttgtactctttcctttgcagttgtgtagggtaggactttggaatataaaatgactctgacgggaaaacacaactcaaaattgttaggaccaatcttagaatccaaggctttgattcatatgccagcgtctttccactacttcagtggttctcagccttggccccatgttagattcatcttgggaagttacaaaataaaataaaacaaaaagcccagcaattgtgcttccacctcagaggcctggacagttactacaaacaaacaaacaaacaaacaaacaaataaatcaacctctcctggtaattctaatgtgcagcagtagctgtgagtctctgccctattccacattgccttaccaggagctgcgttatctggtgtgttgttaccctgtaatcccagcagtttggaaggcggaggtgggaggattgcttgagcccaggagtttaagaacagcctgggcaacatagcaagaccccatctctacaaaaaatacacagaaaaattagccaggcatggtggcgcatgcctgcagtcccagctactcaaaagtctgaggtgggagactcaactgagcccagaaggtcgagattgtagtgagccgagattataatactgcacttcagcctgggtgacagaacggaaccctgtcttaaaaaaaaaaaaaaaagatgactgagccaaccaggatacttctaatgaccttgttaaggaagatctcttttctttctttaagtctcaagcagagtccttcctctttcttgtgactgtttctctttctggttgtgagtttgcaggtatcccacattctttctctggtatcagtattctctgtgcttgtacatgagaccagtgaagctggactaacccctttatttccacagcctaatttaattacaaccaaaacctctcaataaaactgttttcttatttacgagggagactttattccattttttggattgagagagatgctttttatttttcgccctactctgtgctgtaaaattatctctggagatttaattgtgtttttgaatggttattcctagtttttaacgcagggctgtctgtaaaatgaagatagcttcttctctagtttgctcactgttagctagtgaaaacatgccagcttataacttggcaagattactctgagctactcagggcacggtcctcagtccagcgacctgtctgctcactattacccgtccttgatgaaataagtacagaaatcgagatgaagccattagaaactcctagtgatttggaaaacgtaactttagattttgttcatctttgtctttttaaaaaatatacttttaatgttttataaagtatcaaaaactgataatcctcataggtaatttcagaagccatggactggatctctgaatccagtagtcactgagaggactaataactaccgctgcttttttcacgagtagaaataatattcttgatttgcaactattttgaggatgtagggtaacacagtgtaagtggtaaatttcaagttctggcactgggcattagcctagagcttagctttaatctacaatatgcatttctcaacctgcttctgatactttgccacctgtcctctctaggctgcagtttacatttacagatgtttctataaacctttgaagactcaggaacattttggttggtttttaaccataagtgaaataataaaggggatagatttcagtttgctttggcagctttagttttcagttttgagtgattctgaccaagtcaactccacagttcatcattttatagtcacttgtattttggctgtacaccagtatgttctataaaatacatcattttctaaagtacattgaggcatgaaaacatcagtgttaatccttttctgttacacattgttttaggcaatcaaagacttctgcttgctttttcctaactaggatatatagatcttcttacatatgagaaatgaacattgcttcactctcttgtcttctgtagagtctaccaggcaagtgctccactctgtttttgtatattattattcttactgtaagaataatgcatgcttattatagaaaatttggaaaatacagaaaaatgaaagaggagatttaacttttttatattcctagtacttagagagttcacatttttatgtatttccttcttcaaattttgcttcattaaaaattataaaattttcaacatattgggagtacaaaattctatgtgcttatttaaataagcttttttctgtttatcaataaatgtagatatgtatattataaaaatattaagaaaatagagaaaacttataaagaagatttaaaaatcacccagaatcctttatcccagggataatttttaaccttcatttatatttacttactttttttattggattcatatcataattatttttaagtgtacctaatacaggcattgtcacaggttatggatgagagaagagttaataaaaaaactaatgactcaagtcattcagtttgagtttcaaagatgtgaaaaattatttctgaagttcctaagcaaaaaatgtctattatgttgtgatatgtaattcttccctttagagagaaagatgtactttttatttagtagttgtcatggaatattgtcccaaatgtgtttaaaatagttgagccactattagtaaagaaagaacaacactgctgttgtcttgggtgttcaactaaaatattgtgactgtgggttaaaaagtggctctaggtgagggacagagcaggaaaaagcacagtgtagtgaagcatttctgggtctccttttgcccttgggctgtggagtgtgccccactgcactcagtctagttagataactaatactggagctgggaaaccccaccagtcctatatattgtgacttccttatgctttgaattctaatttttactcattcttcatatgtcttttttttttgagacatggtcttgctctgtcacccagactggaatacagtggtgcgatcatggcttactgcagccttgacctcctgggcttaagcaatcctctcacctcagctaccttagcagctaggaccacagacacacaccaccatgcctgtctaatttttaattaatttatttatttttgtagagacagggtctcactatgttgcccaggctggtctcaaactcctggcctcaagtgatcttgccacttcacccatccccaagtgctgtggttataggcatgaggcaccatgcccaacctagagcaggtcttaagcctctttcctccgcttatggtggatagagttgtatcaccccaaaagttatgttcaaatcctggcgtctggtatatgtgaatgtgacctcatttagagatagggtctttgcagatgcagtcaaattaaggtgaggtcatactgaattaaattgggtcccaatctaatgattagtgaccttataggaagatggaaatttaggccaggcgtggtggctcacacctgtaatcccagctctttgggaggccgaggtgggtggatcacttgaggtcaagagttcgagaccagcctggccaacatggtgaaaccccatctctactaaaaatacaaaaattatctgggtgtggtggcacatgcctgtaatcccagctattcagtaggaggctgaggcattagaatcgcttgaatctgggaggtggagtttgcagtgagctgagatcacaccagtgcactccagcctgggtgacagtgagactctgtctcaaaaataaataaataaataaaaagaatatgggaatttggttacagagaagacacacaaggaatgccatgtaatgatggaggcagagattagagtaaaacttgtacatgccgtagaacgccaaggattgctggctaccaccagaagctaggaaaaggcaaggaagactcctcccctagagaccccagagggagggtgactctgccaacaccttgatttaagatctgcagcttctagaactgcaagagaatacatttctattgttttaagccacccagtatgtggtcatttgttactgtagccctgggaaactaacacacctctcaagaacacctatgttctgaactgtctcaagtttttttctgagctttcttaaatgcaaggataatttcttttaatacactgttttttctttaaaaatctatcaacattgctccttagtcttctcacatttagtgttacaggaagtatatagctatcgtgatttttgttctttttgtaagttccttattctatctgtatctagataagtgttatttcattgttttccctggaaaatgcggtaaactcttttgtcttactcatggtgtttttttctgtaaagcaagaaaatacatttgtgtgtgtgtgtgtgtgtgtgtgtgtacatctctttttacaaacattatttctgtaatacttggattgaatccctgttctgaaatttttatgtctatcatctctcctccagcttttcaatctttattattgctgtttttcccatctatatttgggagtatttctcaatttgttttttgcatctctgattttattttatggaatatcaattgttagtatcctagttcctttattatggctttctcttctgaagttgcagcattttaaccttccttacaattcttctctttcccttgtcccctctttaaaaaaaatcttatcctggtatcttttccttccagcctgttttctctttaaagatttcttttactgttgcaagaagctatgtgttcttgtgtgctactgaggatgccaggatttactgaaaattttttgtttctagtttttgggttattattattttttttttgagacagagtcttgccctgttgcccaggctggagcacagtgcagctcactgcagtctcaaactcttcggctcaagcaatcctcctgcctcaggctccttgagtagttgggactacaggggtgtgtcaccacacccatttaatttttattttttgtagagatggggttttgctttcttgcccagtctgatcttgaactcctgtcctcaagtgatcctcctgttttggcctcccaaagtactgggattacaggcatgagccaccgtgccaggcctctaatttcttgaaatgtatcttttcctcactttttcttttccctgtttactcattctcaaatgagaggaaatctacctagaccttgtgtctgctgactgttggaatatgaagactgccttttagcctattatttaaacatatgtgctaatgaaatcattttctgagttttactgctagtaatcaatttcatgtacacatatgccagctcaactccttgttaccatataatgcaaatctgtttttctgagatggaacttcaacctgtatcactatctggcttcctgaaacacataaaataataaatgaattactaaggtaaacataaatcgttttccatgattatttttgtatttacagtattttacaaaagatgattctctttgtcagaattccattgttagtcctctccacttcttagtagattgtgtaattttaagtactatttctaatggatgcaggacaagaagtgttcaggtgggatggtgagttcgggagggccagctgcctctcaggccagcaactatgtggtcgtgaacggttgctcactttggtttggagaatacagacagtgcaagagtgggaaaggctttttgtacctacttccaagtaagcagattactttccttccactgatgcaacacaaaccattcagtatacgtgttaactctcttccgttgaccttgtatttagtggagattgtttaaagattctggctgtattgtgtgtgggtccagatttttttttggcattgtgaagcttttttttttttaaatcttttgcattcatagatatttgagtgggtacgtgggagagatcgtgttgggtattaccagacaaatatcattttaatttggaagtctgacatttgttcctcatttctacttgtaggtttcctgttgacttgtaatttagggcagtatcctcttttgatcttattttctttagctctaaatgggatttcaaatttaaatgtgctttggttagcagattaacataaacgtttattaattcagataatttactaatattttatttgttaatatgagaaaattatttctcttgtattcctgaatgaatttttttctttcatttgtttgatggactcagtacttaaaattttttactttctcttctatttgtatattttcctctctcatccccaggcatattttatttaaaaaccttgagtcagagaaagagttacacggacttatttggggatttgagctgatagccacccatagttcacccagctgaactgccttcctaggaacacgatgaaatggattctcaattctgatgtttcttcactaaggtctccagcatgatactagtttccagtgtgttggtagggtagacctgctcagcccatagctaattgatatgatggaaagaggtcaatgattttgagttggaaacacagctgtatgtcaggataattacagagaaacctgttgccttgctattacctttttaaaaaaaatattttaattgtagtaaaaaacataaaatttaccatcttaaccatttttaattgtacggttcagtagtgttaactatattcacattagtgttaccttttattgcctttacctttgaaagctttttgtcctactcagaagagctgaggctttgataattagcctgatgcactgtgaattgctaagagtccaacttttttcatggaaggaaccgaagacaaaatgagagaataaaagcagagaggagggaagaggaatacagcttagattagaaatggtccctacagcagcattattagtaaatatctcattttctggattccaagaccctaagaagtataagattaggaaaaaaaagtaaaactaccttaaatgtacacatctatcataagataactgttgatttttggatatgtgaaaaaatgtgagcaaatgtgtaccttagaatctgagaaataccaggaagtctcccacatggtgatgagaagcagcaaatgttgtgtctgaggaggaagttggtgaccagagtagaacagtgccacagcacaggcatcaagaagggtcacaagccatctacccccaatagcctctgccatcctcatgctccagtcaacctttagctctctgtgcatctcgtatgtccagaatagctaatgctcatccattctagatagcagttttattttttctataaatgttatttttaactaagttgtttgattctctactattatggattgttgagagcccctgacagcctgacaaatgtaccctgtggaacatgtgcttagcagtgatgacagaatagccaacagaatgttacatatgtaaactactcagctttgtgttcactctgggcaaatgaacaacatatggacatttgaaatatatgtgtgttcaaaattctgtcatgtgaggttagttgtggaattcgatagtccattttgtatttgttccatgtgaaaagggccttataatggcatcaccagttgttcattaatctcctttcccttatgtaaagtctccttttgtcctccctctgccagtctgtaagttttatcatgacatttatacatggaatggattgttaccttttctgggaggagaataaaccataaatatgaacgaggcattaaaagagcttaacataaatcactaagaaaaatctgtagactgtgagaatataaaaatcgctgtgaattataaataatacagcaaggttatataaatcattttatgtaaaggcagacatatatttctacttctcacagtaaggcccagtgattttaatatcattggttggccagcgtctatagtaggaatataggcatggaatatagtagaaagttccatagtgaaaattctgggagatcattggtagcatggaacagtgatacttactttctgttggagattgcatttgctttatattgttatcaaagtatcaaaagaaatcttacattttctctctatatttgctcttggataatagcacgcagatctgtaatcatttaaagaatgaaaatgtgtattgaaaaatttaaacattttgttttaacttaattaaactgtcatttctctttaattagtaattaactttcagactacttttctagaaagtatccagagaatctccttaattgttttttttcctattgtatctactttaacaatattttctagagaaaattaatcataaacatataactttatgtaagtttgcataagcttatgcataccttttaagcatgtattaaagagagtattctttttactaaagttatcgtctcttggttaattacttctgttttaataaacagattattctttgctgaagaaagttttccttataatatgtaactcttacacagttcagaattatatgttatatgttaagtgcataactttattgtgacagctagatgattttctttgtatataaaaaatgcttcattcatgtcactggaattaagtcacctctatacataatacaagagataaagaagaagtgtaagacacaatattgttcttagattgcttcctagttgagatcaaactaatataattttaacagcactggcatttcaagacaatttatgattaagttttaaattctgtgattcagattgcttttaattgtcaatcttaaagaaaattaaagacatgctactattacagtttcacccctactcacacataactagactgaaaacgttataaatattcagtttccagtagataaggaaatcttttccttaattcatttctgaaaggacatctttttcatactaaaagaaccttttgtttagtattatattttaaataatttctccaacactgctttcatttattttatttattttattttattgagacaaagtcttactgtgttgcccaggttggggtgcaatggtgtgatcttggctcactgcagccattgcctcctggcgaagcgattcttgtgcctcagcctcccaagtagctgggattacagttgtgcgccaccatgcctggctggtttttgtatttttaatagagatggggtttcgccatgttgtccatgcaggtctcatactcctggcctcaagtgatctgccctccttggcttcccaaagtgctgggattataggcgtgagccaccacgcctgaccactgccttcatttcttctgaggagtagctttgtttcttgttaggccaaagtttatgaaacaaaatttcttccttgctaataatagaacttatttctaagatggcaatatgtgattacagtagtcctcccttatccgtgtgggatatgtgccaggacccccagtggaggcctgaaactaaagatagtacagaaccactctatatactatgattaagttataggccagacacagtggcacctgtctgtaatcccagcactttgggatgccgaggcaggtggatcacttgagctctggagttcaagacaagcctgagcaacgtggtgaaaacctatctctacaaaaaatataaaaattagccatgtatcgtggtcacagctacttgggaggctgaggcgggaggattgcttgagctggggaggttgaggctgcagtgagtcaagattttgccattgcactccagctgggcaacagagtgagaccctgtctccaaaaaatatatataaaataaataaaaagtttaagttataaattagagtgagaaattaacaacaataactaataatagaacaatgatagcaatatactgtagtgaaagttatgtgagttatactctttcttaagatatttgaggaaggggtgaagtgggccagtacaagatttcatcacattactcagagcagcatgcaattaaaaacttattaattatttctgtaatttttcatttaatttttttgaactgtggttgactatgggtgactaaaaccgtggaaagcaaaaccatgggcccaggggttaggggaggtggggatgggactgctgtattatttagtagtattattttcttatcaaattttatctgacaaagtttaggaataccaccatctagattttaatcgtagattttcagttaaaatgtcatggttgatatatgagacaaaataagtttattttctagatttgttacttgtagaacctgtttattatagagagttctaggcttctttgaaagctgttctagagttgataaatctgaaaattcaagtggtaggatgaaccaatatcatggataaagctgagctaatggttgtccaatgaataagtgctgactagagctttaaaactgcatatataatatgcataattggcagtccatagatttatgggttttaagttactgctattttgacttaaagattgaacgatctatctgtagtgctagtgatgtttcaaacatcaaaagtaacagaacttcttgcaacataagcagtgcaactcttgccatgtctattgtatcccaaatcatacacctttattatttattaactgagaattattgcaataggtttaccctctgagaaaataaattataaggaataaattatgtgagctgtttgtctccttccaccttggaataagccagaatgtctttggttgatatgcttcattctgtaatcaatatacgtgtattctgcttttattcatggaggctattttgtaaagataagtacatttttatcagttgaaggtaaatgcaaaggaggtgaaagcacctctattccagccattatcattatccattatcattaatgatcctaatttcttcttgcaagttactgtgactgaatcctagaatcactgtatttatagggatcaccagattctagagaggtcaccatgtggctggaaaatatttgggttttagttttatgtgcccagaagaaagaatggctgcaccaaggtcaacaaaatgggcaataattatatctccactgtgtgaaagtgccacagtatcaggaatcgtaaactttgttgcctttatggagcacactaccataattcacattcatgcgatcatatcattgaattggcttaggagggagaaaacttgagatggaactcccctggtattttggtaaataacagtaagccacattctgtactatctaatcaatgtctgatatgagaaaacttaggaaacatcatgaattgaactctgcaaactcccctgaatggtgtggataatcatcttgaacttgaaggcaggtgtaccttcccaagttctctgagctcatttttgggctgcagctcctgccagtatggaatcaggtatcacagagcccaggatgaaggacatgataggtggtttggagaattgagtcactccacagatcacctaggtgacgaagatacttgtggtgtgtagcacacagaaagcactcataaatgctgtttaagctaataaaggaaattacaggaataggccatagaatttgaagaacacagataacacttcaggataattttatttgcaggattatttgtataagccagcagagaaactaaatgtagttcaatggaatggaagaccactgaagaacactgagagctccttcagagcataaactatcttaatcatcttttcgtgggcaatacctaacatagtgccctgcattcaataaatgctcgtcgaatgaacagaaactttagtgaaacgttaatatttgtgttgggccttgaaaggtggttgaatttgatttagtgaagggaaatgacatggcttttcagaatagtaggactcaatgaataaaggcacagatgttggaatgagcttacttaattttgtgagacacaggagaggtcagtctgatgagaggcccgtggtgtatgttgtggtggtaatggttgataagaggttgttattgattgaacacacacaaaaagactcagtgcaagcttctttggggaaatacaaagggatgagacatttttgtactgagaaattctgtctcacagactagtctcataactcctgatcaatagccttactataggctgttgatcttgaaagggcaccagcaagaagcaagtgcagtatatagctcagcacacccatcttccttaggtagctcgccatattgagtgggatcattttctcaattaggttgcgtatcaaaatttaatacttgttggattgaatcagatttaaaactctgaaatgctattcttaggaagagggaacctttctccttagagttggtgtatcccattatccttgagaggcaaccagggactctgccggaaggacttcacaatctggcagagacattttctgaaaataatgatttaaaaattcttcccttctctgcttcctcttcttttttcacctttaattgaataaccattatattgtattactttttcacttatggatttctttaaaccttaggtattttggttagttctgtggccaaatttaatcatcatagtacagtagtaggtatagcttcagtaataatgctaacaatgtatgcttttcttctaaagtgtgctgttggtacttgaatttagcagacaccgaatttttctcagacttttagaagaaataaaagaaggaagaattagaagtataatcagagaccaatagtggggttgacagaaggggtgtttttcttaataaatgtatacctaaagaaaagttatttttactggctagatatcacactacaaatattttctgactttgagttctgtagttattttgtctagaccactacgcagctattcatctcattcattattgcacttattggttgttttacctagctcctctgaagctggagaatctgagattaagtattagagctggaataaggacctgactctgggggttgggattgtcatttatcctattgcaggatgcaagccctcgcaaattttgtgaagtgcactccaaagacatggttttgctttcaactgtgatgacactataattgatcaagtatattctttcaaagaatcataaattcttattggagtttgaggagatgtcatattcatttgtcaacatgtcactccagggacacaggtgcagcaaatttatggaggaagcaccttgtgtttctcctgagtcacataaatatgaagcagaattgattgaaaacgtgtggttttagattactcctcaggtggagagcaattaagatctctctgtaaaggcatttcactctgcttctcaggttttcttgtagcataggcagagatcaggtctgaggggacaccagagaaatttttgaagacctgatggtgtcttctcagaaaagaatactaagacatttctctggcagagagaatattgcacatttttagtcaagtgcatgattaactttgacatttggaaatggaacttcacgtaaaaataagcatggtacttctgcatgtttaattaagatgtttagttcttgtcaaggctgatagccctccctcccacccccacacccccgccctgtgaagggcaatatattctcaacttctgaaatttcagaaacctgtacttaacctttaattgtcactccatttacatggaaatctgattaacaacttttaaagttcatgagctcctggtaaatgcaattaagacctttttggagtttgttattaagagctggcatttaaagaagactaggccctggctactgttgctgtcttctctgtagcaggatgtcttaagcaattagcagagaacatgaggtacatgaattgtatggtattgcttctgcgttaacatggttggtatttaaatagcatgctgtcttttttcttttctgtggcttgctttatggtgtgagcttgttactgaatggtagggtagagctgagaataattaggtagagctgtggtggttttcataagtaccgagttaggcacagttcctcatcccattggatgttctctagttatgtttacaaatgctcactctcatgtcatatggagtcaaggctaatcctactgtgatgaatttattgtatccatctcctggctgtggttgtctttttgagagttaaaattaaaagatgtagttattggagagaaatgatccaggtatacaattaatttctgatatcaggcatgtgagctgttcagccattgcccttgcctcatgggggcagaagtgggggtgaagtttgttggggcagacatgcgtagtataatttacaaactgagatgtgctgtgataaatggaaaatggggagtaaatagttgaaagacaggatcttatcggatcatatgctgccaatcatacagtgtgattttcatttactgatagaattgggctgtttgatggatgtatataatgcatttcttcggtactttatgtatgcaggacactgtgcttattagaaattgaggaatgatgagaaaaataatgaaatgataaatcaacagacatatcatttaaatacattgcatatgattgtgctattaaagtatacttgaatctacatatttctgtcctctttgaaatttttatgagtatatattgcttttaaataaaagatcaaaataaagaattatttgggaaaaaagaaataggaaagccaatgcaaaagaattaaattggatgccagaaataccagtgaaatagttctccatttttgtacactagagcagtggtccccaaccttttttggcatcagggaccagtttcatggaagagagtttttccatgtatggagggtggctggtgatggttttggaatgaaactgttccacctcacatcatcagatattagttagattctcgtaaggagcacacgacctagatccctcgcatgtgcagttcacagtagggttcacactcctgtgaaaatctaatgctgctgacgggaggtggagctcaggtgataatgcttgctcccctgccgctcacctgctgtgtggcctggttcctaacaggccatgggctggtgctggtaacaggccacagaccagtaactctagtgcacaggaacccttgcgctagaattttcatatttactgtaaacttacttaaaccagcagtgcagttcatttgattaaccttttaaattttaggctatcctcaagtgtagtgcgtaaataaaatagtttaattccatgttttgaattaacacataacattcagtataagtaatgtataataatcaaatacctattgtagatgtggaaatttttttttggcaacaaaactgataaaatagtattactttttgtttaaccaagctgtcgacaggtatttttcattagtttagtagcttgctcaagggacacacacacccacccacacacacaccatcaccttcagacagaagaattttccttatttcatagacagaatcttgtagatgcaagagttggcgaagtcaagaaattggtgatattaagttgttctttcagtcataaagcattttaataagatacttcagtggaaatatcattagacatgaattttgtctaatacatgctggtattagataaaatgccttctgctcaagtcgtgttgggaggtgaagagagaaatacaggaaaagttaaatatccagcagtgtatgattaattgccaagtccaaataatcatctgtgggtcctctaggaatttaaaagataactttagatagattggtcagagaaggttttgcgcatgggttagaggctgaactggtccttgaaagaaggctagaatttaggtattttggaaagatcattttagatagggataatatgcatatattcagaacagtgagcaccttactgaatttaaccacattctgaggaggctgcgatgaattcggttgagatgttctttgtggactccttaaagaacagaaccactgtatttgtctctgcattctggtgccttgtactctcagtgcttccaaacccccttatctcctggtctttacaatgttccccttaaattccaatgagaaggtatgtaacacagttcctggcacttagtaattacaaagtaaatgctggttgaatctgaatttgcaattgttatctctaaaaattctattttgaatgaactataggcaaatatttttttataagtgtgacaatatttacatattacagataaacaatataaaatcatctttagtaactgaactgctaattgaaaatgctgggtcttagccacttaattgagtaaactgtctccagagagtaatttgggtcttttccaagatgcattaactctttcaggtcgttagggtggcacttatctcattggagcagaaatgtaataaatggtattcctataatgtaagtaaattaatgtacctcaaaaagcctgaagtttcaccatgggtgttgtagttgtactccaaggagctcatctgtgaatgtgaaacagcaataagtagctgctgtttggagcatcttactttcaatttaggtaacttaagacattgtgcctagatgttgacagagatacaaagaaaagacctggctgacaggcggcagagaaggcaaataactgctaaatgaaatccttgagagatacaaactgctgtatgggttttaattagagtgagatatcatagttgacagtcgagatagatggtaatctcccagaagacaggcatcatggcttttttacacaatatgcttattcatgtttattctcagtatatagacatgtataagtataaatattaatatgaacaaatatatttgtaaatatgagttgaataaattgtaaacatattttacaattttcatatgtgtgctttttttccttgtgagaatatgaaatattaatgtctggcattgatctaaagtgactatagtaagtaggtggaaaccagaaaaaacacacggcatcttttagagatatatgctactcacaggttccctgtaacctcaacttgagtgtcagcctactggtgggggatattgacctttagctagaaaagaatataagaatgatttattctacccaccagcatgttacagatttacatctgatgggaagatagaggcacatagttgtcatcgtaagaccaaggggaagtgacataaaaagaccaatgcaaaaagaactttcaaaagaagaaggtagagataacagctccatgagaagataaaacttcaaagctataagcccctccctctgtttcctcatgcatggggttggcttcatctccatgcatgtaactctgattagtaacatctgaatggaggaaaagtagtttgctaagatccattaaagtctacttagattcactttcttgatctcataccccaagctttaaaaaaattttttatatttttccctggtacctgatgtacagctaacattccccatacttgataaatggaagagtagttaatggcaggaaaaaaaattagataaatttagacatgatggaaagcctttgggagttatttaagaaacaggaaataaaactttagtttaatcaactggtaatgatataaaaagaaccaataggaactcatcctatagaggttgattggggctgtgttgtgagaggcgctgaataataataagatagaggtttatttattttgaaggcatggaggaagccattgaaggacttgtcagaggaatgaaaacattgggtttaatctggtagcaggttgtgggatagactgtcatgagatgcatgtggcaggatatggccggtgggagactgttttaataacctgcatgaaagataatgaggacctgatttagaaagatgagtatgggaatgaaaatatttagaagagggactggacatgaagtgtgtagtattaaatctataggatttggcaggtgatttggagaacaagactgagaagagccacaactaactacacattttgatcccaggtgatcagaagaatgatgacattaaggagctcccccgctttggtgcccttcctccctttgaggagaggtggtaatagagagtttacctggtcagtctgagtttgttggacccatgttttagcatttcctaaacatctgctgcattgttttgacctgcttactgtgatatggatgtgagaacccagacattcttacaagcaatggcagtgtatctttggagcttgagagaaagtatgatgtaagagggataattgggaatcattcaaaatgtagaaataataaaaatggaagagagcaggagcaagggttaggatattttacttcctaattgcattttacagcctaactactaatacttaagtaatagtcttaagtattagtgttagttcttacagcctaactactaatactcaagtagttaggttgtaaaatacagtaatcaaactcattgaagtgaaagaaaacattccaaaagtttagagaatgagtattagcagaagcctggatttagtaattgagatctttattgtagcgcaaaggggaagaaggaagaaggagaagaatgataactttgaggagatgatgaagatatacagataatttcatttacccattcattcactcacttacacttataaagtgattgctgtgcttcaggcagtgttctaagtggaatactcatttgaccctgatgatagtactagcaaatagataatattatttctgttttacagatgaaggaactgaggttctgaggcacagagaggtaatatcatagatatatacttactggaatatattagaaaagaaacagatttctgagccttatcctgatagataataatagtctgttatgtactaagcattttgtatgcgttattaaaaaaattctcatttaattctatgaagtagttctttttctgtttccaacttttaagttcaagggtacatttgcaggatgtgcaggtttgttacataggtaaacgtgtgcttctatgaagtagttctattattatcttttattattatttttgtttcacagatgagggaagtgaggcttagaaagattaagtaacttgaccaaggtcacataactagtaagtagtagagttgatttcaagcacagactttctgcgtttttatatgactctctcattttgtagttctaaggcaggcacatgaatttctattttaaaggagttctccaagtgattcctatgtgcagaccagtcttcccagaatcttagcacaaactgagaaggaagaggtctgtatttttttggaggagataaaacattgtggacagagagaactcagagttggtgaccttatagatggagtatttcctaaggacacagaatcctaaagaatagtagagtggaggttatcggaatcaaggagactgagaaagactctgtgatgatagaaggagtcagtatattatgatgaaacatactagtcttaaaacagagtaaaattgtgttagttaattagttaattacagaattaattaacacaaccagtagctgaagttttttttttttgttggttgggttggtttttttttttttttttttttttttggagttagggtctcactctgtcacccagactggagtgcagtagtgcagtcatagctcactgtagtctcgaactcctgggctcaagggatcttcctaggtcagcctcccaagaggctgggactacaggcacatgcatgcctggctaatttttaatttttttttggtagagacacggcctcactgctgttacccaggctggtcttgaattcctggcctcaagcaatcctcccaccttggcctcacaaagtgttaggattataggcatgtgccactgcacccagcctgaagtttttgtaatggtgtaagataattctagagtttggtagtcaaagttgaaaagaaaaggggagaaagcaatgtaaataggtagaatgaactttaaaatatgtttaaatgaaatggacagagaatatattgaagctatagttaggaatatacttttggatgttgagaccatttttgtgccatcccctagcattgtctcttttatttgtctttgttttttaagagtgaaagtagaaataacaaactatcagaataccatgagatccaaaatacatggaggaaaaattgactgaaaggagtagtggaaaattcagtgattatggttggtgattttttaaataatgaatacccttttttgataattaatagaacaactagaagaaaatacagagaagacttgagcaacactattaaccaccctgatttaaactgacatgtatggtacactcaacaccatcagaattcagatgatctcaaggtcatatagaatattctccatgtgagtctatatgctagatcatcaagtaagtctcaatacatttaaaagaattgaaatcacataaagtatatcctctgaccgcaacagaattaaacaaaaaaagggaagaaatttggaggtccccaaatatttggaaataagacaacaaacttctgaatataccatgggtaacagaagaaagacctaaataatcatatgttttcatcccaagagctagaaaaaggagaaaactcggccgggggcagtggctcacacctgtaatcccagcactttgggaggctgaggtgggtggatcaccagaggtcaggagttgaagatcagcctggccaccatggtgaaaccctgtccctactaaaaatacaaaaaattagctgggcttggtggtgggcgtctgtaatcccaactactcaggaggttgaggcaggagaatcacttgaacccaggaagtggaggttgcagtgagctgagatcatgccattgtactccagcctgggcaacaagagtgaaattctgtctaaaaaaaaaaaatggagaaaactcaaagccaaagcaagcagaggttaggaaataataaaggtaaagtgataatcaatgaaataaaaatcaggataactgtaggaaaaaaaagtggaaccaaatagaggtcttttgaaaagatcaaaaattgatatatctttaagtagaccaaccaattaaaaaagagaagtctaaagaataccaaaagagagaagtctaaagaataccaaaatcaggaaatgaaagaggagatataactacaggctctacagaaattaaaaggattctgagactactatgatatgccaatcagacgatgtagatgaaacagaccaatttctacaaagacacaaagtaccaaaactgactcaagaagaaacagaaaatctgaattgtcctataacaaataaattagtaattaaaaattttcctgcacatacataattcacacaaatattctgtcaaacatttaaagatgaaataataccagtcctttgcaaactctttcagaaaatagagaaacagtttccaatgcatcctactaggccagtattaccctgataacaaagccaaagtattatagaaaactgtagagcagccttacaaacataagtgtaataatgttgaacaaaatattagcaaattgaatgtatcgacatataaactgtattataccatgattcattgggatttattttaaaagtcaatgtattaccataaaataaagaaccaaagtcacataatcatctcaatagatatagaaaagcacttgacctccattgattatttatcaaaaaaggaaacatactcaacctaataaaaggcacttgtgagaaacccgcaactagcatcatcaaggaactttttgacctaatgcaaatttattaatttatagatcatggaaataccatcaatcttaacctattcacattatgtatttcaagttcacgggcgtatattccaaacaaaatttattgtcgccatgtgctatgaaacccatttttcatgcattcttaattattgtttatagaaccataatttttaaaatccctcaaatgagcaatcttttagccattgcttttatttctcctttttttttttttgcagaatgactgattaaattttgttcattttatcttctctgcattgactcttaaatttgtcctaattgtataatcttattgccactgctttagtttaaaaccttttaattttttaaattgagctgtcttggtcggttgtctcttcttgctctccttcctttataggattttcctgatcattcatttttgcccctaatcccatttccttccagtcaataattttgtatactgtcagatcaatttacatacagcatatttatcaccatttcatttgcctgtttaaaactctttttcattgcctcattttgtatttggcttcagttcgtaatttgtcattacagattcttttttttttttttttttaagattcttggaagtttgtcagtgtactccctttccaggcttacctcttgttggtcattttaatgtcgcctgaaatattcgttatttactgaagatgccctaaattttcccatcactatgtatttgcttgttctgttctgtgccttcatttttttttgtttgtttgtttgttttcacacattctaagattcaatttatgtccttctatagttccatgatcttgaaggctttttttgttgccctagttaggagccatcttgtcctcctataaatgctcttagccatatttttgtcctgatgttttaccactttctcctttgtattgtactcattcatgtgtgtctcaattaatagataaatacactgagggaaggacttatttttgagtcctggttttatatctagcacaatactttgcatattttctgtgttaaataaatatataatttaaaatgaatgaaaacatttggaagctattaaactgggctttctttgctaagagctattctcttgagaaaaagaaaaaaaatcatgagtagtttgatcagatgttcgatacaggaccaaaaatacatgtgtactcttggaagtttttgatttgttttattctgaacaataatgaaccattcacaagaccatagcgttagtggttttaattgtgcaactgccattgacaatgagtataattgagcaggcatctgctttattttcaaaatgaagaatttttcctttcctttccttactgcagaatattttaggttatacaacggggaaattagactgctctattgaaaaaaataactttttctgttattttttctgttattaacattctattcatagtagctctatgaggaaaactcgataagtttttgtaatttaaaatggacattctaatttaaaaatatcattatattatttcagtctcttggctgtaatgttttcaggaatcaaggttataatttggtgggtatattaccctgattttgtctcctgcgcttttcaaattcctttgagacatcctccattgggtaagactatactttctgcttgggctcttcccttgctccatgaaaaccgggaggcgccttctgggagaaagccagaggaattcgcctactgtgctccgttgtttcttccagggatcatagctgtcagtttctgctgaatttgattcccctctagggtcttcaaattcttattttttagtattttttttggcttttacagttatcagcataaggaccagttaaatgagaactgatttgctgtacccagaatacaaactcttgggcacttgcattttaaaagagcaagttattgaaaattccattatttaatataggcacatttaaaatattgcccaagagaagttgagtcttagttcatgttgagagcttgagacaattttttcatgttactatttctcatgtcatgagaagcagtctattatcagactcatcaaagaggaccaatatactatggcttaatgtaaatcactgaatacgtgaagttagtagtcaagaaaattggggcaggacgcagtggctcacgcctgtaatcccagcactttgggaggctgaggcaggtggatcacgaggtcaggagatcgagaccatcctggctaacacggtgaaaccccatctctactaaaaatacaaaaattagcctggtgtggtggcatgcacctgtaatccctgccactcgggagagtgaggcaggagaatcgcttgaacctgggaggtggcggatgcagtgagccgagatcgtgccactgcactccagcctggatgacagagtgagactccatcttaaaaataaataaataaatgaaagaaagaaaaaaacaaaaaggaaaattgggttcatagttgtacagaatgaaatttgtgcaaaccactactcctgtttttatgagatgccagtattttgcaaagacagtaattttggtataaatgtcaatagattcatattagtatatactcatcaatccataggtatcttagtgaaggaacaaatactcatttaagctattataaggaagatatattagatactataaagacatactgcaaactcatagggtagaaaatctttgaccctatcagcaactggatgtgagacctataacactatggaaaacatttaaagtttgcagtgttcaagtctgtctcctctgggtttcctatttctctctctggccagctagttcattctttattctccctctgcggattgacttctttgatttttctatctgtaaaaggtggttgccccaaagaatttacatctcctcctttacatggccagtagagaatgtattccccaacacattcctgagaaagataattaactggctaattaggggttggttgtctccctggtgaacattttggctgtggctgagagggtggaatcacaggttataagcatggctaccagagtccactatgtggttggggaatagttcttagatgaggagagggttttgtaagctgaaaagttgcctgaaagggatctaccacatcaaatacctcagagatctgagtgtttaattgagtagctgggataaatggagaagctaaagacagaagatgtgttaattctaagcctatgactctcatatttatttaaaaaaaacctctgcatgtataaccacaaacagttataggcaaaaggttaaaggagattaaatggtaaatgaggaattaattcagaatgatgttaccaatgttagcaagttataaatctcaaaatttttgtcctgctttaataccgtgagattgctaagtaacatcttaggaactactaatcaaatatagcagaagagatgcctaaccaacctagtttatatgttctttaaaacactctgtatctttattttgaccacagagccattcaacgtaataggtcctcagaaaaaaacagtgaatgatgatatcactggaatatgtagacttccaagtgctttccaactgttttgttgttgttgttgtttcttgcctttagtttttacagattataccttttaagttgacacacccatcaattttgactattatttttggggctcttgatgaacaacaaatagaaattcatggtacttaaaaatagtaaagagattagtatctaagatatgaaggaattgagagccaacaagaatgtgggatcctgcacattttctgtagacagaatgtatttgatattgtaagtaatgctctttgttccagaatttcaatcttgggtgattttcttcacgcaaatgttaatcagaatagcttgtttacttttatgaaaattaaaatttgaacccataggtgtgtgcttagaatatatacaatttggaaggtgcagtacattatccaccatgatgtggaatcatcaataaattatatagttatattttaatactaggcatctgatgtttgtgtcaagactgtgtagtagaagatttagcccaattcaaataaatttcaggtatcctagaaataaaggcttttttgttctttgagatactaaaaaattctggccgggtgtgctggctcacacctgtaattctagcacattgggaggctgaggcaggcagataacctgagatcaggagttcaagaccagcctggccaacatggtgaaacccagtctctactacaaatacaaaaattagctgggcgtggtggcaggtgcctgtaatccctgctactcgggaggctgaggcaggagaatcgcttgaacctgggaggtggaggttgcagtgagccaagatcgtgccattgcactccagcctgggttacaagagcaagacttcatctcaaaaaaaaaaaaaaaatccctttactaatttgaatatcaaaataaaactttacctaaatttaaaatagtattttccagctggtgatgaatggtattagacaagagaggcaaacaatgaagcaaacaaacacaaattgcaaacatttagcctgtggttaaaaattacacccatcctttttcttttaaattttatttgtattgtagatttttgtactgaggattaatttacagagttcattctactttgaagactttttaatttgcatataacaacatattcattaaagcttctttatgctttttttaaaaagttcagcaatttgttgtatttttttgatttgctggtctgttgcatggccctatggtggaagtaaagaaatgtaatgctttaaggaacatataaattgggggtagtaagatgtctttattattaaataaggactaataatatcaggcagtttttgatgaatacttattgaatgatgtagaaaatgggtgttttaggagttcaggaaagggtatagccaactagagtggcctggcaagggctccttgaagaaaaaacactggaattattcttggaagtatttgttggtatttatttaggagagaaggtaatccagattaggccttctagaaatgagaatgcccacatatattcagggaagagttaagtaattttgattgcagtgttgggtttacgtttgagagaataagatacgcttggaaatatgtactaaagtcagaatgttgtagatgatgaaaggagtagccttctgatgatagcagcagtgttttaggactgtcagtctgttgatattacgtgagaaggactggaagggaaagagatgagaggcagaaaattaaatgaaaactacatgaattgaactaagttggtggctgtcaaaatggacaggagtgggcaaactaatagggagttgaggaacagtcattaatgatcttgaggactaattcccttatggacacaaaggatgtggaaatgtatcaaaagatggttctgaagttttaaacctggaaagtagtgaaaataagaaactaccaacaaacaaaaaggagacagaaggaattaatgtttttatgggaagatgatttaggtttcagaggagttggttttcttagtgaaatatgtgaatatatatcaagcatgcagtcacagatgtgggactggagctcaggagagaaatgaggaataaatcacattgtgataaagggaacagtagatgtaaaggctactttttaaagtttgggactcaaagacagaaggaaaataagattacagataaagcataaggaccaatgcaagatttttgttgagaaagtaggaaaagtgtgtgtttgcagattgaaaggagaagtgggtggataggaatagactaacaatgctgagaggtaacaattaaggggactttactgatgataaggggactttactgatgatgagaaaaagaaaaatgatcttaaaatacctgtgttttgaggtcagtattttattatacaaggccccagtcattggattctagaacagcaagtgcctcaaaagagttacttggattagtgtattttcatgctttggtagaaacatcactctgtcatgttgatgttaaccatctgaaatatgagtgaaacaatgcatttatatacatctttctgtgttatattaatttgaaattcttttctggtttaccagtctttttttgatcacaaattgctgaaaatcttattagcagcagtgccaaatatacagtataatttagtccctgagttgagttgttactagagacccaactcaatattctccctgatcattgggtagtttgggtgatgtattaacagagctagtacttatcattatattatttcatccacataccgaataatactctagtggcttcataaataaataaaaaatatttaccagtctgttgacatgttttgtattttccaagtgcaatccttattggacagaaaattaaataaagtacatttactgccacctatagacctgtgcttatttgggtgctctggtgtcaggtgcatatatatttactattgttgtattctcttgcagtattgacccctttattaatgaccttttttgtctttttgtacagtttttgacttaaagtctattttgtctggtattggtatagcaaatcctactctgttgtgttttccatttgtatggaatatctttttccatatctttacttttagtcagtgtgtctttataggcgaagtgagtttcttgaatgcaccaatattactgggtcttgttttttttttttaaaacggagcctcactctgtcgcccaggctggagtgcagaggcgcgatctctgctcactgcaagctccgcctcctgggttcacaccatcctcctgcctcagcctcctgagtagctgggactacaggcaccaaccaccatgcccggctaattttttgtatttttagtagagacagggtttcactgtgttagccaggatgctctcgatctcctgacctcgtgatctgcctgcctcggcctcctaaagtcccaaagtgctgggattacaggtgtgagccactgcgcctggcctgggtcttgttttttaattcattcagctactgtgtgtgtttaatcagggaatttagttcacttacattgtgttattattgataggtaaggacttactgctggcattttgttacttgttttctagttgttttataactcttccttcttattatctttctttgtggttacatgatctctctggtagcatgttttaatttgctgccttttgtttttagtgtatctattatgggtttttgccttgtgataattcttagattttaaattggattgattttataagtagaacctattggcagtagtagattttttaactttttaatttttttgagacggagtctcaccctgttgcccaggctggagtgcagtggcatgatctcggctcactgcaacctctggttcaagtgattcttgtgcctcagcctctcaagtagctgggactacaggtgtgcaccatcatgcccagccaattttttttttttttttaaagtagagatgagctttcactatgttggtcaggctggtcttgaacttctggcctcaagtgatcctcctacctcagcctcccaaagtgctgggattacaggcatgagccactgtgcctagctagtagttgattttttaaaaagcagctgcttttcttgtgttgaagctctcaatatgagtagtggctatggaaattctttgtaggtcaggacttcgtagcttcctgtggcctttctatatctctttttgcaggtttgttttagtatttatccactatgtgtaatagtgagtggtaacagcatgcactccctagtacactagggatcactttacaggtcttgaacctctgtaagccccatttctttatctataatctgtgaatttatctgataaaattttgtgctttaaaagagataatacattttacatggattagcatgttgcctgcatcatagtaagccctcagtaaatgttatggcattgctgctaatgctgctgtagtttggaatatgaggattaaattgtgattaaagaggaatgttgattaactcactcagcacaatatctagcacatagtagatacccaataaaaacgttccttttactcccatgttcaaatgcccaccccgcctcttccccatgaataggaacaagtagatgacttactagctataatgaatcttttcttagatccccaacttggaaaatgaatgaccaggttaatatactcctgaatgttggttttagaattagatttgcatggttttaaaatagtttttcttaattgcacattaaaaatgtgtatattaacattaactgatttatctggttgtacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagtaagtattattctgctgttaataggttttaagaattgttagactgaagtaagatgacttcctactttattaatagccataactttgtctagcttaagttgattgaagtaatttagaggaagtgaatatatgttgagttttatttatttttgttttctgtcaggtgaagtggttgttttgggtacagttactggactacctggaactcctaataaaaatttcttgaacttgtttcaggggagttttatttaaaattaagagaaatgaaactccccaattgtttctggggaattttatatgaaatgaaaggaaatgaaatatattagccttgaaaaggccccaagagccaagaaacaacctttgttaataaagttatgcaaatgtttctagctaagcagtattgggccttatgtggttacttgtttaataaaagaacaatctgggtttttttttatctaattataaccttagttaactccatgaacccatgtgcccaaagtgtatatctcttggcaacagctaatagttaataatattgataataacttcaatagtaacaacaggtaccactgattaagtgtttcctaggtatcaggcactgtactgggtgagtttcccaaaataatctcagttaaacatactttaaatttgagtatactaaattttagcagcagcagtagtagctaacgtttattgagttcttactaagtgctaatcaaggcattaaattattctcatagcttattttatttactaattacaacaaccttataggcaagggttgtatttttaatacttttgtacatataaaaaaatagagacatgaaaggttaagtaatttacagaaggtctcatagctagcatgtggtagaaggaggatttaaatcctggcagtcttactttagatctgttttcttttgaggatttagtagatatttaagaagttgtgtctgtaaatataagcatgtaaagtgaccaccactgaagtatcccagtatattgaatttattctttttcagcagttggagatctaatatcttctgttgattcacatttgaggcttgtttttatcttagatttttagtgtttttaataattaaagcttcaacagtttatttattttgtgatctagcagagaggagatttatttagtatatccctgccagaaatgaaatctattctgtttattgaatgcattcctttttaaacagttttattcagagagtggatgcaatatcagttacaatgctttaggctgcaagtaacataaaactttaaatacaatagattgaactataggaaagttactatctcacgtaacaaggatgaatgtggaggtttccttaattcaactgtacaatatcataaaggactcagccctttccatctctctgcattgccatcctcaacacattagtaatgttttctattgcgatcacgaggtgtatccatcagttccagtccagtaaagacagtgtgggcaagaaaattgcatgtgattctccctgtgaatctctctctttaaaaaacatatagactttattttttagaacagttttaggtttatagaaaagtagagcaggaagtacagagagttcctttatattccccgcttctctgcattttaccctatttaacatcttgtattagcgtctgtttgttagaattgatgaaccagtattgagatgtcattattaactaaattccatagtttacattagagttcactctttgtgttgtacagttctaatgggttttgacaaggcataagttcccaccattacagtgtcatacagaacagtttcactgctctaaacatcttccattcaccacatattcatccctccaccctccctaacccctggcaacctctgatcttttgactatctccataagttttgctttttccagaatgttgtatagtcagaatcagtgtgtagccttttcagaatggcttctttcacttagcaatatgcatttatctttcttccacatctttttgtggcttgataggtgtctctttgtattgctgagtaacattcctttgtgtggatatgccatagcttgcttatttacctattgaaggacatcttgcttgcttccagcttctggcaatcacgaataaagctgctttaaacactcatatgcaggttttggtgtggacataaattttcaactcatttttgtaaatacctgggagcaacattactggatcattcagtgatactatgtttagcttcataagacactgtcaaactgtcttctaaagtggctgcaccattttaaatctttttaaattagtacttacgaattatcagtttattaatcatttctgctaatgacaaaactcttcagcaagttcctattaagctctaggattgggtcgtaagcccattcctaaactagtcactggcaaggggaagcagatctcagtggttgtcttaaactaggcaggtttctctctggtgctaggtttccagctggagaggaagccactttttctgagcacatggctgagtaaagagcaaggaagcagaatgcccagatggaatcagggctatgccagcaagcacaaagatagtagaaggaaaaggtagttggtagaggcaactgacactgtctcagatgcgcctaagcaggcccttttcttttctttttttttttttcttttctctatttctagctcaatttaaccttctaaatatggaatcattgcagaaaacaggctttagggtttaaagttcatgctctcaaccatcaccgctgactttcaacctcagtcagaccacatacacattttcaaacatttagccagtgcttctgaagttgtggtattgggaaaaaaaaaaaaagaaattgttggaaatgaacaaattggcttaaataattattacacattttttattattgggcagtaatgaaacttatcacagacacagaattaggccgttattacagatttgtctgtttccagtcttggtgctatcattgagcccatgtgtgtctgagcaggtctcagtatctctggatataaactaaggaggtgagactcaatctctagtgcctcttttactgcaaaattatatcagtctgtgacttgttgcagacataaaaagaattcctgagtaccaaaaatacatcaagtcataaaggattaagattttgactgtttttatcacatctgtggaggactttattaccctctttaattacccttagctaaggttaattaagtctgtttaagtcctgccttattgtgctatgtgtgcctctctattctttgcttaagagtttatttattttttttctttgccgtatctgatcaatagctgtcagcatgctttttggaggtcagtggcttcttttctgcacttgactggcaggtggcatgtttgaagtactgcacactttgccttctttctggctgttagtaccctcttagttcttggcagggtgcagagaggggatcacgtaacccaagtgtttccctcacagactgacattcatctcagtattcatgttccttgtcaaggaaaggataaagaaggcataattaagaaaatgatggtgtgcctgccttgttgccagaaacctatcccattagcactgttgctcgtactatgttgctgcttttaccccttagtggcagtcattcttagaaggattcctccatctggcaggttgttatcctgcctttgaaatctcagtttgaaatgggatctcttatcacatcaaaggatttactgtttgatatgtcataattttatctgttttttttcttacttgcacgtttatcttaagactgatttgtttttgttatttctttttgtagttattattttaggttttagaaacctgttctttatcatgagtctctccctccttctccctccttcaccagtgtttctaacctctgaaatagttcctgggtaggtgtgaacaaatattgcgtagcttggtatttttgagagtattttatattgtaggcagcacgtcaaaaaactagcagccatttagaaaagaaactgttttttaggccatttagggagagattatagctgccttgcttttctggtgctgttattcagccacatttctagtatgtcctttgtctagtcctctacctgtggaagttaggcatgagttctgctctgaggagccagtgtgtctgtgttggtagctggcagtcactggtgacttctgagctggatggtaacgtaattagaatgacttcataggatgctttcgttgctgcatgtataaggatcctggctaaaggctgatgggggtctgaaagcaaaaggaagttgggacagatcacagttgtaccagttgaaatgcagaataagcaaaagatccaaatacggttgtaaaggagccttagccaggaatatcgctcataaatcaaggtctgcggcagctggccctggccctgtcatggtatagccaaagtgtcttcatcacggaacatcggggagcaccacacagaccagagtagaataatgtggaatacagagctggtcagcacttaattggtttacacctgcttgtctgtttcccctgtgtttctctgcaggttcgaatcgtcctcccatgccatcagtatgagcgcctatctgcgagaacagagaagggagctctatagtcggagtggagaactgcaaggtgagtgattgagcttctctggaaaaattaattttctggaggagtatttcctttattacacatgagtttgtgtcctgcattcacacgatcctttcaaggtaacaaacacttagtgacttaataatttgtttcttctgtaatttcccagcatctgctgccaagcaggtaaaactattactgtggccataggacttgtagacctgctactgttcaagtgggaattcaaagcaaaaagagatgaggccaggctcgtcttgcttaaacagaagacctgagtccagtcacaatctaggagaatgttggtcttctgcgactgccactgttacttctaattgttgtttttgacaccttctagaatatgacaggagtacctgagatttgggaaagggaaaatgcaaccactgtcattatttaaagggaaaaagatgcctctaaatagtatgttataatcaatataactgtgatgaacaggctatttgatacccatgtatagttaccaaagagttgtaagctgaagaagaaaatatttagaaaataaattaaatataaataaatatattagactgataacatttccttctgtgacaaaaagatgctgatcatgtaaatgtaatgagttaagaaaggtttggaggtcaggtgtggtgactaacacctgtaatctcagcactttgggagactgaggcaggcagatcacttgagtccaggagttcaagaccagcctgggcgacatggcgaagccctgtctctataaaaaaatacaaaaattagttggacatggtggcacgtgcgtattcccagctactcaggaggctgaggtgagattgcttgagcctgagaggcagaggttgcagtgagctgagatcatgccactgcacttcagcctgtgtgacaaagtgagaccatgtctcaaaaaaagaaaaaaaaaaaaacaacaaaaccacattggtgagggcctgctaagtgtaagacatcttaggtgttggaagtagtggaagttgggtacaaagaaatataaagcttaaagatctagttatgaaagtaaagtatacatatgtgtgtgtgcatatatacatacacacacagagatacacacacacacacacgtcaataacaatatcaggaagtaaatactaacaactgagtgggtggtatggataaattgctagagaaattacaagaaaggagtgattacataaattgttttagaactctgggcttttctccatgagggatgggaacgaatacttttactgtcttgatgcgttgggctcacgtagcattttgcagtgactggcctgtgtaattaaatatttagtctttaagactcataattctgtaccaaaacactatgaagtaaccactcaacctttcttgatttaaagactattgccttgtcattcctaacttcacctttgttattaatagaataacctgtaagtttttccaaagatgctgctgtactctctcatatttatatcacagtaatagttctacagcccataaatgtggtcaccagaagtaaaagcctagaagtatgtttagggtattaggaagaggagattagcctaccaacattttatttaatatgaaagggttgtcatgcattctggaagacatgcaatgtgcatgtcgagagtcttgatgtagaggagtacagactgtcattagacctggaacaagtgaaaggacagaaaggagtgaaggaggagggtgactcatgctctagcaggctttctctgcctcccaggagaagaggctaggctgccaagagtgaaaggaaatgatgataacagaacatacattattgcaggaggtaggattgtgctcgaactgcccttagcaggctatctaaggctagtgtatcttccacactcacggtatcctaattttaatttctcttcagatttgccttaaggaatagtttaaatttgcctccatattttctctacacctgtcttctaatacacataaatttatttgatggtgacaaagcatctcctttcttctttttaggttgagtcctaattattttctttcttaaaaattaataaacactatctgttagagcagttataaggtcccagctaaattgagtggaaagaacagagttcctgtgtgcccttgtccccacacatgcccaccttcctccagtgtcgacatccgtcagcacagtgcagccttccatttgacccttctagtgaacaggcagagcatgtccctatggttacatagggaccgaggacctctcatcgctcactcacactcaagcataaatagtcaacaagggcacaggactagtggcagattctttatgcttgtatgagtgagaatggagagcactctgcagcagccgtgggaaggcttttcagtcctgccccagtggtccacgctctcttgagagacagtatagggtggcagtgcagagtaggtggctctgggcccaagtcacctccatttagatacctagctccccagcacttgctttgtaacctccagcaagttccatggtctctgtgcctctttttccttttctctaaatgggaataaaagtaacactccctactccatgaggtggttatgaaaattaggtgagttaagctaggaagtgtttcaaaaagtgtctgacatatagtgaatgctatgcctttcttcttctcctctatttctagtactgtggtgtgacttcagagtattcacacacattctgtttgtcctttctgtcatctttatatggctaagccctcctgagctttccaagttaaatttaggtatcgctcatttggatgggcttccctgttggtccctcctctctcagcctgtcacaaatacacacacattctggggttgtggcccctgctgtgtgttactgccacatctttaatgatgttcttctgagtactttccatactgcattgtggaacaatgctctcttgtttgagtttgccacgaaactataagctgcaagagcaaaatactattttatttcctgtgcttctcacagcacctggtacaataaatgtttgataaatactggttgacttagtgacagaatgaatgaggacagttaggatctaaaataggatagagagcaccatggagaggcaggaagggcctgaaaggaaccactttcagctttatagttttccattagtctttaagttgaaggcaaagtagagggtatacatatatggttttgtcctctgcagttataagctttattaaatagaaatattgcccttgagctctctggcccaggacaaaactactgtatgtaattgaaaaacattttaaaatctaagtgacagaggaattttactctgtgaggatggttaatggagaaatcactacaatctaactaggaattttcccatccttcaaaaagttaattgaaatatgggctttcaagcacaagtcgattgaacttaccagttttcagcaaggaatatttctggttacaacagaagaaaagtaatagttagcaaccacattatgttcctaataatcattaaaaatactttaggtgagctgacatattacacacttggtgagagaataaatcagtggaccagtttttgtaaaagtctgatggtgtttcattcaggaggaaaagtttctctgatgaatgcttttaacatttcaacaggaaaaaagagaagaaaatcatacctgtcttccattaaaaacggctgtcctttttcagttattccattaatgactggtccaaggaccacaatgagatctgcatttcagcttgtccctgaaaaggcataattgaatagttcagtcaaaccgtaagagactaagggaagatttttgtttcttctgttaacaccatatagcggcaggctttgcttcccagtaatttcggttcatacgtcaacttttccttccgttgcagggtagcggcgaagaaatccaccagaaagacaatcaaagtaacattaaaaagctcaaattttacaaaagttaagttcctgccaacattttcaatttatcatacaattagaaatgtgactcagtctaacaacacccaagaggataaaaggattaaaaaaatgagatttctttggtgttatcaatgcatctcaataggctctaactgttatggtacagatggttcattatatagtctgctgttggcagttgggctgcggagatgtgggtgctgcttcaaaatgtgtgagataccaggtggagatctaacttgtgggtgtgtcagtgttaatcataggcttcctgtggttttagtctctgccgcttcattgtacttagcagtgctgggagtgaagaaagatacaagttttaatgaacattttatttgaatatagcttctcaggtttaatgtataattcttcaggggaatagataattgatgaacacattatctggtgagggttaaaaaaaaacaaaaacaaaaaacaatctaaagactaccactcatgaccaaaataagctcacaggtttatcaatgacattctgcctcagatttctcataggaaaaaattagaactgttttcagtcctgactactttaggggaatgttgtgactattaacttaaatattaaattattagtattagaaatttctaaattagaaacattagattagcaatgttgatttaaatgataaagtgatgttttaaaaaatcattttgggccagacacagtggcttatgcctgtaatcccagcactttgggaggcctgaggtgcacagatcacttgaggtcaggagtttgagaccagcctggccaatatggtgaaaccccctctctactaaaaatacaaaaattagcctggcgtggtggcggacacctgtaatcccagctacttgggaggctgaggcaggagaatcgcttgaacctggaaggtggaggttgcagtgagccgagatcgcgccactgtactccaacctgggagacacagcgagactccgtctcaaaaaataaataaataaataaataaataaataaataaataattaaataaatgagtcagtaataaataaataaaaatttaaaaagtatcatcatggagttaagggtgctgcatctacttcgttacttcccattttctcttcaactccagtccactgagttagctctcctccaagtcaccagtgacctctgcttggtagacttaatattagctttttctgacattcatttcacttgatctttccgctgtttttcttttcttatcctcatgttctttctgagtcttgtcaaaagcctgttggagtatctcatgatttggtcctgggatttcttctgtgctgactttgtagactctccccagatgatctcagccaagaccaagcttcactcagtgcccgagcacagctgacctccatgtctgtgtctcctgcccttttctcattgttgtctaaccttttctagcatcccgtctccctacaatataattctttatcacaatatttaaaaaaattttctcattgtacttttcttaatatgtacatgtcttttttaactttgttaacttccttcacttcccttgacccagagtgcaagccttattcacgggtacatttcagtacctaggataatgcttggcttgaattaggcgctttaagacatatatgatgaacacatatgattctatctttaatatctccttatttgtaggtacaagcctacttatttgagaaaccctagtggttgtttaaataaacagactgggagtcctgtgatttgtcttttctcatttttaaggataataaaactcatgaatgagtaagagtatattaattgccattgattcaaatagaaatgtatactcaatttccattatgttttcttttctatctcggggctacttaatacttttgtttttattcaatgatattacctttagagtgccatttttatttccattagtttaatgagtggcctttctatagccctgacattaaaatgttctgtaaatctccaaccacttgagacctcacttctttaagatgatttgcattacatagtaaatatggacatactggcataggtaaaaaagctcttatactggcctaacctgaattttctgagtttttctctctaatgggttgtcggtgactgggattgtgaatacttgtatgtaattaatctcttcgggggtgtcttgccttaagaaaagacagtatttgagatagattcactctgagttgattatccatttctactaaaaggatttataataggagtctcttatatagcaagctgttctataatggagcatttaaggcaatatttcacttttgcacacattttcagggtcactttgattgaagtgaggtgcattattttgtatagcaatattatgcttatgacatatatttgttctgcagccttaaatataagaagcactttcaaaactttataccctgaagtttgattagaaaattctttgttgccttctagaatttgcttaatgacttcattaataactatgcaacaatatgcagggaacatgaaaaaaagtacatttttcttctgaaaattgcatataattattacaaaataacttttaatctttcatagtcatcttttctgttttagcctctaaaatagtgtttaaaaattgattccccttttcttcatggatttatattcttgcttttttttaaaagaatgaccttaacttacttatatgtaagatttgtcttataataaagttataatagaatttttacaaatgctcatttctttgtctatccctaagacattgtaactaataaatatactttcctcaagtcatgaacagattgcattatttcaaatcatttaggaaataaaaatattcttatgccaagattgttatcaagtgtactactttttagccttaattgatgtagacatttatttaaaaatattctttagttatggatttactttatataagttggatttgttttctgaataaatctgatccatgcagtattttgtctagccagtagacaaaccatgcatagctgaaccatatggaagagcctggaatttatggtaaaatggatcttgagaatacaaaataaccatcacaaagccgattactcagtgaagcctaagaacctcgctcttgagatatgatacttggtcatcacacagaaccagttgatgacatctaaccttatttctaaaaatattctattcattcatacagatgtgagaaaagaaggaatgctggtaaatgaaacgtaatgtatttgagttttaaaagttgaacaaatgcatttctctacatttatattatatggttttttaaaaaagccaaatttatggctgcgcatggtggctcactcctgtaatcccctctctttgggaggccaaggtgggtggatcacctgaggtcagtagttcgtgaccagcctgaccaatatggtgaaactctgtctctactaaaaatacaaaaatcagctgggtgtggtggtatgtacctgtagtcctagctagtcaggaggctgagacaggagaattgcttgaacctaggaggtggaggttgcagtgagtcaagatcgtaccactgtgctccagcctgggcgacagagtgagactccatctcaaaaaacaaacaaacaaacaaaaaaaacgaaatttgtgtaaaaagtttttgttttcagaacaaaaacttctgaaatgatgcaacagggaaatttaaaagttaacttatatctcatattttcaattatttggttcacattggttttttaataaggtaaaaataacagctttgctcatcttattagacattttttaggcccacaagaaagtatatttttggctattctaatagtttatataataccactcattatgagttaagccttgttaaaatatggagaagaccacaaacatttatggcatatggtaaagaaagtaattattagaaacagatgaaaatactaaataatgaatttattattgtcccaataaacacaattcataagataattttatatttgaaaatgaagtttggatccttttaggaatactaatagtatcaatagaaattttcctttatgaagggagctattaattaacaaaattcagaagaaatttatgtaaacatgcaggtaatgtgatatctggaaaataaaacagtagattttagtgctagaaagtgctttagaactcatagtctagtgctttttaaattcatttttagttatagaactcttcttctatttaatcttatttcacagttcaaggtagacaacaggtaaaagtggagatagtttaacaaagtgggggtgaggattcaacctcacttcatctttttctttttccttcctctgtgtgggcacccagggtactatttaaaacactaaagactcagaggcagacatatggaaatattatatgagggagaaatgactttacaaagtttaggaagaggacagaccagtcaataaagaatggtgagacaattgatcatgcatataggaaaaaaacaaagaaattggatttgtacctcatatcatttagggaaataaatttccaataggttgataactcaaatgtgaaaggcaaacctattcagaatgttcatagcaacattgttttagtagcaaaaaccgagaaacagctcaaatgcccatagaaagaaggatggatatgtaagttgttgtagagtcacaaagtagaatactatgtagcaatgaaaatgaatgaactatgctatacattgagttggttgaatctcaaaggtagtcatataagaaaatattagataatatattagaaattagattatatatagaaatgtaaacatttataatgtaatatatataaaatctctatataaagtctaatataaatctaatatcttacacatgtaaacttaatatgtaatatatatgaatctaatatataatatctaatatatttaatatatataaaatctaatgtcatttgtatgaaggtcagaagcaggcagaactgaatagcctatttcataggaatatatcctgtgtgataaaaaaatgaagaaggtaagggcataaatataaaagtcaaggaaaacatcacctctggagaggatggaggagggttgtaaccaaagagaggatctcgtggggattcaaagatcctagtaatgttctctttcttaagctgttacagaaatactgttgttttattcttttaaaaactgtacaaatgtcatatgcactcatacatttcataaaatgtacagatataaacaattttttaagaagcctcttaaagctttagagacaaaaccatgtatgtagtttaatgttcctgtttagaaatcgagaacaaatgtggagttttctggacagcagcacttttgttgcaactcctggtatgtgccaaagctgtgaactacccctgaacgagtactgtaccttaagtcgtccatgagaaggcatctttgtggttagaagagtttcctcccaacttacctgctccctccatcatcctccatctgggatgtcagacacctaacattaattggagtcagcagcgattatacttttgtttcctgtgttaagggactttctgtttatttgttaatcctgtataggtttattgtatgtttacttgtgctggatacttcactaggccctcaggataaaataatgaacaggactgcctttgaaggccaaaagaaaagaaagggaccataaatgtgtcacttatatggtcacctgcctcccagcatttgttctccctttcctccaaattcatagagtccctgatatttcgctagtcacagggccacccaaaataggaacatttctaacttgccttgcagccaacatggacgtgtaatttaattctggctaataggatgtgattgaaagtaatgtgtgtaactttgggtcattctcttattgggaagaaagaggctgtctttctctcccagcccagcctgtgtgtgaaggtgtggatatgaatggaatgtggtaagtcctcctagaccatgcaggtgaggcagcactgaaggaaagctacaacaacaagacagagggggcctgggtttctgatactgtgtagtgccatacctcagtaacttcctggaccagagtcaccgcatcatcccggacttctgcatgagagatgagtaaactctgacttgttaattcactagtgttttgattcatgttacatgcagccctacttatatcccagttaattcagcaggaacacaagtgatcacagctctgtgatacacactatcacggagttgtgtgtatgtatatagacaactgggatgcatatacaagttctgggaaaggcagggaggcatctataagtatttaaagcttaaactcggttataacagatgaagagaagttttccaggtaaagaaattgaggcaagcatttcaggcatcaggcacagtatgggtaaatgtatgaaagtatgagagtataggctcttctctcatcagagtttcacaacatgaatcggatatttttctactaattaaggaactcagtttatatatacagatttttactgattataatttgttactttcaggagtcagatgaaagtacatcaaagctattatgaatggctttggccattgttcatcctagtaagagattaagaattgataagaaccaatggtgtactggtgatatgggaaaataaaggtcattattatacctgagcaaagaataaatgtaatcacatacaggattttccgagtattgttcaagtgttgtagctatgcagctttattattaaaaattctataggaaaaaataactttgttttaaatgcacttattatagcatattatattagactctgcatggtagctgaggctggaaatattggtagggcccacggcacaacctatttctaaagtaccttgcgttaaaaatagaatgttcagcttgaactgcaagtgatcatgatggcagcctggttctatatggagattgcagagctctgtgtgctcacatctgatttccagcttgtaattttggtgtggatgaaaatatgcattaagttacttttggcttctccacaattttaaactggaaaagcccatattacagtaatatatgatagtatgtatgaatgcgacatgaatattgtaatagtcataatataggatgttcattcctagaattgtgatgacatctactgaattgcagccagtaatttgcatattcatgcccacttagctcaaataagtccctgtttgtttgcacattaatgtctgatttcagcaccagctaactcatttacatatcctgttcagttggttagtgatgttcatatgtggaatattggtgcagctctgtttgggctttgagtagcttggggtttagtagaaggatcacctgttactcatcctagcttttctaggcaaggcactttacttttctgagctctaggttattcatctgtgtaatgaagttaatgctggttagttcttagggctgtcatatcagttgacacactggaggttatggtgtacagtcaacatttctaggccaactatattctggggcctgttcctggaacattttctgcgtgcagaggggttctagatgctgtagaagataagacatgcaaacagtcacagtttcagtgaatattagaagtactttggggagtacagaagagaaaacacttaacattttcaagggaagtcataggaggtattacaaaggtggaattcttacgccgaactggtaagatgagttgaccacactgaacaaaggaagggaactcgcggcaagtagggagaagatgtggatgaacacacagatgtttgagaatctcatggaactggaaatattttattgtggttaagcataaagtgtatggggaagattgaacatagacatggaagactggtaggcagatctcaaaagacctggtatgccatagcaagaaggttcggtttttgtcctgcgggtgataaggagtcctccaaaggtttaaagtaggagagtcgcataatgaaatgtgcattttagaaaatgttttctgatgactgtgtggagaatgaattgagtggaatgagagtgtagacaaagaggcaagttttgttatttcaggtgagagctcatagaagaattcttaggtgaggtgggaagtgacccagaacctattttggaggtacaatcagttggacatggtgactcattctgtgtggtgtttcagcaagaagagatgtattttggtgtcttgggtaggtaatgatgtcatttgttaagacaggaaatataaaaagaggagtagtttttatggagtgttagataggggtaaagatagcatttcattatgtatgcttttatggttctcttttggttgtgtttagttctgtctaatctaatctagcccaatataattttactacatagtctaatcttttatctttccctcaagtgtaaggctttcagcagtttgtgattactcataaccattcctcttctcaagttcagagtaatggagttacggttttcttccatcccttttcctctttttattttttaattgcaaatactactttcttttttttctaggctttcgttgatgtattagttttagtgcccactttagtctcttaagaatatgaattctttaatttttattccttgatgtaccctgtatttttattattaaaatcaaactattagcgatgtctcttgataacttgctctgactttgtgcaagtcacttaaccagttttctcagttgtaaaaggaagaaggtaagtgatttttttttttggaatctcatttatctccaaagctctaggttcttggattatcagtcactggcccactatatgttcctcacagcagagtctggggactagttagaggttcggagtggtgggtctctggaattgggcttactacctaggtgactttgggcacagtaactccttctatgtgtcacattcattttcttaaactgtgaatataatatacctaacctcatagggccatagtgatgacgaaatgagttaacacatgtaaaatgtttaaaactgtgccttgggcctggcacggtgactcatgcctgtaatcccagcactttgggaggccgaggtgggtggatcacctgaggtcagcagtttgagaccaacctggccaacatggtgaagtcctgtctctactaaaaatactgaactctactaaaaaattagctggacatggtggcacacgcctctagtcccagctactcaggaggctgaggcaggagaattacgtgaacccaggaggcagaggttgcagtgagccaagattgcaccattgcactccggcctgggcgacaaagcgatactctgtctcaaagcaaaacaaaacaaaaaactgtgcctggcacatattaagtacagataaatgttaacaactattattttacccgtaacctgtagcacctggcatcattcgtcacacataggaggcactcagtaaatgtttttttaaattaatgaaccaataagcctgttagtgaacaagtaagttctagtagtatctcttagaatggtccctagaaactcctccccccacccccatttttcctgttttcttctctgacagaagtctttctagactgttgagaaaatgtgtttacctcagagattgtcccaatcttgtaatgttaagtgacatccattttgagaatgtagttgtgattcacatatacctctaactaagagggccacacttggtgacctttagtgaatttgtctttctggcctatattcaccccagagataaatattaatggccatgatgaacgtggccatttttcttcaaaaccatttggtctgcagtggcacgaactctaaattttactacacaaataatttaggacggttggaatatggctagtaaagaggttaaaagggaaaggacagcccttctatttatgaattaatggcagctgaaaatttggcattgttttatgtacattattgttttgccttcctcttgcctccagtttgacatcactttcttgctgcttgtgaaaacaaaaataaaaatgcagttgtaatcctttaacggattgggtaatacgttggtgagggagagcttctttcttcaagtctatctacagattggaaagctgacctcttcagaagtacccttatagacacactcagaaataatgctttactagctctgtgagcgtccctagcacagtcaagttgacatataaaggtaaccatcacagaaacaaagtttgaaaaaaaaaggttacagctgatctgaaagggaaatttttgacttggcttagaaagcaagcaataaattgtttatggatatcattccccacagcatgtctgctgaaagaggactgataaaagcaaggcaattgatgggatgaatcattcgctcatttatgattatctaccatttctagattataggaatgttattgaggaccattaactccatatccacttaaatatgtcatgaatcattttttaaaatttctcaagacaagaactttttccataagaattctttaacatgtaaattgagtggttgactatcatttctaaattatggtattcaccctaacacaatagatgtagttgccctaaaatagatacagaatttggtctaacttattctaaccaattgaaatcctttgtcatccccaaattataatcagtatgatcttctttttactgtcacttccaggacattttttaggcaagtataatgcccaagaggaataattagctctttttaagtaacgtctacttttctatctgttttagatggtttctgtttagttattagccatatttgttgcattttacactttgaaatttgtagttcctataatacttttagaagtaataataatatacattatattaaaaaaattgggcgtggcatggtggctcacgcctgtaatcccagcacagtgggaggccgagctgggcagatcacgtgagatcaggagttcgagaccaacctggccaacatggtgaatataaaattagttgagtatagtggcacatatctgtaatcccagctactagggaggctgaggcaggagaatcgcttgaggctgggaaacggagattgcagtgagctgagatcacgccattgcactccagcctgggtgacaagagcgaaactgtctccaataaaaaaaaaaaaattgtgcgtaacactggagttttagatgcctgtacactgaatcttttctgttctttctccccttttttaaccttagtttatttattaatattattattacactttaattagatttcacttattattgaggtgaatgtacctgcagtgaagtgtgtaatgtgcactcatcttaaatgtacagctaaattcttgcacatatgtattcccatataactaccacccagaagatttcctatgcttcttaacactccctgagggtcaacactattctgatttctaactctatctcttagttttacctattctttaaataaatagaatcatactctgttttgtgtttctggcttctgtaactcaacaaaatgtctggcacattcattcttgtggatttgcatatcagtttttattattgcatagtattttattctatgactataggacaattcattcattcaccttttaatggactttcatcgtttccactttggggctactatagataattctcctatgaacagttgtattacaaatgcactaatttctcgtgggaatatacctaggaatggaattgttggttcataacataggcatgtgtttggctttaggagatacaaggattttaccattatagaaattgataagaaattgtatgacaatatcagttgctttacattctcactaatgtatttttatgggctcaaatttttaccattctcttgagtgtgtagtataccttctttttttttaaagaaaaagagtctaagctttccttacttctgctactcttcccctgcccccatactggcaggaatttctggatatgattatttgctatacagactatctgccaatttactgatttacagtacagcattttttgttgttgttgttggttttttttgagatgcggtcttgctctgtcccccaggctggagtgcagtgcaccggtgtgatcataactcactgcagccttgatctcctggacatcaggtgatcttcctgccttagcctcccaagtagctaggaacacaggtgtgcaccaccgcatgcaccatcacacctggccaattttagcttttttattgagacaaggtctcacttttttgctgaggctggtctcaagctcctggcctcaaacagtcctcctgcctcagcttcccaaagcactggggttataggcttgagccactgcacccagccaatatagtttttcatagttcagtgatcttgtattccttctagaagaagtcctgatcatgttcatacagtttctacccagaattctttagcggcttttcttactagaaatcacctaccatatttcttcgcaccttcgaggtggaagataaaggtatctcctctctttcaactttttgtaattttttggccagtggttttctattttgaatgatctttttattgcatgtttcttactgatattcccactggtagtaggcagaattctagaatgaccccaatgaccagacccatgcccatgtatttataatttttcccctttgggtggtatccatgattctgacagactgtcactctcggggttagttttttatatggcaacactgaatggattttgcaagtgtgattaaaatccctaataatttaaatttgagtcaatcaaaagggagattaccctggttgggcctcacatgacatttgaacccttaaaagagacaaaaagcagcagaaggtgctcttctgttagcctcaaagtagtaattcttgtgaatagattaggccatgttgtaaggacctggggtcatctctgtctaacagccaacagaaaaataggacctccatcctacaaccaaaaggaacagaattctcccaacaatcagaatgagctaggagcaggtccctatgccttagataagattgtgaccttgcctgacaccttgatttcagcatagtaaaaccctaaacataggactcagctaatccatgtctggacttctgacccacagaaattgtgagatcatcaatttttgtttttctgagctgttaaatttgtgaaattgtccctttgagactcccatgtagttcctaagactgatggatggaagttgctaggctagctctcttgttgtaagaaaggcaaacaactcttttccctaccttaaatttattccaactctctgtcagtgttttttttttttttttgagacggagtcttgctgtgttgcccaggctggagtgcggtggcatgattgcggctcactcactacaacctccacctcctgggttcaagcgattcttctgcctcagcctcctgagtagctgggactgcaggtgcctgccaacaagcccagctaacttttgtatttttagtagagatggtgtttcaccatgctggccaggctggtctcaaacccctgacctcgtgttccgcccacctcagcctcccaaagtgttgggattacaggggtgagccaccacgccctggccaaagtaacactttgcctccttgtctgggaatcgaaccctggtctcccgcgtgacaggcagggatatcactatactaatgaggaagacatgtctatcagtcttaaaatatctccttgcccctccagttctctatggcttttatttaatttggaagctgaaaggggctttgggaaagaatggaggtctaataggttttctgtgttactgtgggctttatagtatgagatacccattttgaaaacgtttgtagttataggtatagtaaagacatcgttgtgatgatagccccctgaggaaagcagcacagattatcatgttacctttctgggctgtctcatgagaaccaggcactgaacatgcccaaatcagactcatgattcctcctccctaccactcccaagcccgcttttctttcggtgcacctgattttgttaaatggcactattgataaacctgaaaggcatccttgactcctccttctttgccatagacaatctgtcaccagatcctactgatgctgcctcctaagtgccttacaaacccatttactgtttctttttaaaatgtcccttgcggctgggcacggtggctcacgcctgtaatcccagcactttgggaggctgagatgggtggatcacgaggtgaggagattgagaccatcctggctaacacggtgaaaccccgtctctactaaaaatacaaaaagttagctgggtgtggtggcaggcacctgtagtcccagctactcgggaggctgaggcaggagagtggtgtgaatctgggaggtggagcttgcagtgagccgagatcatgctactgcactccagcctaggcgacagagcgagactccgtctcaaaaacaaacaaacaaacaaacaaaaataaaatgtcccttgcttctacccaggttctaactgccatcatctcttggttgttcctgcttctatctctaatccctccaaaccattctttataccagaactagagtgagttaaaggtatttaataatttcgtatgtactagtactaaaccccatgtcctcaatatgcctaataaagttctgcatgatttagccaccactacgtgcagcagcttcttggcctcttttgaaaatcataaccttgtgggcttctcagaacatgctgtgcttgttcaggccttggaggctccttgcatgctgctgtctatacatggaattggcttcctttcatattcttgataattaatgccatctttaagataacgttctctgtataataagaattttatatcgtgcttattaagtacttaccatgtgtcaatcagtattctaaaacattttaccggtagtatgtcttcttcttttattctcttaaccattattttcttgggggagctttttgaaaaaaaaaaaaaaaattaccccagaccaggtcaacttccttctttgtagcacatggcatacttacaattattcagttggcatacttagtaatttaattatttgctgttgtttaaaatgtgtgtttatcattcattttaagttccttgcagtcagggaccaagtcagtatataccaatcactggtatagtaagcacctaataaataatcatgcttattaaaagtaaaagaagttcaatattattaaacaaatgcctgatttagacagtagcttaggtattttcccttcaagtttagagcttttttccataagcggataatatttggggatatttaggaatgtatcatagattaaattatattaagaaggaagctaagagaaactaatgttacttgagagaagaggatgcagtgactgagatggaattatttagggtatgtatataattattttgttttcataatcattttgtcaagtaggccttatgatatggtttagatatgtgtccctgcccaaatctcatgtcaaattgtcatctccagtgtgggaggtggggcctgatgggggtggttggatcacggggcggagttctcgtgtaagctttagcaccatcccctctgtgctgctcttgtgatagggttctcctgagatttttctcttgctcatgccatgtaagaagcgcctgcctcctctttaccctctgccataattatacatttcctggggccttcccagaagcagaagccgctatgcttcctgcacagcctccagaactgtgagccagttaaacctcttttctttgtaaattacccagtctcgggtatttcttgatagcggtgtgagaacagactaatatgccttattatttcatttctattatagctaaggaaaaaaaaaacatggctcatggaggttaagttacttgattatagtcacaaaaccaataaaggacaaagatgttacataatagttttattatatagggtttgcaaaataacttgcatttgaaatggcttgtgtattttccactttattgagataatttctatataatccacatttatttaaaatgaacagtttgatgagttttggaggatatatacacctgtgaaaataatgtcactattaagatacagaacattttcattacctagaagtttctttgtatccttttcagtctgtttctccctcaatttcaagcccttggtcactggtaaaatgctttatgtcataatagatgagcttacaacttctataatttgatataactggaatcatacaatagacaattttgtgatcagcttctttcactccacataatgatgttgacattcatccgcagtgttgcattcttcagtagttgttcctttcactgctgagtaggactctgttgtatggagatactgcttattgcttatccctgcagttgttgatatacatttgggttgtttccagtttttacttattgtgaataatgctgccctgaacatttgtgtgcaggtctctgtgtgggacagtattccctgaggaacacatacgagtgggattcttaggttatatggttagtgtatgtttaacttttaaagaaattcccagttttgtaaaataaatgtattattttatattcccagcaacaatgtgtgtcagcacttggtattgtcagttcttttaattttagacattactctgggtgtgtagtggtatctcattatggtggtttatatttaatataacatcttattgatgtaggaggccacacaaatgtggattcaggccttggaagttagaatcaacctcaaatcctttttctcttgtgagaattcatctagacctcttattatatgtcatgtcttttagaataacttgtgtctacctccatgaagtttttaaatacagagaaaatacatgtaactattttacaagtcaactggaaagccatacatgtatgtatatgttcgtgtgtgtatggcatatatgtatatataattattcattaaaaataatgcttactaaaactactcatactcattattgtatatatctatatttccagcatcttctgaaagtttgtaagttctgaataaatcctgctttgaagctaaaaattctaaattgttgctttattagtaatcacagggctaatgcaaagctctgataattaagactttatgtttttctttgagtgccaccatggcagcaaatggtatctgaaactgacagactgtagattaaaactttcagaatgtaaggcctagtctagggaaaatgaagttatgtataggtgacttgttccatttgaattaatcaaagggctgctggtgtagaccagctgtgttctctgatgacaaaaacgaatcttgacattttagataatgaaattcagttcagcacctcttagagatatgtgtgataatatatgtcagtcagaaacagagagaaggggagaagctcaaaccttgtcttattaaaatagacattgtgacaagtggacattgctgaatctctggtttctaggggaaaaaatgtcaagggaaacctctttaaaaaaatgatgggaatggctgttttatggaagctgggtgaaaagatttgacttctgatgcatgacctctttgacagttgcctttgttcatgattcctagtttcctggtttattttattggggtacagggtgaggtctggaagacctggaaaggaaactcacttttttggtttgacagtattaatgcaatcatctagttcataccttgtaagcccacttattatttcctctgcgtgtgttttttctggtttagcggattagctgcactgtctcttcaaaggctatccaatcaaggaggggttattaaaaccagggcgatttatgactgagaattaattagagaagcattttcatgcacaacatccaattttttgattagcaatggagcagggccgcaattaacactcgaggaagcttaaatttccagctttttgattctcaggaaatgagattatcaaaccagggtcagacacttgacagcaaagtgggagtgggggagtgtgaaattatatgtaaaaaaaaagaaaaaagagtcgtttgattttgattctgagattgctattaagacaatgggaaattcagaggagggaaagaacaaaaaatctgaaatggaagaacctgaaaggactgattctttggtggcctatttgctatgcacaatatctgttgtaaatgtttgctggaagtatgttttagaagcacagcaatattgttgtgttccttcattgttacttattattcagtttttctctcataaatttttcttggatattcagtggctgaacaaatatttaaaatgtttatatatgttggagagaggccaaaatttttcttgttagaaaagagagcttcttttctaaatgctaatttgcttttttgtgtgtggggggagtctgcttcttttcattggtgtttttaattttttcaagtcactcaagacacagtttaggtagtgagttatgtcaagccatagatgaccacttattgctaagtggccttgtcaagcttaggtgcctgagataagaagtaaggcaaccgcaggtttgctgtaaaacaaagtgtattctgtcatcagtgtaattggtgctccccaaggaatgcaacataatgaaaattcatttgttctggaaaatatttttcatcttgtctcctcttaatttggacatctaattttcatggagaaatagcagagcagcaaatcttttaattcattctgccaagttaaaactcatatgcatctcttctttattcagtagattctaagatttttaagagaccttgtcagtatttttgaatcatccaaccctctcttcattgccctgttttcatatttgcatgtatgatgaattgcctatctataaatagtgtaagactagtacaatctaaatattaaaatagtaatatgtactatttatagattgcttgcctattggtcttagggaaattgttggcatccagttctaagaggaaacacaagtgatcaatgtgtctttggcccagggtgggagagggactgagaattggttgatagtcttgtgtgactctggtttctctcatattctcctagcattggtttctctatttaaataagggtggggctttttgttacaatctggggagttattttaaaaaacatcttcataagcagattccagaatacaccaaaaatgaatggaagagaccatacgtcatttatataatcagagattgttgctatggcatttttctctctaaagcccctctggtttaggaacatgatccattgatctagcctatcattcttgcaatcctactatggattctcagctttatttgtcagtcttgcttaatcctccttcctttgttgatgaagagtatctatcactggctggatgaaaattggctgcagtttaatcttggggaaaaaggaagaaaactgccagtcagaggctgaagagttgatcttgtcagatttatagtcatcagttatcagtgctgatcttcatgttcttagatgttgatgattacatgcttttcggcatccaataaacatttgcggaaataatttatagttatatttatggatatttcctttgttgggaaatgttcctgcatttccaggtccatagcaaagggagcctaagcgtatgaattagggattcttaacctatgtgtgttatgtgttgggtggtttgggggagggtacgtgggtagccttcagggaatctgtgacacccagcagtgtcttcagattagaggggtggggagcaggaagaagttaccaagttttcattaggtttacaaaatgctattgttacatgtgtgtgtgtatacatagacacacgtatgtatatgtgtgtatatatatatatgtatacatacacacacgtatacacacacacacactcacaaatacgtgtacaaatacagttcccgacttggagagccttattatcaacagaggaaaacaatgtaacaactttagtaaaagcatatgaaatgatatccttttgtaataaatgtgaatgaaatacatctaacctatatttaaatgcttagtaacatttaatattaattatattaacatcacaggtaggcagaaaagttgaatttataaaaattgagaaaattaatcaagagaggcatagtaattaagtgtgaatcattttaaagaaagcaaggattatttagtggagtagaaaaacagaaaagcaaagctattctaggttggtttgtttgttttttctcctttaatgtgaagatttttaaaagtacagtttgatatagctcaattgatcgtttaattaaggaacttgatttgctttaagaggctcgcaattgataataatcatattatcatgttgaattcccagtggtgaggtgagggtgtcagctgttctactggcgcatttttgctttgcttgatttgctgtatgctcagtttatatcgtggtagatgacagatgtgcaagaaggctatttaaaaatcattgctggtgatgggtggaaaagaatgcctttagtttttagtatgatataattaatctttaatagtgatcgactaatgtatgtttatatgattatatctgaatagatatttattaaatatatattattgatatttctgccggggtaactgtgttattattgagtctctgggactcttttccacttcccatctgaatacttgctttaataagaatatcctactctagcagaagtagtgtaggtacaaagaaccccgttttcttaggttagtggtcaatctatgaaattagatttttgtgagcatgaaagtagagtgtagcccagtgaaatgaaatatggaaacctcagggttcaaagcaatgggttggcagagtcaggtcggagattgaaatgttgtgagtcatctatgagatagatggaaacactggagttgttgagcttttaaaacagtaatagatggaaagaaaaactctagactctgcataaggaaaaggctactagtttgttgaagaagagtagcttgtgagactcgaggagtgtcttgaataagttaggggaagggcaggcaaatggacacttaaggtttatagtgtgaatatcttctatctgctttttgaaaaacacatttaaatgagttcttaatgattcccaggaaccacagtccgattttggcttttgtttcctgtgccctcctgtcagttttgataactgtacctttgtctctgagcccatttttttcaaaattatggtttcattttaattgtttaatagtctgctcttgtctgtaatttccagagtttgaattgtatgatttttgcagcctctatgaaaatggtcagtgaaaaagaatttttggttaactatgacatcctgtatttaatggaaatattttgttttaatgacatgaaaccatagccatgaaaatttttctaatgtaacatcaagaacttctctttgtatattatatgaaccttctgtgaggtccagctaattgcaagacgtcctaagttagatatctcgtgcccattctgattcttctaagaatttactactattttagatcacattaaggttttcagatttttctctaattgcttgataatgtaacacaagcttaatagtgtaataacaaaagcttgatgttctgtagttagattcttttaaataatgtaaaaaaaagttataaatgatttgtagcttggatgactttttacatttctctctgggagtttcagttgctatgattttgttgttgtgttcagcttaattgccattagctactgctgaagtctcctccttactcaccgtgcaggcagtgtccatcagcagcatttagtacaggatgaatgaacgattcctttttgttatgttcaatggaatatgtaaatactttcaaatggccttcttcaactagagttttttaaaaatgagagatacgctggaaaaatactttgaaaaatattcatattctatagtggttagcttatttgttagttgtattatatttggcagttggatgacaggatatgttttagaatacctgaataaattagggaggatatatttctttaatatgattgttttaagttgtagatggcactcatggtaatgttttagtaatctaaatgtactcgtgtatgtaattaaagtttggataatcattagtgatattaaacccctcaaaaaattacattcttccctgggtctaggaagcatcttctgagttaatctacactagcagttttaaaactgtgtatgttccctagaacagttagaggtctggaaaggtataagaaattgggtgatcagaattctcagttccctcttgaaagcttcatccagggatgcttaatttttttggttttgtatgttgggatttcacacagacatattttctaattttgctatttcaaaaaatgttgcagtacagacttttatgaacatctgtgatactcctttaatatagaagatgaatcattgggtaaaaagatagtcttatctaaaatttgatagactaccaaattacttcccgaacagtgtttcctagtttatacttctttcaaaatctatggaaacatcatttcttttcatccttgacatcatttaatattaccatttttttaatttaaattttagatcttaaaaatttgaaaatttaccaacttgattagagtgtgtacctgattactagccaggtttagcatattttttgcatttatttgacatttgtagtttttcactgaattattatcgagtctaaaaataatccctaacacctctttcctatttttattggacttttttttattactgatttttagatactctatatattctagatacaaatgtgttctaaatacttttcctcctagtcagacatttagataagatttaatttggggacaaagatgatttttctaaaaataatttcaaagctattagagtagtattttttgatactatgatttcttttagatggatgtttttaaaagaccataaagtaagtagatattacagttttccttgggtaatctgttctagtgtctcacagtccttattaactttctcaacttaaaaaaaataaatgtgttaattaacatcctacattagtcgatatacctatcttgcttatttggtactctaaaaaaatttcctattaacatgaagttacaagatttcattaagtttttaaattaaatctcaaatcttttgttactaagtagcaacatgactgcttttcttcttaaaattcatctgttttataaactgtcagcatcatagtatccttctggataatttgtgagtgggcagcatctgtacttttcagaagggaagaatagatatttaataatttactcaaggttgtaccgttgcagaatcagaaattagaatctcagtctgttgagatgtgctctcaagataaaatacatgtgccatgcaaatagggcatagctttcttgtctagcaatggttggcccagtatgtggcccaacatatatttcctgtagaaggaatgagaatcactcctatgttgatgaccatagctgaacatgactggaagaattttagcatgaccagttgactttttttcctatcaccactggctagttctgaagtataaagtgttaagttataaactgcagcgttataattcctcttctggtaaaatgaaaaatcagtactgtaatcccagcactttgggaggccgaggcaggtggaccacctaaggtcaggagttcaaaaccagctgtgccagcatggtgaaaccttgtgtctactaaaaatacaaaattaactgggcatggtagtgcatgcctgtaatccagctactcaggaggccaaggcaggagaatcacttgaacctggaaggcagaggttgcagtgaaccaagatcgcgccattgcactctcagcctgggcaacaagagcaaaactccgtctcaaaaaaaagaaaagaaaagaaaagaaaaatcagtaacaaatacacagattttttttttatccatgactacaaaggtacctaactgaataatacatcatgatatttcttatatcattgtccttgagaacttaagtcttttcaatgaaagaaatgaaatatgaagtatttcccgagacagtgttctctaactttggggtgcatcaaatgcctggaggtcttgtgaacacagcttgcaggaccccattacttgaatttctgactcagtaggtctgagatggggtctgaaaatttgcatttctaacaagtccttttatgatgctgatggagggaccacactttgagaaccactactctaaaccttgtgataaaaatgatgaaaggtgatgctaatcaggatagccttgttgcctgtgaccaactacttctgtttcctctttaacactgtagcacttaggaattatcttatttcccctggagaagatcaaacctaatagaattatgcatgcgctgtaagagatcatcaaccttacaccttttcccttggacctagagcaatttgaaaagagacatttccatcaaaggacataaaacctgtagctacagtcacaagttaacaattatcagggtgtttgtacctgtctcctccatttgggttttatgcatgaattataaaactagagatgggaaagtaggaagaggatgaaggagtagcttccaaactgttactccaatagagatttcatactaattttgaattgaaaatgattagtcagtttagattcttataaggcataccacactattgaaaaataataaaatgctatagagagatattatcattgtgctacatgttttgttgtacgttactgttgagtttttattccagactttcttttgattatttttggtcctgagcaattttaaaaggcacatagtagaaactgctggttgcttagtatccaattacccaccttttctcctccttttttaccccttcttattgtatttaaggtggcagtgtttccagtgatacatttctcagtgttttctgcagttgggtgcaaccattgaaatataagcagaggggccgggcactgtggctcacgcctgtaatcccagcactttgggaggccgaggtgggaggatcatgaggtcaggagatcgagaccatcctggctaacgtggtgaaaccccatttctactaaaaatacaaaaaattagccgggcgtggtggcgggtgcctgtagtcccagctactcaggaggctgaggcaggagaatggcttgaacccatgaggtggagcttgcagtgagccgagatcacaccactgcactccagcctgggcaacagagcaagactccgtctaaaaaaaaaaaaagaaatataagcagaggtagttgggtagggcttctgataaaattccttaaagaaggctcagctggaaggttctcttttataacccttcctcttcctctctccctggcatttggatgtcttagtgggccatcccggactctaaggccactttgaaattggaagccaagcactagtagagcaggaaggagccttgatgccaaatgaccacagacgaacatttccagccctggactatgtactgtcaaattggagagagaaataaatgtctctcttgtttaaccagtttatttggattttctgttatttgtaagcaaaccttgccatttatgttgaagatggcattgtctgtctttgttaatgaggggtgtctctttaaaacctacgaggtgttttcacaggtgactttgtaagttcattgtaaattattccacatgtatcactggatccccgtcatcttacatcttttctttcttcttcttttcacctagtgaaatagtgtgtcttttggagtcaggtacacctgttttatttttaacaagtttattgaggcgtaattacagaacataaaattcactgcttttaaatttacaattcagcagtttttagtgaatttactggtttacaaacattaccgtgattcagttttagaacatgtcaacccatttacgttatcccttgtgcctgtttgcagtaaatccccacctcagcctcagaagaccaccaatctaatttccttctctatatatttaacttttgggacatttcttataaatagaatcgtgatgtggtcttttgtattaccttgttttagtgagcataatgttttgaggtttatttataatttagcacacatccatagttcattcctttttattattgaacagtattttattgaatgagtatactgtattttgtttatccattcatcagttaatggacattgggttgcatccacttttcagctattgtgaatatgctgctgtgaacattgctcttcaagtccttaacacacctggctttgaatcttagctctgctcaataggctggtgacctttggcaaattgcctaactactggtctctaaaacctgtgattttcttatctctaaaaggtgatcatacagacttcctcatggagttgctgtgaggattaaatgaaataccttacgagatcctttgtttagcaatctaaacactggaaacatacgagcaatagaattgtctcaaaagcatgtattaaaacaaccctcactgttatagtgattttcagtaatgcactgtgggtggtgatagtgggacccacagggcctcaaataactacttagtattgtcttgatagtttattcattcactaaggacagagtggtacatatcacaccagaagctgtagtgactgtattgtgatagtcctggtattgcacaagttgtgactttttcattgctcatatggtttggcaagtaagaaccatcttaaagttcagaattgtagtgtgccggtacataatatgctcttataacttatttataaaagaaggaaaagccgaaagagtatatccacaagatctgcatcattttttttttctcttttctttactggtaggtaaaatacctaaagtttggacatattattaatccagaacatttaggctccaggcgtcctggctacataattttctattataccctcttaggtgtgtgcctgaggtctgtgaattaaacaataaaaaagacaaattcacaagattaaaaaagaagaagcacaccagttttattttaaattttacatgtgtggaatcagaaaggaagtgaaatctcaagtagttagattggggggcttatatacaattttaacaaagggtactaaattgttgagaattgactagacaaagagggtttgggtttctaggggcaaaaaaaatattgtgggaagatgagatatatgggggaaactaatgacaggtaagggttatttcgtaagggttgattatgcaaactcatttcagtgttctctctgtctctggtgataaggattgttcttcatttgctggcacgggagtaggagcgggccttcacaagagagaattaatgcccacttttaggcagatgggggagggcagagagctattcctgtttctgttttttctcagttgccttcagctcaaaatcatccttattccaatgtggcatattttggggtgacatattctggttcccttaagtataatcattgtagagcaaatgcagacacagtacctgtgatgtaaatatttagtgaatgaatttagtcctgtgtgaaatcctccctcccctcccttcccattccttcccaccacttcacgcttaaccacagtgcagcattcttactttttggggtgacatattctggttcccttaagtataatcattgtagagcaaatgcaggcacagtacctgtgatgtaaatatttagtgaatgttagtcctgtgtgaaatgctcctctccccgcccttctcattccttcccaccacttcacgcttagccacagcgcagcattcttacttttctcctcctgctcagcttggagaattcagatgtcgatgagacaaaatggatcctactctcctggagattacagtctagcaggggaaatgtatattaagcaaatatcacacaaatagttgttaagttgtgataactgctgtgaaaggaacgtatagagtgctttgaaaatgccctggcatggtggctcacgcctgtaatcccagcactttgggaggctgtggcaggtggatcacctgagggcaggagttcaagaccagcctggccaacatggggaaaccccgtctctacaaagaatacaaaaattagccaggcgtggtggctcgtgcctataatcccagctgctcgggaactaaggcagtagaatcactagaacccaggaggcagaggttgcagtgagccgagattgcgccactgcactccagcctgggcgatagagtgagactccatcttaaaaaaaaaaaagaaaatacatagtacaggatctagcctagtctacagagtcagaaatcttctctggggaggatctctgaaggatcctagcatcagggagatggagcagaggcaagaaagggcatgccaaacatagggaagatagttgtgaaggctcccagtgaagaagaagatcaatgcgcacaagaaattgaaagaaggtagcgtagtgagggagagcttagctcaaaaccaaaccaaaccaaacaaaaacaaactggagagttaactgagcttaggtcattctgcgctgtggttaagcgtggtattagtcatctgatttttggcaagttactccttctacgcctcagtctgttacattaaggttgatcattctcatcttcagggaggcagttaaaatggaaaataaatcatatgaaactggccaggtgcggtggctcacgcctgcgggcggatcagttgaggccagaaattcgagaccagtctggccagtgtggcagaaccccgtctctactaaaatacaaaaactagccgggcctggtggcacacacctgtagtttcagctacttgggagactgaggcaggagaatcacttgaacctgggaaatggaggctgcagtgagccgagatcgcgccactgcactccatcttgggtgacagagcaagacttcatctcaaaaaaatatataaataaataaagtatgtgaaacttttaactgtatgtctggtatttttaaaaatttttatttttaaatttttatatatttacttatttttgagacttaactgggttatgagactggctaatttttgtatttttggtagaaacagggtttcaccatgttgtccaggctggtctcaaactcctgagctcaagcgatccatcgccttggcctcccaaagtgctgggattacaggcacaagccaccacacccggcttgatattatttttatcattaaaagttttacctgttttctaggaaaagcattctaagatattttacacatttttctgtctttttgaacataatattttaaacatgatacaccttttattgataacttcaggttgtcattatcagcttcaaacagcatactatactaaagtttaggtctgattgtccttgatttaaatgatccagtatcctgtctttttgtgttcttgggtctgatttgtatttaatttgttatttgtttccttattgtcaggcattttcttcctgctcatagcttactgtcttctagtagtctttgtttccttctttcttttggagttagaaattggatataagaatgtgttgctctttgtaaagttaaagtaaatagacctgaggtgagtaataaggcttgtgaaattttaacatctgtcttgtcccttgagaggccatttttgtttactttcaattcttggttattatgaagattcatgaaattgctggatatgtgagctgtatctgctctccaatttgccggacagtaattggacagaggagaaaattggctgttccattgggtagtgttttcctagcacattgtggctggctggctcagggcgctatatcatgcttattaatttatgtatgtaatgtgatacttagcatttattgtttgttatactcagacattgttctaggtgctttacatgtattaatggtattgataatattttatttctattgtgtaatcaatttgattaatttagttctaatatccatcttattggaacatcgttttttgtttttttttttcttttgagacaggagtctcgctctgtcgcccaggctggagtgcattggcgcgatctcagctcactgcagcctccacctccccggtttaagcgattctcttccctcagcctcctgagtagctgggactacaggcgcatgccaccgcgcccagctaattttatatttttagtagagacggagtttcactgtgttagccagcattgtctcaatctgctgacctcatgatccgcctttctcagccttccaaagtgctgggattacaggcgtgagccactgtgcacggcctggaacatctttatacttaaaacaagtaactttctttttctccatgtaatttctgataaatccactcctggaatgaatgttttagaaaatttgaccaagaggtgcttttgagcagcattagataaccccttcagtatctaaatgattgatgagaggagagactccttaatctagatttagagactttccatactggcagcaagatgtaccagagttcttaagaggagactaatgaaaatataaacatttgtacagaagaataggttaacattttttgagttgattacatagcaaggaaaacttgaggttttatacttaggagtgctaggaactaggcattgtaatgagaaaaatctgggccctgcaggagaatgtgaattatttttgatccagtactttatgctcattgtactatgataaatgatatcatttcatataagggcattttaatctgatgcattagactaaggatagtctgaacttttttgttgctaccaccacttcagtctttatcattaatgagaagctcagattgataaagtaatattaaactattattcttaatatattaatgtcaaaataacaattttttagagcacttttttgtatacatctctacaagatagtttattttgcttactagctgctcagcttttttatatgtggaatatggatttacttgattgttttagattattatactgagaggaggataaagaactggaccaatattgtttgtgcaattagttaatgctgatgcacagtgcagtatattgcaagaacttcaggacatacttttttaggtgggtttgtaaaacctgtatatcttccaaccatggagattactccaatcagtagcccaagtgtgcatacacacacacacacacacacacgtatacatatatgtgtaattatgtataaatatatgcacatatatacatatatatacacgtgtatatatgtacacacatttatacgtgtgtattttacatatacatatacatatagtgagagagaaagagagagagagactgtttcattctgttaccttggctggattacagtgacaaggtcatagattactgcagggtagaactcctgggctcaagtgatcctcccacctcagcctccccattagctgggtctgtaggcaagagccaacatgtctggctaattttcaaattttttgtagtgacaaggtcttgctacattgcccaggctggtctcaaactcctggcctcaagcgattctcctgccttggcctcccaaagtgctgggattccaggggtgagccagagttcctgaccggcactgatttttttaatcaaatcaagtttttacagaagtaaaaacagatgcttcactatagccagtttctaaagaattcaccaacaacatctcttcttatatagtcattctttatagtcattatcaaaattgtgtacaaatgtattgaagagctttattgtaattgtggtttcatcaatctgaatagaaaatttgtcacctagttgctcttcagtgttaattgacttattatctgtgtatctgcgaattgaaccattgctcaatggcagtgctttaaaatactggaagactatcgatgcatcactattgaaattacagtctctaaggtggataatatgacagtcttagcaactgtgtcaccactacaaggttttggggacttttttgttttgttattttgttttcacgttttaaaaagcagctgtatggaaatacaattcacataccatactgttcacccatttcatatgtataatttagtggtttttagggtgttcacaaagtatataaccacaccacagtcaatttaaggacattttcgtcatcctcaagagaatttctgtacctgtcaacagtcactccctcttctttcttttctcctctagtcttaggcagacaaaattattctgtctctaaaaaattgtcttttctggacatttcatgtaatggaatcttataagatgtggtctttcgtgactggcttttttcacttaggtcttcaagttcatgcatgttgtagcattggtctctatttcattgctgaataatattctgttgtatggacattttatatatctcttcatgaactgttgatgggcatttgtgttttttccaatttttgggtactatgaataacattcatgtgcaggtgcaggattttatatgcacatgttttcattctgcttgggtaaacacctagaagtggaaagtctggatcatatggtcattcggggtttattcttttgggaaactgccaaactagctgctcattttttttttttttacagaatttataccacttatttacagtcgaaaacatttagttaagatatttttactttaggccattgtcttcaaggtgagttgtttattcttccctctttgatgtgtgaacttgtccatttgtgatgtagattagtcatcacatcacaaatagtaaatgtaaatataccatttatacacatccacctaaatctattctttctaaaatgcatatatctatttatctttctgatgaaccaagggacataagtatgccataaccataatgagattgatactaatttggacaatgagagtaaatgagtccttcacagagcaaaaggaattctatacatttatttaaaagacaaatatttgatttgtaaaaataatattaagacagttggaagacatgtttgaaactgcatgggagggagtgtgattaatagaaagtgtagggttgggaaggaggattagttatggcagttccacaatgagtctggaagtttaataaaggaagtgtgcagggaataacagaaaaatcaaggaaaaggtagtacctgctactatcaattgtctgttgagatgggaaaatgaagcctacaaatctattaatcatttgaagatattaacaaagataatatataatttttgttctctgagttccttcccccgctccatgtgtattagctcattttcatgccgctgataaaggcatacctgtgactgggcaatttacaaaacaaagaggtttaatggagtcatagttccacatggctggggaggcctcacaatcatggctgaaggtgaaaggcacatctcacatggccacagatgagagaagagagcttgtgcagggaaactaccctttataaaaccatcagatcttgcgagacttattcactatcataagaatagcatggggaagacccgcctccatgattcaattaccccccactggattcctcccacaatacgtggtaattaagggagctacaagtcaaggtgagatttggatggtgacacagccaaaccatatcaccatgtaagagttttgaatcttgtctctaacttattttggactcaaattagaaattagtctttcactgggcatatgcatatatcagttagcttttactacgtgatgaatcaccccatacttagtggattaaaacatcaaacatttttattgttcattggtctgggactcgactatgtagttcttatgatttggactggctcgattagggttggatgatctaggatggtgccagatgggatgcttaggggctgaggtcttcttctctgcattggttttcatccttgaagaggtcagctggggcttattcacatgggagcaagcctgctgtgctcaagcagtcttcacgtttgggcttgcatcatatttgctagtatcctgtagtttaacccagatttgatgggtggagaaatcggccgtattttttgatgggaggtcctgcaaagtcaaagtccaaaagcggtgtgcacgcagagatggtaagaaattttgccccccacccccttttttttttcgttacagtcttctatactgtctaaagaattaagattattcattcatgccctctcctatttttttttttcattctcctaaggtagttttatgttgagattattcattcatggcctctcctattttttttttctttctcctaaggtagctttaggtttctttcctgaggaaattgtgtgagatatagaagaaataacttaaaagaattgaaaacagggactcaaacagatattttatacccatgttcatagcagcatcattcacattagttaaaagacagaagcaacccaaatatccatcagtggataaatggaaaaataaaatgtagtgtatacatagcatagaatgttactcagcctttaaaagggtggacattctaacacatgctacaacatggatgaaccttggggacattataataatacagtcgcgaaaggacaaatattgtatgactccacttatagatggtatctaaagtagtcacattcatagaaacagaaagaatgatggctgtaaggggtgggatggaggggaataagggaatggagagttatttaatgggtagtttcagcttgggaagatgaaaaaagttctggaaatggatgatggtgatgattgcacaacaccatgaatgtacttaatactactgaactgtatacttaaaaatagtaaaaatggtaatttttatgttatgtatatttttcctcaattaaaaaagtatattcactgcaacagtgaaaaattggcaacttctaaatatctaacaagagagaaaaggtagctaagtaaatatttcatttaagttttagtaaatattggttattaatttaggttgggtgtgatggctcatgcttgtaatcccagcaatttgggaggctgaggtgggtcaattgcttgattccaggagtttgagaccagcctaggcaacatagcaaacccttgtctctataaaaaatacaaaaattagcttggcgtggtggcatacacctgaagttcctactcaggagctactcaggtggctgaggtgggataatcgcttgagcccaggaggtcgaggctgcagtaagctgagattatgccagtgcgctccagcccgggcaacagagtgagaccctatcttaaaaaaaaggaagtattagttactcatttaaatgtttgtgaagactatttaataagagaaaatacatcataaataaaatcaaggcataaatttaaacactacagcctcaaacatgtaaataaaatgcataaaaacaggtatgtactgcctttcaaaccatgagatacagttatttaaaaataggagaaaaaaagccaaagaggaatcaatccatagcctttttaatagaaaagaaaaatatgatagaagttgagtacaacctaattagcctccaaatgagaattcaaaatagtttagagaagttgagcatttgtcggaagtcaagttgtccagccagtaccgttaggaagttttcagatgaacttcccagtgtaaagcagaccatcagatcaatggaaatgaatacacatctcagtttctataagaacagtaggttcttactggaaaggatgtagtcagtaaatggtactacagaaatttggaaaaatctcacagataatgtgtggtttaattcacctcacattagctgataaaattaattacagatagctaagtagtaaaatataacaaatgaaacaaaaaaattagaaggtaaaagtaaatatttattaaatgcttggatatacaaatacttcttgcgtaatgaaagaactctaagaggaaatgatagcttaatattaccacaaaaatgtaaaacttttaataatccaaacatataaaattaaaagccaaaaaatttaattgaataatgttgccacaaatatgacagaaaggctaaagttcttaccagataaaatcctcttttgggtgaaaacctgagcatgtatcttattcctgttcttgccacaatattttatagttactgtttttgtatcagtctcacttggggtggggtgtgtgtgtgtgtaccttttagatcttggtattttcagggacaaacacaaagtctagtccagaaggcattttgtaaatgtctgagtatgaacaaattggattctggggctattattttactgaggtctgaaatgctgacaaatgcatttgttaatcgatgaagcagatttgagaaggggatagaaaaatgttcagttaagttactgtgcaaatgcagcatacattaactttcttggtggaaaatattttaaaagatgaaatatatattccaataaaatatttggtggctattgaagtcacattacaaaatgcagctaccacacattgttagtttatatgaatcaattacaggggagatctttctggtgccatttttaatttttcctccttccagttgctgaagccctaccttcattcctcttgtcttaattttcccgctcccttctctttacctccttttttctctattctcccttcctttcttttcctttctctatcgccttctccacaacagctcagtaaaagagtgaagtttttgagtttcatttatgcctttccctgttttgctataaaaatcaaccaaggatgcttttagatagcaccagtatgatgagggaaataagctttcattgcaggatgattactgttggtgatgatgtataaaataaagggagggatgttatgtggaatgttgacccttcagggcttgtaaatgcacattacgtggtctggatggtaaactaagtgaatttaatattagctactggaaatgacagtgtttataaattttcaaaatgacgtttgtatctgtcaggctttagcttttattgtatcgaatacacttactttattttaatatttttctagagctgctttatgctatgggaaacactagttggaaattgaaaaccctagacattagatgatttttatttaacattatcttttgtattagttgtaattataattttctgtttgtaagtcactctcccaaagcacaggagaaaaaaacaaatttttcttccatgattttctcactgagaataattcgtcttatctacttaaaaatacgttcttttaaacaataaaagtggctctatctaaggctgttactttataaaattggaaagtatttatttgttaacacttatttatttctgtagtctttgaaatttgtattctcccccaatgtattttagcaaaatgggagaaatgaaggataacctagaattacattcccagagcaaaatatactgtatttattatttgtgattcatttcagttccgtgttttttttttgttcgtttgtttgcttgttttttgagacggggtctcactctgtcagcaggctggagtgcagtggtgcagtcttggctcactgcaacctctgcctcctgggctcaagcaattctcctgcctcagcctcccgagtagctgggactacaggcacgtgccaccacgcccggctaattttttgtatttttagtagagacgtgatttcaccatgttagccaggatggtctcgatctgctgacctcgtgatccgcctgcctcggtctcccaaagtgctgggattacaggtgtgagccaccatgcccggccccatttcagttctgttttatgtatgtgtttgtaactttaacaatataataataatggtgtggattcagtttttttttttaaactggatttgagtagtttatgactcctgtttattaaatcaaaatcagcaaaagtatttcatcaatatttgtcctcttcaaacattttagtaaattttagaaagttaaagtggagttgaataccagtcgtaaagctagtaatacctcttccaaaacaaacatacaaacaaacccctgaactacagttgtggaccttcattatctttctgagtgttgtgccttaatgtgtttgagtctctctgagatgcataatacgtgttatttgtttgagtttcagccataacttagtagtgatttttctccattatagactttgcacataatgaatttcaggaaatacacaacaacagcttcttccgcttgtagataaagacagtaatatgatggagtgatcaaatacaaatgctcctttaatttattttaccaagacatttatccatgttttatttataaggcaattgaagtcattcattttgtatggaactcttcctcttctgaataacaaataatatattatcatatatagcgcattgggggagggagtgatgaaagccaaacttgaaaataaaagtttaatattttgggctcattgggcacaattatagtgttactatctttgttttcaactgaatcataattgtgtgtgcagattttgaaaaaaccaggatggcatacggcacagagtagtatggaaaagagaaaattctttgttggaagagagggttttttttccctccagttgaagagcattttaaatgcacaaaatctgtctcagaaatatccctttgaaagatctttgcatacacaagatttaaaatgctttcattctgtgggtgactagaatgaaatgggagcctacattcccaagaatctctgatatgaccatataaaaaccatgaccaactggtttgtttttaactcttaccatgtacgagcccatttgaagggcatgggcaatacttcgtttctgaaccaagtcaagttgactgctggcatttaactcaccaccttgtgtttgctgttgcctgatgccagtaagaaatacatcgaaagctgtaatataatgataaccattatttgccctcagttaaaaatctagctaatgggtctgatgtgcccacagcttcatattgcttgagactgcccccttctaggatattttagaataaaagatcagaccagaaagaaaagtttaaagctcaggatatcatagaataaatggaagataaccagctagttctgttaaagcagactctatattttaaattcagtaaggatttaagtatattaatggttactagtttcctataaattagtttggggaggtccatgtaacattgaagtcatagttcactgccatgtttttccaaagtatgttcacaggtgtttggaatacgtatgatctaatctgaaaattaagagtatatatacctttcagttcttttttttttttttaattatactttaagttttagggtacatgtgcacattgtgcaggttagttacatacgtatacatgtgccatgctggtgcgctgcacccactaactcgtcatctagcattaggtatatctcccaatgctatccctccccccttcccccaccccacaacagtccccagagtgtgatgttccccttcctgtgtacgtgtgatctcattgttcagttcccacctatgagtgagaatatgtggtatttggttttttgttcttgcgatagtttactgagaatgatgatttccaatttcatccatgtccctacaaaggacatgaactcatcatttttttatggctgcatagtattccatggtgtatatgtgacacattttcttaatccagtctatcactgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtatgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcagatgagtaggtggtgaaaattttctcccatgttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccattttcccagcaccatttattaaatagggaatcctttcctcattgcttgtttttctcaggtttgtcaaagatcagatagttgtagatatgtggtgttatttctgagggctctgttctgttccattgatctatatctctgttttggtaccagcaccatacctttcagttcttactatatctttcaacagtgagctcttccttagtactttgagtgtatctggcttataaactactatttcaagaatatctcttatatagagatccaagcatacctgattattataaagactctaggttgtgattgttttaatatccagtttgtctttcacaaagttactctattgtcagtgcatttgaaatcctttctttacgaagagtctgtgacatcttgtaagtgtaacatatagctttcttgaattgtctaccatactgtaagagctatggttcttggagtgcttcatagtgtcccttctggggtacgttaggatggaggacgcaggattttggatggaggaaaatgtgactcctgatattgtgtttgctgaattattaatatcactgagctgcctttttcttagaatagccactgctggtaggctaatatttctaaggtcaaactgattgctagaaattattcctgttgagatcagctaggccatttcaacctttacttaggttttattgtaattttcaagtgagaataataagctagtgttgcttcctaacttttctgtgtgtgtatttcagaacagaacaattgcatatgtttcttggcagattctttttcatgatgtggtttatgctggagttggtgagactgcttcagagcatttcctcttccccatcttatgcctttctgaaatagagtttttaatactttttaagtcatggaccccttttgacctgtcaggataatgctgtttactgtgttaatgaatgcaaagagtacaaaaggaaacccactatattgaaatacaggtacaataaataagaagatctagtgtcaagtctaataatactataatttcaaagtagttatgagtataggtgtaattttgagatacctgcaacacctgtaatatagtatgaaagtatttgttatttctgttggtgacagaattgcaggtatgttaatactgttgtagttgtctgtaatcatagttgaaggaaatgctaaatttcagtagaggttagtgaaataaaagatacgtgttttccccctctaaggtcatgccctttttgaattctttccatggattccagattaagaagtatttttctaatgggattcctggttttctgattactatttctcctgagccaatattccagagagagagactgcgatttgcctttctttcctaaagggctgagttccccaaacattagtgacaaggcctatagtgctgctgaggctccagtatctttcacttattctgccagaagagacacttggttggtacattattttctttttcccagataattggctctttctgttttgagagaccaatacaatattgttaccaggctgttgagaaattcttatttctttggaatggtataaaccaaaggataaatcagtttttcagaaatccctagtctttttctttctaatatgctcaaatgttaatcttatttataaatcttgatgactctttctttattcaagttgatatcaggttaggaatttgcgatatgggattgctaatttaaaatacaccagttattcactggactaagaagaaagatcaaattggcttgcagagaattctttaaaaacaatgaaaacaagaacaaacaaagattttataaaattttatccattgatcctacattctgttgctcaagagagaagcttaccaggatgtgactttctgaagccagtgaatttatcatgactacctggtttagcacatagattcgcaaaggcatttcatgtccctgggcccagtagagagaatcagcagtaagaatacaattactttaattttactgtagaaacgtaatcaaaagtagatatagccgggcgtagtggctttcgcctatagtcccagcactttgggaggctgagatgggcagatcacgaggtcaagagatcgagaccatcctggccaacatggtgaaacctcgcctccactaaaaatacaaaaaaattagctgggcatggtggcatgtgtctgtagtcccagctactcgggaggctgaggcaggagaatcacttgaacccaggaggtggaggttgcagtgagccgagattgcgctactgcactccagcctggcaacagagcgagactccgtctcaaaaacaaaaacaaaaacaaaaacaagaagtagatatagatgataatggaaaagggggcaaagttacaaagggacaataaccataataccacccctgttaactggatttttcttacatcaaactgtagttgttttaaaataatatgtatttagctgggcccagtggttcacgcctgtaatcccagcattttgggaggctgaggtgggtggatcacctgaggtcaggagttcgagtccagcctggccaacatggtgaaaccctgtctctactaaaaatacaaaaattagccgagcatggtgatgggtgcctgtaatcccagctacttgggaggctgaggcaggagaatcgcatgaacctgggacgtggaggttgcagtgagctgagattgcgcccctgcactctagcctgggctacaggaatgaaattccatctccaaaaaaaataaaataaaataaataaaaatatgtatttcagtcatccagttgatgggccctctatgttggttaactaaagactagagcatacagttagaaacttttatctgatttatccaaacatgggatcttcctatggtaagtctgctgttactacactctgagcaataggtaaaggaataataatttaaaaattttggttaaaaactagttagaataaatttcaagttgtgtagaagagaaaaattgtgtttaattataacagtaggtttcggttcattttgtgatgcatagaaaatgtgaattacattaaaaaaatggctgtagttgaaagagttgtgttcagtaggccactttatgaagccctacaaaacagtcatcagtattcccaaataaaatacaacactgataatcaagaatcattcttgtttttagccaaaacagtttgtgtgtgagagtgtgatatagtggggagatatttactgttcatgcttacttcctttttgtacttgatcagacatctttgaatgtatcagtcattctcgaactttatttgcatcagaatcacctgtaaggcttgttaaaacacagactgttgggtaccatcctcagatttctgattcattaggtcaagagttggacccaataatttgcatttctaattgccacactttgataaccactatattgtccatttaatttttcctagcagtagtgaagactcacctgataatctttggcttaatgacaggtggtatctatgtgacatgatagaacacctcattgtattaaaaacaagaggaagcagtttcacagttgaaagaagctgtataataaacctaaatggaactctgagccttgatctcaggaacattcaaagtcctctagattcgagagaaatttccttatagtcttaggaaatatgggggtcaatgagatgttaatatttttaattgtgaaagttctgattttacaaataaacttaagtgcgacatcagtgattgtgatttttgaatttggaattagtgattccttgataggagctatagagatctacagctatatatattttttctggtggctgatcattgtattctcttcagattgttgtcactgtcagttggttttcgggaagaggctttcaaattatctcctatggccttttatatgttgattcattcaaatactgagtgaccatataatattttaagtcaaccaggacatgtgaaagtgctcagagtgagagaatatatgagtactccgtgtatcaccagcttaattttctataaacctaaaactgctctaaaattttaagtcaattaaaaaaaaagtactcagagccaacacatttgtctgaacaaaaggagaagaggtgagaaaatgtacgtaagtttggagaagaaagatcctgaatgtgcaagggtttttttcttcttcttaaatctctgttcatttatacatcccaacatcaacagatgtatgatttagcatttgccctgcacctctggctctagggaccctggagttttgtatatggataccctgctgcagtgaactctgtcattgttctcaacagctgggaatggaatatagctcattaagacaggagatgttatccaagcctcccctggcatcctgaagagtagtgaatatgttttgcttcctgagatctaaagtatccctttcgttaccacctagtgttctcttccttttattgaaaaactctattggccccattgccactttgaatgatgtgtacagtttatgccagctgttccttttcttaatcctttctccttcttctttgcctttttattatgtttatggtgtgtgctgtgccttgtatttaaaaaataaaaccctagtgtaattagtacatatcacttggttatgtaattaaaagaatattaaggacagattttcacaataaacccctatcattcagacatccctgctcccttttgtataaaaagcaactttgctggagagagggttgcaagtttaagtttctcatacttatcaggcgagggaacttatatttgagtttttattttatatcagatgcttagtcctattactccatttgattgtagcaataaatctgtgagacataaagatataagaattattatctcattttgtagatggggccctaagcatcagaaagatctaaaacccaattagtaaattgtgaagcaggtattcatatctttgtctttctggctccgtcatctctctgtactatttatgcaacctgttgctgagttatgtataaatttagatgtctgtattcattttttatgtggcatcgttgtctgcttatgtggcatgattatttagggcaaaaagaaagataagaggaaccatgttaaaaatatcacttttatctggagattcagatttatatctaggtcatcatttttctattcggagagttattcaggctttacaaatgaaataggcagggatgttcaggaatagcaaccaggtgctttctttgcaactggagagaagaaaataccaacctctccactaatgtatattgggagtttactatgtgccagccacatacatgcgttattttatttaatcctgtaggtggtgtgagagtagatgtggaaaatgaggtccaatgcatttaaataatatgcccaaggtcacatagcctgcaagtgtacagctggggctagagctgccatctgattccagagctcaggctctcaatcactacgctacactgccgaggaatggcagtttaagaggtggaagtcgtgtgacatagtaacctagaaaaagagaggtaagttatttgaacacctggacattttgtttttccatcaaccaggaagaaatattgagataatggatatacaatcatgcatcacttaatgatggagacacactcccagaagtgtgttgctagttgatttcatagttgtgcaaacatcatagagtgcacttacacaaacccagatggcatagcctactacacacctaggctacatggtttggccttttgctcctagagcacacacctgtacagcatgttattgtactgaatagggtatttgtaacatagtgatatttgtgtatataaacatagaaaaggcatagtaaaaataccatagtataatcccatggaaccatcactgtatgtacagtgtgatgttgatggaaatgttgttatgccgcacacaactatacatttatccatcctcaaacgctaatctcctaaagagaaatgaaagcacatgtagagttacttggtaactttttattaatccaagaaagttagttacatgatttctaaatcactcctgttcggtataagtggaacctaggggttttgagagtaaaaaaaggaaagttaaagcagtggcagagaaaggctaaatgggtttggcacgtattcaactttgtcaaagggaatgtgaaggattgcagttcacttttcatgccaaggcatctgtgatgatggagagagtgatgtcatatggtttggcaaattaactgcataaccttgaatgtagtcaaggggcttatcctactcttttttttctagttaaagtgtctctaaggttggcctttctgacatcgtggccagactcatacaggcaggacttaacggaggctaaaatcattagtatacatatacatacaaatacttcttcagatatgtattttctgtaaggaatccaaactgtaggaaaaggataaaataaagtttttagtaaggaatatattttaatggaaataataatatagtacccattagtattcatttcctttaaaatatagatgatattatctttataagacatggtatctttattttattgactataaatgtactagtgaaatgtttcctaagttaactcttgaaacacagattctaacactggtattgtacagaacccaaccatccatgttggagagtgtctgtgctgctttaattagttctgatgtaataaaccgtttcatgtttagcattttagatttataatatggtctagttggcttctgactacagatcattgagtgaatttatatccaattttaaaattttgacaagtaggtgaaaactggaggaacgacaaaggaacattttagtaaaaccaagaaagacttgtctttagtcatggactgtggcactaccacttatttgagacccaggcgagacttgcaagcagatttaccacagtcagggtccaaagttaggaagaaaaaaagacatgagaaaagttcttcttatgtgaaaagtatagtagtccttaggtacataaatcctccttggatttgtgattgagaattcagttgtactgcttctttgcagtaaaccttacttttaataatgtgatagcttttttattttcaaaaaatcttccttttgaattgtttttagaaattagttttggggactagaggcctggtagacctacaagcacagattgaatatcccgtatccaaaatgctttggaccagaagcgtttgggattttggactttttcaagttctggaatatttgcacatacatattgaggtatcttgggagtggaacccaagtctaaacacgaaattcatttgttttttatatacatagcctgaagaaattttatacaatattttaaataattttatacatgaaacgggtttatgttaagtacttgtgtagaattctctacttgtagtgtcgtaacgatgctcaaaaagttttggattttggagcactttagattttgaatttttagataaggaatgctcagtctgtacccaatacttactatttctaatgttggggaagccagtaattccaaaaatattctaaactttttctttcttcattaccttgaacttaactcttatattgtcattcatcaatatatgacccatcatttagtaatattttagaaacgtaaaaggagggatgggctcaaaaagacaagatttatgataaatttcttcagtgaaactcctcttaggaaatgagtattagttccactctcccactgtaaacaggagcagagtaaccacactgatcaagagttggtgcttcgttttgtaggtaatttattttcctgggtgccaagtggtttttatatatggagctatggtcataacttaatggcaaaaaatgaagcataatgctaaaagaaaacatagttctaggagaaagcttgcttttaatacctgtttcttctagaagtgaataggactttggtgtgggcagtttaaaagttggccacatcaggttttaagcttggaagccatgtttgattttgaatcttagcccaagaaaaataaataaattatttattccaatataaagatgtttggaggtgtcagtaattgacttatttagcagcaataaagcaattcagataattttagaaaatttacttttgaggaggaattctaataaaggataatttaaacaattacgtgtgagaaataactatttactgaacaggaaatagggttgctataggtggtttgagtttaaaactagagatttgctttgaatgtagttttttctttgagatttcagggtgaaaattgcatggctggagcatgacccagaaacagccctgccattgattgccactgggaatacagtaattgaagatttgcctgtgttgattgactttcagtatctgattacagaagctctgagcaatgtatcttggtcttttatctcctttgttgcctcctttcagaaatgcttctaaaatgtgtctggtttatctatagatttttggattcttagaaggccacttaaccatttctgtttagtatttaccagttcaatcaatatgaatagtaacaaagaaaacctgaattaaaatgtactaggattctgagactgttatgtctggtatataatatacttctctaatttattctttgtagaacctcatctctataaacgcttgtgttgaaatgctttttggtcttaagtgatggaatgacagcctgtgccaggacattgtagcttgtggatgcctactcttttcaagtgactcatcggtacaggttaatattttgagtaaatctttcggaattaaattcagtactgtcaacaatgagaatctggctagtttatgtagagcttaacagaggcagaatatattaatggactttagtgtttttaaaaaagggacattggtattgtacgctattctatacctagctctaggggtagcatgtgcagtatggattatttatggtccactccttgccacaggtcttctgtgttacctttaaaaagctagggtagtgctcggctgactgtgccatctctgtatggattttctgtttatttgttttataattttgttttatagaaactatagtatgatgtcagaaacattggtggctggattaggtacagtatgttggaaaagagaaatgtgttacctgcttaacaggagtacagtttgactcttctgtttccccgatgtgttaatctaatgatttgtccttgatggtatgggagtagctggtgagaaaaaggaagggaaggaagatgaggtaattgtcctgaattgtccttggataaaggatctaacttcaagtctttgcaaatgacaaaatgagaaaagtccacaaggcatttgagaatacctcttctgaataactcagtttaggtcagagaattttatttcagctcacgtaagaacttcgtttgtttccagtgttccctgtattttcataatcaaaccgtagcctctgccttttgatgttttgttttggtcagcactttggttctatgtattcatgtttttgttgccatttttgatttagtgtaggatttgattaatgactgcatacattttaaatgatgtcacattgaaatgtacatttgcacaaatttatgtataatcagtaaacatatgtttttgttctgtttccaagatgcctgtttggttgtagttgtttccattttgtcctaggttaaagaaccttagctaatttcaatcagccctgagttgtcattcctgttcatcactgtcacattaacatcattcctcttcatcaatgtcacattagcagcaaatctgaacttgctgattagtaaagaggatggaaatcacagctctgtgtgtgtccaaatagctactcatcagcaaagcttgtgatggggcctgatggtttaatgcaggccttaatcaagggctaggaaatgttttctctgcagtttaacctagtagtattgaattacattaacatgtatatacactcgcatacacatacatagtagtgttacatcaatgttcaaagtcaatcaggccaaatcaaacaaaagaaggaaataaatcttgaagatgactttttttgtgattttagtcagcaaacataaacagcatattttcctttggtctcattgatatcctcatatccagctgaagaactgcttgattaaaagtatgctgtctttggtgacgtggactgaaaaagtatggggtaagcggggtgaattttatgcttggagctgttattatcccatgtggtatctgttgcttacttctcagtgatacttgtatagatgtgtcaacagatttgatgttttgtgcctatgaggcagaatacttaaaagggcatgagagtcattacttggagacgagatgggccctcatttgtgctcacaatatctgtgtgagcacgtggaagaaccgtattttattttttgaaaacaatctttttgagtgtcaaatgcttatctgttgagagcccactgtaaaactgaatgtctttgtggtagttgacatttgagatgatgttttttaatgcctcattgtgggaggttaagtgtcattatcccgattttactcatgaagttctgagcaggtaagtgacttgtccaaagttaccctcccggtaagtaaaagccagaccttgaatgcaggccttctgacttcagctacagtaattttgtctttcagccgtgtaacagctgccttgtttatgtggctaacatgatgctagataattatgagaagaatttcatttaaaagaattcctcatacctggaagtttacaatcctatctgaatgaccacagctgtgtgaatcctaacttcagtcaagataagcagtaatactggaaacactgtagaaagcaaggatggcatcacagtgtctaccagcattctgtgggaggattagaggatttgcatgcagaccaagagcagcctgagtaatcaggactctggtactgttttatggaaagcaatttaatgcatatttttaaagcaatatcaactcttttatatgattaaaaatgatttctaccttatacgttttaattttcttttatagatttcagccctggaatcatacatatctatcctccacacatgtcattttcttcctctcaaggctagtggtacacgtttaaatatttccagcatacattttgttgctgttagaaactatgaataagcatcatcattttcttccaagatttctgtcactgtcaacatcatctctttcttttctgatggctcacattaatgcaggcagtgctaacacatttgtttcttttgtcttttatgacagtctgagttttaaaactttgcttctattctgagtttagtagtttttgttcagaaatgaaactttgaggcagcagcatcaggtaatgggaagagtgtaggcttttgagacaaagacctgaatttggattcttgctgctccacttactagctttattgagttactcaaatactcctagtcacactgtcctgttcataaaataggggttggttgtgctattgtgaggatttgatagggcaacctaagagaaatgcctgccatggtcccttactcagaataaatgttcaacaaattacaattctcctttatttgcagtactgtttctcatgctttttaattagatattttactccctctgtttgcccctccctcctcctctttttcttcttctctctctgtttacagccccgaagtcctagtaattcttgagatcacgtacatccactttgaagtttactttgaccatgctctgatcatacaaatagtatgtttccagccagccttcttcaaaatgttgctggtagcaatttttatcacactactttttccagtcatacccattgtctaccccgttacctattttatctgttcttgtttctttctttcttgtcagtccattttaaaggcctccttatctagttgacaggcttcctttatcctggctatgggagtaggtttggctgtgaataacagagactcagcataatagtgatgtaacaagacagaattttatttctcacatagaagtgtgggagtcaagtgctggtgtggggactttgatctgtcttaatgcttcgtcacatgtgtgctccattcctaaggtcccctcctggtccaaggtgggtacttgaactcttactattgtatctacatattaggcagcaggaagtagatggggcaggcagcaggaagtagacggggcaaaagtaagacatatgcttctctttggaagttgcccacactgactaactcttagatttgattcgccagaactgtattacatgactatgtctagatacagtgaagactcagaaatgtatcctgtttcaattatctacatgcctaaaaggagagaatggctatttgaggacaactggcattgtctgccttgttggtaatatgtgagatgtgctatatccttagccaaggtttcaggaaaccaaatcctttaaattcacactgtttatatatcttgatttttttttttctttgagatggagtctcactctgtcgcccaagctggagttcagtggcgtgatctcgactcactgcagcctccgcctcccaggttcaagtgattcttgtgcctcagcctcctgggtagttgggattacaggcacccccccccccaccacacctgactaatttttttgtatttttagtagacatggggtttccccatattgggccaacctggtcttgaactcctgacctcaagtcatctgcctgcctcggcctcccaaattgctgggattacaggcacgagccaccacgcccggcctaatttcatactatatagttatctattgttgtcccatactttatctttctaagtccacactatctatggacatagaataccacctgtactctattttgttcattttcttgccgagagaaaagtgtttcttctagtcagattctttgttttctcctgaactacccaccatggtcagtgactgtagtcttaagactcagacaaatctagcagaatgccatattggatttttttcccccacattcctctgaaagtagtccaacatggattttactgttgttttaaaccaaaataatggtagtataacactctttcatttatttttatcaaagcatctgtggaaatatattccatttttcaaatatatcagtgctcaagtgtcatcgtgaaagaacaactaaccaaactgtattgaagatggggttgtaaagagttttacatgttgatcacaataatacatatttttggttcattttgttttcttttataaataaatgtttcctttctttagtaggaacaactacaagagctttccctgttttttttggtatactttcttgtgactgacaggtatctgaggccataagagtatttttattttaaagatgaggcaattgagttcagaggttggataacttgcccaagaccctataacaggcaagcagcagatcccagaatcaaacccaggccgtttgaattcaaattcacttcctttttcactatggtacaagaattggaaaataagagcattcttttgcatattagagactgaattatcaaaattctttattgctgttctttcattatcggtcatccttcatgggagagccctcatctctatacagtatgattcagctgggatagaattgtttccctttatttgctgttaaatggtttcctttccatccgtagcttgacaaacatctcctttctggttcttaaaatattttactcttagaccttttcccctttcttctctgattgaatgcataatattctttaacagttgtatatatgctctcaaggaattttaaatctcttcagggacacataatacatgtatgaaaaaggatttgtaggaaaggagtggcagctcatgcctgtaatctcagtactatgggaggctgaggctggagcatcacttgaggctgggaatttgagaccagcctgggcaacaaagtaagacctttgtttctacaaaaaataaaaataaaaaaataaaaaactcaatcaggtgaggtagcatgtgtctgtacccctagatagccgggaggctgagggaggagaattatttgaccccaggagttagaggctgcagtgagctgtgatcctgccactgcactgcagcttgggctacagagcaagaccctgtgtcttgaaagaaaaagaaagaaagaaagaaagagagagagagagagagagagagagggagggagggagggagggaaggaaggaaggagggaaggaaggaaggattacacttagctctgtgaaatagcttgggttttttttttcttagtcttctttattggtacatttttaatataaactgctgctgatctgtcattctctattctggaaatgtttacttcattgtctgtctttatcttttacccaggtgtcttgtacctgtggtatgcttaagcctctgctctacctcattacttctagaaagaacaattttatacctagacacacacatacatgtcttatattacagagagtgagacagagggcagtgacagagtgtcctgccctccctgggaatggacagagcagcattctttctgtcctacttaagcaatgtgatgcttcgatttggtatgagacttttttttttcttgtattgtcttctttttattgttttattattttattgtctgacaaaaatggccgtctctcctgtatctctttttacccttaaccttttctgctgggttgtatttttttcctattgcataactgcaatgtctgaaccttaaattcaactcaaattattaactctgaaatgaacttcctttggcaagactgattgttaacagagttctagatctcagttgcattctcttccatgttgatttaagtaaagacaggctgtcttagtacctgttaatcaagaataggaaagtctgtggggtgggggggtatatatattctctctaaaagctaactataaaatcaatgtagtagcttgcatgatttaataacttggaggttttttttcctttttttgtgtgacttagcagtttttaagtataggaaaggaaattataatatggttttataaaaatgaaacctgtttgaagatcccatcattgatggggcctgaattttttagttggtctttgcgaaggagatcattgctctgtgaagtttatgaatccctagacctgagaatttctaccattatcttactaaggaaatgtctatatgctctcccagaagattctaaggaggcatgccctaggggcacatgtgctgtagaggtaatgagttcactggaggaaatctcacaatcccttcttgcttgatgattttttgataattctgtaattcaggtgtgaaaaaaaaatcaccaccagcaacctctaaaacctgggaggagcagttcgctatttgctggtagtagttttgaggactttagaaggaaggcactagataaacataaggcattttttgttattactattgccattacttgttatcatttatgtagcacctgcttcactaatgcaattgcttataggagctgcaattttactcctgatggctactttctgtcattatgtaatctgtggtaaaccacataccatctaaatgttgccactggatttcttttttcttcaaactccagccctggaatactgttgctgtcctatttgtcaacgaaccactaatagaaatttcttaggaacatactgtactagatgcctaggaaaagaaaatatattaaaaaccagtgtaactccaactgattaccccatcatagttcttattacttcagaaaactattaaaagaacactaataagttttccatgcatgggttcatttttataaccaattgctaaattgctaagttgcctttttattcactttcaaatttacaaacaatttccaagtctgtgctttcatttactaatgcaaagctctttgcatatatatatgtatgtgtgtgtgtcctggtaaattgttatgccttccttattcaatagctttgggtctcttattctgaaaaattcctgccagcagttatcaatttgcatgttatggaacaatgtattgacctgatagactttgccagttttacttgcaaagctaatagcttcccattatatagtagagaaaggctttgttacatagacacagttattaattctctatttactgctcatcagaaaactaaaaaaaattttgttttgaaatttggaatcttgatgtttggaatatttttacacaatgaatcgaagcacttcttgctatttccccttttttgacgttattaacaattttgttttttttaattctaggaaaaggaaaggttttacattaagatatgcaataataaggaaaaccgtggcacatctgaatatttatgtctacatgaaataatctttgagaaaatacatttttgagttatttgtaatatagtgtccttaggtttaattaagctaattatagtcattatttacctttttcatattgaaaatggttctccatattttttcaaacaatttgagaaattgtgcactatgcaggaagtatcagctagaagtatagttaggaagtatcagttgccgtttctgagaacctatgcccaaatggccttcagcttaatttttcacgtttgaatattggtcactgttacctctccattctggggcactgtggttagaatctccctgatagctatagaaactgttggctgtaaacacttgggaataacgatgcatgatttctccttaaatagttgcctcataaataactactttcaggcatgaatcatccaccaaggtatatttgtttttatgttatgttacgttacattacgttatttattttttgagagagcatctcactttgttgcccaggctggagtacactggtgtgatcatggctcactgcagcctcaacctcctgggcacaaatgatcctcccatctcagcctcacaagtagctgagactacaggcaggcaccaccatgcgtggctaattttttgtattttttttttgtagacatgggggtcttactatgttgcctagactggtcttcaactcctgggctcaagtatatttgcatattaaaggaaaattcttagtggatgttggcctctatttggtgaatgaataagcagaatgatagatttaaaaattcggggtaatattgggactaattttttgggaaagaagttttccccaggcactgtaccctgtgtcatgagtgaggggtgggtgtccagtgaggaattccagcagaggctgaagtcccatttgtggtggtcatacacttttgctttccggtagattcaaggttccagggctcttgttaggaatctttttttaggacacagtgtaagtgcattttaagaacttattttaaaaattattttgaagcaatgtgtgtacaggccaagacccttggccttctgaagattcactgaaaattcaactggcaaaaggcagattaattggagaaaaggcagacaaattttatcttgtgtgtgtgtgtgtgtgtgtgtgtgtgtgccttcagaatgaagacccaaagaaatggaggaaattgtccatttttatgtttaggttcaacaaagtatagacaatcatgtataattatgattggacaaaagagtatgatcctaattctcatagaaggagtggggaaatccagcaaggcctgtgtgtctctagattcttcctatcctctctgagcatgcatgccttccttctgggtgtagggcaggaccctttctggaattgggcaggggaaggttttatgacctatagtgaaacaagattggtcagataagttacttttggccagtttttacacagaaatgtggagagaaagttagggtaatatttttaggttttatgactggccttggggtaaaggttctggcttctgtgaccagccttgggcaagagggattctagtttctgtgggtagccttgggggagaataggactgaggaggggagaagatcagagaaaaagcagcttctgaggccacttctgaacccttcattttgggggtattgtcttctgagccctaatacatgtcacttggagagggcccacttaaaggtgttcagaaaatgatttgaaatggtttgaaactgatctaatgaatggcatttaattctatgtttgattgtcagtaccattttagtttttcttctatgtattcagaaaaattttattttttttttgaattgttggatgcagaataaaaacttacaggttataaatgttaataatattaagtgtgtttagactagaaatatgctaattgactgcctgaagacgaccatagctatcaaaagaatgttttgcttattttcagttatcccacaaacataacagcttgaatatattgagaaacttgagctttttagatttgtccttgaactcttgattggctttgcaagttgttttctggatggtgtggtaaaggatttaataccctttggtattgattttaaaaggtaatgagaattttttttttgatataatcctcacaaaatatactttgtgtataagttgagtgtcctgacataatctcaatagcctaaggttttcccctaaggcaaatttttaggtttctgttcaatatttatttaagctaattcaagcatcgatgatataatttaattaattctgtttattccacccaagctcttatcagttgatattccctagtgttgagtctcagaggagtatttttatattttcatctctatattttatatttatactgtgggcattttttcccctcattttacctggtctcttaattccatttctcctgagttgctgcccccttgaacagcctcatccatccttcatacaacaagctttcatatatttaataactattattaggttatccttatgctgtcatttcttcagccacaataatcccagttcctttaagctttatttttatcctgcttttatctagcctttaatattttagtggcttcttctagatcttctttagaaaagagtggtgtgagattataaaacgaacctgctgctagaagtgtgcttgtcacttctcctctatagccgtcaaattctttgagatcctcaaactgaagcatccatgggaacatttattatttgttcaaatatggccataaaaatcgactttgcaatcatattgagtcatcttgacagtgctgtgagtgacagaaactaatcttatctgctggctagcattttaaaaatgataaatggaccctcagtctttagtttgcctgtaaatgaaattaggtttatcttatttctcccagaaatagcattacttagaaaattttgaattatttctttctgaacaaagttaaatggcccaggctaggggctaaattttgattattattacatacatatattttttgccttttatcagcaaataatggtgcattgggaaaattcaagtattaagaaatcagcatatattttctaaacagaacaaagattcctcaccatctatacttgcagcctgagaaatatatgttcaaagtaaattttactgaatatttgttctttgaatttttttttcagatctaaaataaagttccaaatcttgataatcacagcacgtttaggactaatgtcttcattgttttatctgtcttccttttagttgcctaatcatttaaagatcaaattaaattgaaatctaatataattcctgctggtaaagtgacttttatagtaacttccaccatttatttgttttcttagtaggaaactgatttaccttacttctacatgtgtttttggtatctttattctgaaattgtcttttctttgtcaatcaggatctaggacttcagaacccatttgtatcaactcctataagaaactaaattaggtcacctaacagtgtcaaatgcctttttcttctgcgttttcactgacattttagaactccaatactgtcatactgtcatttttttctttcctctattcttaatctctaggaccatgttagtaagtttgttagatattttgtcaaatgtgatttttaaccaaatcgagggaattaaagcaataacctttttatgttctgtttctaaagcaagaggacattgctgtgcagggttgattttttgaaaaaccttgttgtcttccacttgtaggtttccttccctttttttttttttttcccctggtcactgtttttcagggctctttgtatcttgtacatgaaataatatgaaaagaagatttgaatgaatgggaggataactcttcactttttgtctcgattattatgtttttaaatttcatttcactttgggcctttaaaagcatatgtgtgtgtacgtatgtatgtgtgtatgtatttatgtgtttagtatttggaaatttgtgagggatgaaaaggttacttcaacaattcccttgtctatgtggtcgctatttctctgccaaatactcataaatgagttattcttttcctcccccactcttgcattatagaagaaaaaagtaatgcctcatttgttagtatcattaagaaatgaaatgtctctcaaaagttaattttccagataactaaatcctacctctgggaatcatactagctcctccatttttagatgttgaacaagttataaatttcactgaccctccatttcttcttttctaaagatgtgcatgtaatacctattttaatgatttgttcaggggattaaataagtgtaaaatgcctagaaccgcagaaaacttagtatttttgagatatcaagaaaactggataccttatagctgatcaataaatactaggttctttcccttttcccattaaatgccatatcttgatttaaattatctttttcttatttcttcctacactcatagtcataaaatcagttagattttacattcaaattttaaaaaattttcctttctgtatttattacagattctccagttcacattctctttatcattcacttgaaccattttcaatattaaagagtcttagaagcaatctagtttgactactgtcccaatagttgaattctgtctgcatcctttcttcaagttactttgcagtctatatctattgcttaaatgtgctggtgctagtttgaccctatataaccacaaagaatgtcagatctcagtttcatgtggcacccttccaatacatgaggatggttggcatgttctcactgagcctccctttttccaaatgaaaatccctgattaccaatttatattttggggtttccagtgccttgacattcgggttactatttcctgctgcttcagttggtttaacttgctcttggattggaatggattctagtctagatatgatttaaccaatccagaggagagtgagatgattacttctcttctagatacttctgttaatgtagcctgatatcactctagataatgttttatagccagtcactctgttgattcatagtaacttttaagaattctttcttatgggtactgtttttaaactatatctattttattttttaagatcagatttattgatatatagtttacatacagcaaaatttcaccctttttataatagctggaaaactttttttttttttttttttccgagatggagtcttgctctgtcacccaggctggagtgcagtggcacgatcttggtcactgcagcctctgcctcctgggttcaagtgattctcctgcctcagccccccgagtagctgggattacaggcatgtgccaccatacccagctaatttttgtattttttgtttgagatgaggtttaccatgttggccaggctggtctcaaacttctcacctcaagcgatctgcctgcctcagcctcccagtgtgctgggattgcaggagtgagccactttacccggccttagctggaaaacttgaagagttttgacaaatgtatacagtcatataactatcaccacaattgagatataaattgtttccttccttttcaaaagttccctagtatccctttgcagccggtccatttccccacccccagcctctggcaacctgattcctgtccatataattttgtattttgtagataccattctattcttatatggttggcttctctgctctggtataaaactttatttatttaaaatttctacatcttagtttggatacatagctctagactgtcatgatatttttaatcccaattctgtttttattttcttccctatctcataacatgcataaatttgatatgcattttagctgatcctccatgttattggggataaaaggccaaagataagagccaacgaggaaaaacccacaaaaattccttatttgacactagacaacattatcgaaggtgacatttattcattaatcattctcttttgatattgtgctttaatccactaaactttattattgttcagttcatacttatataggcatatgttggaggtattccaggttcagttccagaccaccagaataaagtgaaaatcactatatagcaagccacatgaattttttagtttctcagtgcatataaaagttatgtttacactatagtgtagtttgtaaagtgtgtgatagcattacgtctgaaaaacaaaatatatatcttaatttattgatcagctttattgataaaaaatactgatgatcatctgagccttcagcaaattgtcatctttttgctggtggcgggtcttgccttgatgtttgtggctgctaactgatcgggatggtggttgttgaatgttggggtaactgtgccaatttctggaaataaggtaacaatgaagcttgccctatggattgactcttcctcttatgaaaaatttctctgtagcatgccatgctgtttgatagcattttactcccggtagaacgtctttcaacattggagtcaatcccctcaaacgctgtcactgctttatcaattaagtttatataattctaaatcctttgttgtcatttcaacagtgtccacagcatcttcaagagtagattacatctcaagaaatcactttctttgcttgactataaaaactccttgtttgttcaagttttatcatgagattgtagcaatttcatctttaggctccacttctaattcgcttgctgtttctaccatatttgcaattacttcctccactggagtcttgaacccctctgaatcatcgatgaggtttggaaccaacttccaaactcctgttaatgttgatattttgacctctttccataaaccagaaatgtttgtaatggcatctagcatggtgaatcctttccaaaaggttttcaatttactttgcccggatccatcagaagaatcactatttatagcagctatagtcttatgaaatgtgttttttaaaataataggacttaagaatccaaatgactccttgatgcacgggctgtagaacagatgctgtattagcagacatgaaaacaatctcgtttttatgtcaacagtgttgacatttcactagtgtttacagcatcttcaccagagtagattccatctcaagaaaccactttctttgcttgactataaggactctttgtccgttcaaattttgtcatgagattgcagcaatttagtccatctttcggctccacttctatttatagagaacaagcagagtagatttagcataattcttgggggccctaggatttttagaatggtaaatgagcattagcttcaactttaagtcaccagctgcattagcctctaacaagagaatcagcctgtcctttgaagctttgaagccagccattgacttctctctagctctgaaaagttctagatggcatcttcttccaatagaaggctgtttcatctacactgaaaatctgttatgtagtgtagccaccatcaatgatcttggctagatcttctgaataacttgctgtagcttctacattagcacttgctgcttcaccttgcccttttatgttatatagatggcttctttccttaaacctaatgaaccagcctctgttagcttcaagcttttcttctgcagctttctcacctctctcagccttcaaagaactgaagagagtagagccttgttctggattaggcgtttgcttaagagaatgttttggttggtttgatcttctatccagaccactaaaactttcgccatgtaagaaatgaggctgttttactttcttatccttttttcttggttcactagagtagcacttgtaatttccttcaagaacttttctttgcattcgcaacgtggctgtttggtgcaagaggcctgtcttggctttctacgtgccttcctcactaagcttaattatttctagcttttcattagttaattagttaatatgttttcttgagacagagtcttgctttgtcacccaggccagagtgcagtggcacgatcttggctcaccgtaacctccacctcccaggttcaattgattctcatgcgtcagcctcctgagtagctgagattacaggcatgcatcaccagtttggttttttttagtagagacgggtttcactgtgttgttaggctggtcttgaacccctgccctcaagtgatctgcccgccttggcctcccaaagtgctgggattacaggcatgagcaaccacgcccgtcctctagcttttacagtgagagacgtgtgacttttcctttcacttgaacacttagaggccattgtagggttattaattggtatattttcaaaattgttatgtctctgtgaattgggaagccggaggagagagagagagatgagggaatgatggccagtgagtggggcagtcagaaggcacacatgcattgattaagtttgcagtcttgtatgagtgtggttcgtggtgccccaaaccattacaatagtaacatcaaagatcaccaggatagatataataataatgaaaaagtttgaaatgttgcaagaattatcaaaatgtgatacagagacataaagtgaacacaggctgttggaaaaatggcacctataaacgttctgggtacagggttgccacaaaccttcaatttgtaaaaaatgcaataaagcaaagcatacttcaaaaaacatgtgctggtacatgtattttaaccaaggacagcacaagaaatcttggcagatgtcatgttgaaatctggaacatgactttaagcctagatttccattacataaaagtctagtaaccttttctgcctactaatgtgactttgaaagtatcatctggcacactgtttattgaaattcacatttttctttgtcatttttgttctttcacatttttaagtttgaaatttatgtgcctgatactttccatagccataagttgtacaaaaccagtggattttgtttctcagttggctatttcttatgaatgaaatcttctctaaagtatatttttgtatttgaattgaagccatgctttttgttacaaagcccttgttgccttcattaggtattaaacagccctacactggcagggagaggtgttacgtaggaaatcatttatattaatcatttatatttactaaatgagccctctgagagcaggcaccgtgtctcctttgtgtactaatgtgaccccagaatcaagcacaatgccaagtacatagtaggtaccttcaaatcagaatctctgactctagcctaaacctctttcatacccgaatgtactgtattctgttgtattaaatatcaggccctgtttagacttgttttattatacatttgtggctattactcacaatagcagagttattcttcctgcaggaatttaaataataaagattttcttgaaaaatgtaactctaagtttgagactataaaatctatatctcagagcaaatctagcatttaatgacatctagcttttgctcaaaagtaatggccttactgtgttttattaccaccaacagtattataagtataaggctttttatactttcctttatcactcatttttattaatatcagaaaataagagataagcgtaagcaccaaccttaactgagatgcagttgcaagaatactgtccagagttccctaacttcacaaatgagggcatgttcctagcttccacattagaacctgtaatagcctttttgatttaacattgctggactaccacccccatttattcagcaaaacactaatttaagtgctgctgcaaaggtattttatagatatgattaaaatccataatcagttgacttcatgtatgggagattatactagatactctaggtgggcccaattcagtcagcaaaaagttcttacacgaagagttgtggctttccctgaaaaagaaatttcatttgtggacagcatcttcagctgatttccgagacttaggccccaccttcctgacagcctgtcctaatgatttcgtacttgcctacatagctcccacactattctaagccagtaccctgccgtgtatttcttaatctggatctccattggttctcctcctctagttgaaccctgactgatatattacccaatcagaatgatggctcctgataattttataagaaatagtgtgatgctaagcatgattcctagttaatcattctattcctatgcaacatatcaaaaaagacccttgttgcatgctgaattcttggactaaacgtactttttagttgcacagctgccacaaaccttactattgtatacttgctgattttgtcatttgattttttttttaatttctaggtttttctaaggatagattcatcatgttatttttcttgtctagagtacagagaaataatattttgattattttagttgtttcaaaattgctctcttttttggaaggagaaacgtaactgccgtgcattttactgtagtcagtagttaaatgtataacatgttagctcaaagattaaaatgtgaatattctagagcacgagtacagagagttgatacaaagggggatgtcagttgctctgaagttaaattccaggattctgtcacatgctgatatagtgccaaagcatatggatctccatatggtgctgcttttggggtttataccacctgtaatctagctgattttcattcacttaaatttgtccaagaggtaagcaaactaaataaggaaatgaaaataatatgcctgtgttaaaatgccgaagtttgggatgagttactgttattacagtgattaccaagaaaaaaaaagattgattagaggagtgcattagtaatatagcagtagtgtttctatcacctcattaacagcagggaacagtgtatccatttctgactcgtggagagggaaattaatttttttattttattgagtcttcgtgagaagatggagttagatcattttggacatttttaaaagtaatagtaatgaatataaatatgttttcatggttcaggaataatgatattgtgaatggcacttggcattttgattgaatataaaaagtaataaaactggttgcattctgactacatgatattgcagttgttttatatcattaagaacctttgatttcagaaacagagaaagaaaaacatggctcaattgaaccatggtattcagacctcataaaaatgcttctctaagcttgaggcagagttattggtttatgtgtcagctagcattgttttacattgcatcttaaatattttaggctctcttcaaagcagctgttttaatagacagggcagaaatcattgaagatgtctttgtgttactgctgtcacgcaaaaacaaaaaggtgctacttgtctacagtctagcagacatttgacatttttaactgcaggtgttttattaatatccaacatgtgagagaaattgagccataattattgatatttgaaattacttcaaaagccatctatattaggcattacctcctttcaaccacagccacctctagggagagatggcagattggactgtttctgcagactctgtttgctgaaactcagtagtgacttagaatgggagtaatgaggagggatagtttccttaactagtgatagaaatgatcatacatgtatgatcagcacagtccagctacatggaagtatctgccactgtattcatagcatctggcacagtatctggtgcaaagtacaaaacactgtattttcctgataataacaaatcatattttttcacacttaaatgtttgccattaaggtgtattttacccattaatgtgtatttttactgttgtttttggcctcctcttaaatttttattaaatatttgaataaaatgagtttggtgcattaataaaggaaggaggaggacttacctttgtaaggtctgatccatttgcttttggtataattgaaggatcattgactgggttaacatgcactgagctccagtactatccttgccatttactagtgggtatgtgacactgggcaacttacaatatctcaggcactgattgattctttattgataaggtaggggtagtattatatatcccagtttataggatgattatgagaatcaaataagataatggatatgaagtgttttataaagtgtgatatacatataaagggtattactaatcacagtgtgtctgtaatttacgtcttattttattctgactgccccaactaattcaggccttttgccatctcacacttggattgttcctatcttctgctaaatcaattccgtctcttgcttttataggatgtgttgagtagccctgaaataatgttctaaatatgttactttccttttcaaggctttttgctgtaccacctgtctactcttgtagccattatcttctctttatactccttcctccgatttcattccctgaactccttgctattcctgagctctttatgcttgccacctacgtgcctgtgcatgtgctgttatttctacctaaaatcctttctcccttctaacctcataatgtttctactcaacaaaatctgatttgtctctcaagactcatctcagatatgactttgtcccttaattttttttcctcttttgccaggcctgatgtttcttttatggaaatggaatagataatggtaggaatggggatggcagccggggagagaaagtattaccgaatttgattttctgttgttcccaacaaagtgagaggtgatcctaggttttattttgctgttggagaatttaaaattgtggtaagtttttatcgctcacgtaacatgtcaccagtttctcccgcctccacccatgtctattctttggtgcttacatttgtactttaccgatcaggggattttatgtagatctattcttattttatgtaatatagataataaatttttaatacatcatataatataaattccataggaaatagctgtttaggggaatgaagaggtgagctatctagaaagcaaagaaccagtttttacattgaaaaacctcacagtttatctgttatgtagactcctttatattagcttttcttaagtcgtgctttatctcaggtggatctttaggaaaatagtaactttacagcccaggcctattcctgagactattaaaatctttgtagactgtactactatagattgatgaaatgttttattttatttctcagtaatttaatactattccctagaaatcattcttaatattatttgagtatcaaaaataatgtaaatgtcaacagaacagccatctatgtttaaattctaagttcctaagctctttacactaaaaatagaattgttgttatacattttctcaatttaaaaataaattgaggtctgaaagagttgtttattgctctgctcgccaaccttaatctagtgctggggcagtatctgtacctatctgcctgatctgtgtttcaaaatgctactaaattgatgccttttctttgacaaaatcaccatgaatcagaatggcaatcacagggcccccttgagttttaggttttgtggccattgtcatttcctcctcattatttgaaacctgtcctttcctaggcctgctgcttcaggcatcttgtagcctcctgcacgtcacttttcatccatggagccccacctgacctttcctatcccagtagctccttagatgtaacaattggcacattgtattataatttcgcatttatacatttatgtctccaactagactgtgagatccttatgggtaagggattatgatttattaattttctttaatcctatgccttgcacattacatgtagtaaatgtttgtggaattaaaagatggattaacgattgtaagatacctcatcttgttgtttcccttaggtatagcagcatgtcatgatttctatggatagaaaatattggggaaagcagtgaattagaaatgattggaaaaattgaatctagcctgtggggtgtggattaattcctgtgacagagaatggcctgggcaagttatttatctaaataatagtgaacaaatattgagtccccctcagcctaagggactgtgctgcacttgactattctttgtatagaccaagacatctaaatagatggaaaaactagtaatattaaaatacctttttttcttggtcactgagcatgtaatggttaagaagatggtaatatgttagcgatgtgttaactattttcacaggtaagacattttatgtttcaacttcaaagattacctataactttattcttgttagctatatttttctttatagtagtttttgagtaatatgtatatgttcctgtttttatttctttaataaaattgaaagtcatttaagttattcctctaagaacctaggtttatattcagaagccctagggactatttgaaagacacacagacagaaagagcacagacttgataatcaaattgcatgggtttaaattttggctttgctactccagctatatgattttagaaatacttactttagcatctttttgctattttggcatctacaaaataatggcagtagtggtactcacctcattctggggtaattctgagggttaaatgagataatgcccataagattgttagctattataacatatgctcgatagacaagtatttttaaaataaaaattccagtttggcatactgctacatagcatgccaaatgcaattttgaattttcaaaattttgaatttttgtaccttgtatatgtaaggtagttctgcttttgtgagaagattggccagatacattaggttgtttctgatagaaataggatgtgtgcatcacttagaaaattataaccacttgacgtgatttttcataaacttcattttacctgttagttgttgcctttagttaagttgttgcagtgcagcttggtacctacaccctttaacttgtcaccagctatgttcttcgtggattgtttgttgtaactttaatgaaatctagtcttgctgaatcactaaacctgttctctcctagaaggctctttattgggacctgacagatcacctctccagagccttcagacgtcctagctctctaattcttctccataatgagttttgtgctgcatgataaaatattcatgttcaaataggttctaaactaattatctgtggccagcagtcgccactgcagtcatttgctgttagcttggctcaagttaatggcttgtatttcagtacaaatagtcccttctggctgtttcctgtcctgattcttatcctaaatggaatttccatacatatctagagttaagtcttcttcttttgaaaggagattttttgccctaccttttttcatctcattttattaagattagcttattttagtgttcagttccttattgtttcttatccatcttcaaatcctacatccctgccaaattcatgactcccacactgtccaaaaagaaatagtaaagcaccaactttaatcaaatataccatgtcagattttggaagaaaccaaaatggggtaccgcggtaaggatgggatctagtttcagtgtgtatgataaacatttctgcttagttgctagagacctacacagggaatgttacgataggaattaaccactttgggaagaattatggggctggacatgagggagataaggcactaatggaatatttttctgtgggtgttgttgaaaatgatggatgacttgctgaaggagtgggagagttcaatatcagaggactaagggcttgatcttcggggaatctgtacttagatgtaggtatgaaaagagctggagcccagctagcaaggagaccttcctgataccctgggacaggtccgtgcctggggccttcttgaatcctttctgcgtccctctgtttcagtgagtgagtgagtgactggatatgaaaggataagtcagagaaagaagatgttattaggcagatagagggtggaccacctttagaaattctaagtgcctctcacctcagcatcattgtggtcactgagctcttcagaaaacagcagctaacctaaagtgcttaactggaatgttggaccaaggagacaggtacccttttctttaactagctattagagcttttgttccacctgactttttcagaatgttgtagtcattaaactctcaaataccaccctggtttctcctccctcccccacaacccctcccttcctaccttccccttcaaataaaccaaacacaaaagtcttaggttgcattttttttcattcactatactctatatttcagttttattttgtttttaattgacatataattgacacataataattgttaagttgtgtattgattctctgccagttaaatggtatatgccatatgcattctgttaatggcctagggatttcatgggcccaaggttagtgctttgattttgaaatcaaaacgttcaatttctcatgaacttcaaattattttattttgaataaatagagtcaatagattcatagtgttagggcttgtcagcatgctggaatcacagatgtgtggtgaataaaacataaatgatttttatggcattctgaatagtaaaagtctttctgatcctaaatgcacaaatccaacattttattctctattgtacttaaaacagcacaaatggccgggcgcggtggctcacacctgtaatcccagcactttgggaggcctagacagacagatcacttgaggtcaggagttcaagaccagcctaaccaacatggcgaaatcccatctctacttaaaatacaaaaattggccaggcatgatggcaggtgcctgtaatcgcagctactcaagaggctgaggcaggagaatcatttgaacccgggaggcggaggttgcagtgagccaagatcagcactgcactccagcctgggtaacagagcaagacttcttctcaaaaacaaaaacaaaaaaccccagcaaatatgggaaattagtatgataagtgttttcccctcatgcattgtttctgacctgtgtcatatgtgtcttaatttatctgcttttttattccttgatcaaagaaacatgcctattaaaacacccacggtgaaatacttcctgaaaggaaatgctagctggtattttggttccttctcttttcttttcttttcttttcttttcttttcttttcttttcttttcttttcttttcttttcttttcaaataaaagcactttttgccctgtaatctgttataaatgtaaatcctgtgaaatatgtaagagggaaatctaataaagtatcagaattatggcttctttgaattcagctataacttggaatttaaagagttacatatgttgctttatattcattctgtatgtataacaccacaataatctatttctttaattaaatgcacaaataatagtttaagttgatgaagtacctgaggcaccggggagaggggtgtgttaaacattgactaatttaatgagaaacgtgtttaatctactccctcctttaatgtagagcgataattttggaaattacaaacaaatgtacgtattcttcaaatgtctttttattttttttaattttaaacatatagattttatttttcttttgttagtttttttccgtaggctgtgactatgcttactgaaaggatatgacatagatataaactgttttccatggagtcccgatcatcttaagatatcagagttaacacttcaaatcatttaatacactttcatttgctcagaagagaaatgctactgatgactgcttccaagagaagcctaaggggcagaaggaggaaaccctgtgcccacctatcctccagggtaatcatatgaccaaccatattagccttccttacttttaagacataggaggagaaatttcctgccttttaaggcataggaggagaaattcttgataatatatgggggctatgtaaaatgcttctcaggtttatgattttaagccgttaaaccaaatactccaaactttgaacttccactttggtgtgcatttggtgtttgtttttatctttccaaattacctgttcttatccctttaccatatttccatacttcttattgatttgtgtatatttgtatatattatgggtatcctttccaagtgtgacaaatcattttctcccagtttgttgcttatattttaaacttttatgttatctgttactatgcaaatgtataatgtttgtgtcgtgaattcttttttctttatagcttcttggtttttaaattttctttggttaagctttctctacactaatactgaaaacacacatttttctagacttcattgtttaatttttctgtattacatctaggcctttaatctatatagaatttatttctttgtaagatattgatttaatttttcctgatgtaaaaaagggtctcagtatcttttgttggtcagttctgtccattcccagtgatttgaaatgcactgtgtttcccaattccaaatgcgtaattagaatttcttgatttcagttgtaaaggactcagcttaatgagcataaacaaagttgggtaatttttaaggagagtaggcttttcctcaggaccacagagcaggtggctgtgccttgggaacaactatttacaggaactcaaataccatcaggtttcattctctttcttttttcctttgtcttcatttctcatttctttttcatatatcggcttcattgttctttctcactgtacactttttctgagtggttcctgagtgtttcatctactcagaaatcacttttttggttaccagttgaaaaatctcagatttgtgtcagttgaccttcactgtgttctggaaatgaagtcattaaaaacatagccagccctgaccataaccatgtggatgaaaggctaattcttctttagaaaaattagatagcttaggtacatatatctcattctggactctctagaagttatatctgtttatccatgcctatttcagttcagtgctgtgtcaattacgtcaattactgtagttttatgtttggcttagaaaactgtaggacaagtactttctcattttttttaactttcaaaatattactggctggtatttattcttcacaatgaaatgtagaatcagcatgtcacgttccagtatacatcccatgttttttgatgggaatatattgaatttatagctttctaagtggaaatttgccttcttattttgagattttattttattttatttatttatttttttagacagagtctccgtctgtggcccaggctagagtgcagtggcgcaaccttggctcactgcaacctccacctcctggattcaattgattctcatgcttcagccacttgagtagctgggattacaggtgtgtgccaccatgcccagctaatttttatatttttagtagagatggggtttcatcatgttggctaggctggttggaattcctggcctcaagagattctcccgccttggcctcccaaagtgatgggattataggcgtgagccactgtgctgggccaagattttttttccggaatcatggtgtgcctttccatttaaaaaaatctttcttttatggtaaagtgggctggtgtggctgtatttctgtcaaatgaattcccattactaatctctgcttaattaaataaaacttcattgaataataataatttagaaagcaaagatgagtaaaagaagaaaaagttttcttataatcttgtcatttaaggataactgtatatacatttaggcatatcatggtgctatatcttccacagagattaaatgtttaggatacaatgaattggcatttgtatcaggaatgcattcccatttaagtgaaaagaaacctgctaagagtatgattttattattcataatcaaagaggtttaaagatactagatcagtgactcagtaaagtcaaagatgattctgtacagttcttttggccttgctctggtagtcacaagatgactgctactaggacagtcattatgtacctggttgaggcaagagggtgacagatgtttgacgtcagtttgttcccttgttgtcagtaaaacgaaagctgttttagggtacctctgtttctgcctggtcacatgaactcttctccatgcaggtaaggttgacaagcaagcacatggctttttaatctctgttgtgggaagtgggattggattggcctttaggtagccagtcaacaccatctgcctttgcaaataaggccagaattactcttgatcttaaattttacaagccaagtttttagacagtggataagttcttccacgtcttctcaaaccagtgtttttctaagccccttaatttattcatttctttccctcagtgatttccaggaagccattacccctatttgcctggcacttatacagtgcggaaaaggtcctgaaaacccgaaaaatcatttatagtgtgttttccttcatttttaaatgctatttcttgattgcctaagactgaattgccttgggcattcctcactgagctggaatgctgactctacagcaggttcttgaataacattgctttgctataacgttgatgagaaaaagaaattgattcctggagggccccactgtctgtgtgaagttaacacattctccccatgtctatgaattttctccagatactccagtttcctcccacatcccaaagctgtgcatgttctttgaattgtcatgtctaaattatcccagtctgagtgagtgtgggtgcgtgcgcgtgccccaagatggaatggtgtcctgttcagggctagtgcccgctttgcgccctgaactgccgaaataggctcctgccacccgccacccagagctggattaagcaggtaaatatcttacttggtgtcatttatctcaaatgtatgcatagctcacatttatttcagtatttaatattagtgtttttgtcttcatttagaggtttggtgatgtttttgcaaccagaaatatgccataacaactcagctcttgtttatgtcagttagccagtggggaaattggttttgtggtacatcattttgcttaaagttgaagtttctaagaacctatagaggacattaagtgaagaacttgttgcatttctgcttatttatttgcttttactgtgaagaaatagctgaacttctgtgaagggtgcagttgcttttagtccactgtgtgctgctctaggctatccaagcccaggggttggtttctgctcctatgatatgaaggcagtatgagaattctcacagggccctagcctgacctctggattagggttctcatggtgttgctctggttcctggtttctgcaatgctaggttccccggcttgcctgaccttgccgccttttgcttccggttagtgtggttctctcaatcccattcatctgatacttccagacttgtcatttttattaggtctcattgcttcagcagttatgccattctcctgacaaatagagttctttcttacctaggaaaaatattagctttactttaactagagctgttttcacaagtgtgtgaagacctggaaatttgcaattagtttcagataagcacagctgaaatattcttgttttgtactaaggcaacaaattgaaagaaagattgagggcactgagtcattgtagtttctaacgatacaacgaatacattattgggttcgtgtatcatactgggaccttgttacttacaaaatataaaataaaaggatcttaatgtgtctttagtaatcctcatgcctcttaataagagcttttaatttttagtccctgagtcatcacattttggtattgctagccctgctgtggccaaactgaatactatcctaattaattttaataatagaaagactcattaggaatgcactggtctgctgggatgactgtggtgatgcatgaagtcacgaaaggaggatgaaatcattttgggcatttcagtgacattttttatttaaaatgtatatttcaggccaaggagcactattgtggtcagcatttgggaggctgagtgttatattttaaactgttagatttcatttgttttatttgtactagtgggttgtcacactctggcattagtggtcattttttaatggccatttctaatggcatatgaaattgaaagagactgaagtgttggaaagaaggaaagttaggtttttttttaattattaaagtatcccaaataaaaatggaattttaaagaatgtctcaagaaatgtatgcgttaaagaagtcaatcaaaattgggcaaatgagcttctgctcatgaacatctgtaaagcattgactttaattgccctgcagctgctgttggctgtgcggtttctagttttactcgtttctcctccatcttacatgtcactttatttcctctttccaatgttgcctgggtcacatgcatttgcttgtgtcgaaaaagtaagatgatttagttatttttaagatcccaaagacaaggatgcttatctgttaaagccttttcctccaagcacctgttaagagttgaatttaatctacaccagctgtagcctagttatgtgtagctcgagtaggaggtgtctgatacattgtcttctcttttcattgaaatggattggtaaaactaggcggcataagttagtggggaaaatttagatacatcttagattagatgaagacctttcaaaatagggctttaaaacatacaattcaaatatacgtgcttatacttttacgtgaattacaaattgggtaaagatagaaatttgtttctacagaactgccaggaattatattacacattgagaccactgatttttgacactggccactttgtccatttgaattttgctgctgagttactcttttgggcataattctgcagagtggaagtctttaaagataaaggaagggctgagaatgttttattcttgttgacatatgagtatgattcaaattgagttttatggaaagatcactcacttcatagaaatttttttattttacctactcagtagcaggttgtattagtccgttctcacattgttgtaaagtaatacatgagactgtgtgatttataaagaaaaagagatttaattggctcacggttctgcaggctgtatgggaagcatagcagcttctgcttctgggaaggcctcaggaaaccttcaatcatggcagaaggcgaaaggaaagcaggcctatcttacatggccggggtagaagcaagagagagaaggggaaggtgccacacactttcaaacaaccaaatctcatgagaactcactcactatcatgagaacagcaccacaggagaaatccacccctacgatccagtcacctcctaccaggctctacctccagtactggggagtaaaatttttctacatgagagctggacgggaacacagatccaaaccatatcacaggtcaaattcaagctcctattttttttgttctccttctccacttattttaaattggaaatgaaaagatggaatataagttgttttagtcattatgaaatacgtttaccaaaccaactacaccataccttaaacctaagtaaacctcttttagtgatcaattttgaaggtaaggcccagtcaaatgctgaattttgatgaccagtaggaggcagactaagatttttcactgttcccttaatattttttaagatttgtaatgtatgaagcttttgatatgtaatatgagagacaaaaaggagacatcttaattctactcttaatgagtggaaatattttctaacctgggagttactgcaaattgtcgtggaactgaaccttgaggcctgtgagcaaaggttgctaaggtcaaggtcagtagtctgaatcacagtgttccaggggttccaggaactcaaacctaacccagccaagtacagacaacctcggggtctaacatgtgagagtggaattgcgatagaaatcgaatttggtgaatagtggtgttgggatgtcgagttttagttagagttagaattagaatcccaattagtgaccttggtaaatacttctcccattttcagaaccatggcaaaatggattgaggttcaggggaactgtaacctaattaggagccaagggaggagctaattcccaaggattggacatgtgtggtgggctcgatagggaagaccataggcttagtttgctctccgaagcatgctgaatcctgagcttaaccgcctccactcttagttttctcatctgtgaaatgacagtagtcaataattatagtctcctcatggggttatgatcattaaaaagaaaatccataagtaacacgtaaaatactgccttgacatattgagtgttcagtaaatatgttggcaattacagatgctacctactcaaaggtatgggtttttacctgaggccccagagttgtttagagatcaccttgaggactcgttaaaacacagattgctggaactgaccttcagagttttcgtgattcagtagccctagggtagagttgccagataaaatacagatgcccaattaagtttgaatttcagatatacagtaaccaatcttttaaatatgtcccatgcaatatttggaacatacttatactaaaataattcactgtttatctgaaattttaatttaactgtggtaaattcattgtttatctgaagtttgaatcttctgggtttttgtttttgtttgactaaatctggaaaactgagtctagggtggggcagtttgaattggcatgtcagatgtgttccttcccaggtgatcctactggtggttcagaacaacactttgagaacctctggatacctgcagctggatggatctgaggagtatgttgacaatcatttacaaataactgtagcagaaggtgtcacattccctgggagttcaaagtatacccaagatacaaggcaacaatgttagtgtctaaatagttgcactttattgggggttattatatatttgtggttaagtctttaaaataaggaacatgagtttgagatcatttataaaggtatgtaactaagtgtattggcctatatgaaaatatagattctgtctttttgtcatgattttaattgagctacaccttcatgaatttcaaatttatagctttttaatgccaggaattatttttggggttaggaatgagagagcccagggtgaaaccttaaactcatctgtgctttatctataatccctataagtcagaagccagtaattagagtcatacaggaggcagtgtagagagtgattatttcatgggctttagagttatttctcatttgtgtagtgaaaataataatggtacctatctcataggattgttgtgagcatgatgtgcaagagtacacataaaacatggtttagcatacagtgagcacttaagtgcagactaaaataggattaggattaataaaactcaaatcctcaatttagtgggtaaattgttaagacattgttaacaaatcctctgagccaagtttgtgtttgtttgttttgttttgtttttgtgactaagaaacatcactgattcatggtagaccggaaggtacatattagaacttggttacttggtctactatacactgcagtattagctccacaatagcagagactattcttgctttgttgtttgttttatccttaatgtctaaaacagtacctttcatagaatagatactcaataaatatttgtggaaaaaacaaaaagtgactaccactggtaaatgctttcaataaactgtttttagatgattttatggttatgtgtagacaaagttgttgtatcagaagattatgttcccatggatataacaatagactaaaggttcagaatatctcaaacaatgaacctggacacataaacagaatcatacagaatgtcaagaaaaatggaaatgttttagatgtctgatgtaagaacagtcacttggtttttcttctccttttttaaccttttgatatactatgctggcttaagaaaaccagctttattattcttaaaagtaaatttaaataggcaatacattcccatgcttcagaatttaaaagtataaaagtatacatgttaaacatctccttaaaactcctctccaatagataccctgttacctttcccacaggttaatttatatcattagtttcttatatatcattctagaaattttttggcatatataagcaaatatatatatatattcttttttttcctgttttacacagatggtaacattatgaacactgttctgaacatcatttttttttcattttgtatatcatggagttttatttcttctttctttgttatggcaagagtattacgttgtattgttacaccataatttatataaccagtcctgtgttgatatgcattcatgttgtttctagtcctttgttatcacaagcaatgccacagtataaccatccttgcatgcatgtgctaatatgtctgtaagataaatttctggcagtggcgtttgcaggccaaaccgttatattccagggtttgtgcatttgtagttttgatggatactgccttagttcattttttgctgctataacagaatatcatagactggataatttataaagaacaaaagcatatttggctcatgcttctagagactggaaagtcccagagcatggcactggcatctggtgagggtcattccgtagcagaaaggcaaaaggcagaaatgaacacaggagacagaaatatgggcctgaatttattcttttattctgagctcactcctgtgataactaattcattcccgtgataggaatactagttcatgcatgaggactctgcctcttgaaggttctacctgtcaaccctcttacaatggcaattaaatttcaacatgagttatggtgcagatgttcaagccatagcattgccatactgcccaccatagtgtaccattttacacttttaccaagtaatgttcttcattctttacattcttatcaatacattgtgttaacaaattcttgactcattcccattctgatatgtaaaaatgttttagtttgaatttatatttctcttgtgagattgcacgttttcatatattgaagaactttttatatttccttttctgcaacctgtctcctcatattattttgagtaattttcagttgcctcttctttcccccttactgatttctaggatttttttttttaatctgggaatacagcaatttgagatatgagcttccaatttttttcccatttatactttggctttccttagcataatttttgccatgcagaaatatttaatctttattttatttagtataacaaacttttcttcgatggattctacatttgtgacacagttataaaagacttccaccagctgaggttataaatgaggaattttatcataattttaaaataacttttatagtttgttttacatttaaattttcaatttgtttggcaattatctaggcataggttatgaggaaatcattcgacttctgccttgcgtttgttttatttatgacttcactatttcaaccagttttcattgagtatcatttatgtaccaggaaattaggtgggtgtccctcatagagcatattaaaacttagttggatgactaggatttccaaaacaaataatgaatgaaaaagcataagaagtgttatggtagagatgtttgggaatgcatagacaggaatgattcatcctttctttgtatgggaaagaacaggactcagaataaggaaatatttataccacactcatttttgaaatcaggaatatcttaaaacagtttagttttatgaaactgaaggatttatttagaagaacagatacagtctgaattagaatgttgatgtaccgtgtgaatagatcaactgatatgattcacgtttgttaagactggcagctttctactgatattttttagcaaagtaaaaataagtaagcaaataaatagggctaagaaaactaatttgagagagtcagttttcaagatgttggagagggtagtaatatgagaacacaaacttcccaactgtgtgattttggaactccctttgagaaaaaaaagaataattaataaagatttttttttaaaaggccagattaataattaagcaagaaaagcctcagataacttgaaaggtgagagaataaattgccaggtgataacaataaagaaatttaatcatgtccacgaatgtataatactttgtacagccaataaaagcaagtaagaattttcagtcctgtagaggactttaatgcaagggacaacaaatacgttagatatgcccaaaggacatgactagtaagagaagcgcttcagttttgaaagtaagataaaatgtgtaagttgacataatctttaggaaagtgaatacagttcccatgttaggtacaagcaggcagttattttcaactagaaagatatgaaagtcttttaaaaaccaagtgtagatatgtaactttattattaaacatgcattcattcagtgttactgagagagtaaagaattaggaagataatattgaggaaagatgtgtggattatatttcaaatgtatatacgtaggtatgtgtgtgtaagacacacacacataatggtggagtgttgggttttgtttccagagaaccaaaagaagtataaaatatttaactatccttcaaattttgacagtcttttgcctttcattcatgaagatgaatattattcttttccttcgtaatcaaatgcccaggtttccaggctgcttccagtgaatgtgtggcttctgctagagattctgtattttacagattctatattttacatctctgtcaccgttggaatatgtttatgagatctgggcttatcaccagtgtacatacttgtctttctgttcgccactaatttttataagataatggcggaacgcaataaaatatcacatagttgcctagccccttctgtaccaagatgtcagtgctgccgaaattgaattgtgagttggcaggagaggctgctgtggattagcaggaaatatttgacagttcaaatttggtatacagaagttagcagtgtcaatatataatgtataatagttggcacagtgtcaatatataatgtataatagatgacctcatgcatttagagcctctgtacacttttaatattgtcaggaagaggggctgccggggctttttagactgaagattgggacttggaggtcttacagtctcaccagttagtgatcatccagtttagtcacattattttatagtaggagagtgaaacctaaagaagtaatttttctgtgtgtacaaagcaaatttggtggcagagattaacaggcaggttttctgtcttgtttcattgcttttctttcagcacatgtcgtgctctttcaccatcgtggttttcagctctcagtgtaccatgtgtgattcttgggaaaagtgcagataacctgatctccaacctcagagattttgatttagctggtctgggatatgagcccaagaatctcagatgcagatggctcttgtggcaggcacactttgagaaggctagaccatgtcatgcgtgaaactgaaatacatagaagttaaatatccaaggtcacacatgtaggaaatggggaaaccaggactcttatccactcctcaatatttttttttgatgtatggtttttcgcattctagaaattgaagtgactcactctacctagaggtttggaacaagatttaagaagcatctaaaatcaacatgatgccagttcttaggctgatgtgtgtttattaataagaagtaaaattgtccagcatgagccagctttaattaggcattttaaagaagtaagactgtgctacttaatatttgaaaattgatttaatttagaactgattatcaatggtgatttaagtattggtatcccatctttactcctgttgagcaacctgggtggccttatcttccgtgacagtggaatttacaattatttcaaactctgcctttaagtaacttagaatcttctagaagatacaacttataaacagatttaaagaacgatattttttaaagtgattattaaatgattacttatgtagctctagatcatgtaatggtttagaggaggagagaaaagtttcagaactgtgttgcaataagcccctttgatggggcttaacttgaaagggagcccttgtctgatcaaatgacatcagacagaagggagccagtgagtgtggaaattactaataaaaatgaagaaacgtgtcttcacccttttgtgccaatttctcaaaataccacagattgagtaatttataaaaaagagaaatttaggccaggcccagtggcttatgcctgtaatcccagcattttgagagtctgaggcaggcggatcacctgaggtcaggagtttgagaccatcctggccaacatggtgaatctctactaaatatacaaaaacttagccaggcatggtgtcatgcgcctgtagtcctaggtacttgggaggctgaggccaggcatgagaaccacttgaacccaggagtcagcggttgcagtgagccaagatggcaccactgcatgccagcctggatgacagagtgagactttgcctcaaagcaaaaaaaaaaaaaaaaagattaattttctcactgttccagaggctggaaagtctgagaccaaggtgctgacaggtttggctgtttggctgtctggtaagagctgcattctccagtgaggaggacactcaggggtcctgacgtggtgaaaggcagaagagtaaaagagctgaaagctgcaataattttgtttttctaagtaacataatctcattcataagtgaggaccctcatggcctaatcacttccgaaaggcactaggtcttaatatcgtcacattggcaacaccggaattttaaaagggatactttgaaaccatagcagaaggttaatgaaaaattagtatttgctgggaaggtaggcacagggattttctttgttagtgagttactgggtgaaaatatacagtggtgtatacaaaatatacaatgactgtaatgaaagtgtggtagtgtttgtgaataaagaatttaagtgtcaataggtatcaaagaaaggaggcaattatttggatggtcatacttgtgcttagaggttctttactgcaccaccccagtctgtttacttttgtttctacattgttacagcttattggaataactcagattcttgtctgaaatgctttgtcaattcctccaaatttgcaccaaggcaaacagtaaatctgaatcatagtagtgaataattgaacaggctaaaacatgaactggaaaagatgactggaactgaaaaatcaataagcttagggaaaaaaacttgtaaaagcttattcaatataaaaaaaataaatcaagaataataaatatccaagttgcttctataatcgttttactttgaacaatataatttttttttaaaaaaattgatagtcttcctgtgtgtacaggaaagatttctagcatttgaaaggttacagcagaataaaggaagtacaagcaaaaaaatacataaaaataattccttccagcataacaaaaatcgctttcatgaaatgataaactttagtgtagatacattattgaattgaagagccgttggcattccagggaagcttttggggtccttaaatgtcattccactgaaacagcatgattgtgattgctgattaatagtccaagaatagtgatatctgaatatggtctatagtgatttaaaaaggcttatgaccagcttctcatttgaaacttctagacagttttcaatttaataatcttagtttcccactatgaaaatgaggattgcttggggaaaagagtctgttatttttgaatttttgagttagacgtcttccattcaccagaaagcactatccagattctaagattatgtttcaggatataaccatatggcaaagcacttactatatataggtaatttgaaactataccagttctaaaacaaacaaataaaaggatgtggtcatgtatagcagtggtaatacatgaatagttagatcttgtgtatagttaatatgtttctgtggagttgtctgattaatacaaacaaaaaaatactaatctgtgatatataggatacttaccactttatgtatattgttagagatggaagcaaccgcatttttacagaatggcaaaacttagttctggagaggtgaattgactagctattgacagagataaataggcaccagatcttttgggcaccagtgcagataaaccatgatgctacttagaagaatagaggaagaaccagtttcagcgccagatagtatgcttaggatagcccttcactcacctcattgccttctctgataagtcatcatctctggtcctctacttaggcccatttagttgaggtatcaccagaggcagcttctgtaatggggagtcaggtacctggaaagctgtggtaatacgccccaaagtatacagtcctgtggaacttggtgcatttacagtcacgtcttctttctttcctcctttccttccttcccctctctcccctcccctcctctcttttcttcttttgaggcaaggtttctctctgttgtccaggctctgttgtgcagtggcatggtcatagctcactcactacaaccttccacccccggcctctagtgatcctcccaccttggcctcacaaagtgctgggattagaggcatgagccattgcaccttgccaagccaggtctttaactgccagcctacggtttgattcattgctgtcagcattgtaggttcctgtgttaagtacaaattaacaatgttggggacttcatgtatttctactgtgtagagagattcttcagctttgtgaaatcttaaaatacctttggttacatgttattttttccagttattatttagtatatctaaaacattttgtattctcacagtgcttcttaatatcatgagttattaagtaagactgctaataagttgctgtgcttattaatagtttgtaattattaattatttatgactgatatctgatgtaagtagaaagtgtgtaatatatataagaagtagctctggctcttgaaaagagagtgtgtgtgtatgtttgtgcacacgtatgtgtgtacatgcatgtatatgtatacatgcataatcatatactcatgtataattatatatgatttatataaatatgaactctatatacatacatgtttacacatacaccaaaatgcacacacttacttgctttcttagatatttagggaatgaattagattgaatctagattataagcttcttcactaaggggtttgcttcttgagggtagacattttctcttgttctttttacttaatagacactgaataaaacatttgttacttgccctgattttgggactgggtaaattgttatatttctctaaaggataattcaggtcagcgtactttgtgtgtgtataagccagtcactttgtctagaggattgctgagctgcaaccactgatagctgccttgaccctgaagtatctgttctttacacgaatgaagaatgaagctcgtggtcagcatgaccattgcttctcagaaatgtaaattttctcactcttgtgaatatcatacttacacctcatgctggctactctcctcttcttctcttcatgatctttctcattataactttgtccgttgcacccagatacatccgaaaagttgtcacctgcagagatgctatttggtgaagatttgaaacctcttaacggttaagagtgtcctttatcttcagcgttgatgacaaacctgttacaaacaaatttttggatgggatattgtaatacaaatgaaactgtttgtgaaacagatgacctgattgtttcatatgcgtttatattatctgtattggtgatgtgctccacaggatcagataattatgataatacacacgtgttgaaaagagatgcattcaattcacagctatggaagttttaaattgatttttttttccccaaaagaagtcagaatgtattcattttttctcgtcatttccttcttagcttagagttaccccttgtggcttcctaatttcattgctaccacattgtccgagtcttcatcacctgaaacctgagttactgtacacttaatgcttgtctctcctgtttctggttcattctatatactgtatacttcagcacacatttatttaccatggtggtgatagtggtgataagattttagttctagactagaaggcataatccatcaaaaagtgcacaagagaggtattggtttgtaatttttagaacactaactttaaaatagtcccccacccagttaaaaaataattgtggacctataacgtatacaatactgctttagatggtgaaaacatttaatatatttattgaattgaaatagtttgttgatttaaaaattctgctatgatggtaggatagggtaatgggacaattctagagaggagcacatctggtatgtggcatgttcattgtccgaagagaaccagttctggtaatgagtagagcatttcttgaaattaacattgtaataagcacagcaaagcaaagagggtttaaatcatagtggtgcctctctcctccctggcttccctgatgcccagtggtatacaattcagaaatatctgatgagtggttataacatttctctgattttcccctttcttttcttcatctccaggttcatcttaaatgaacctctccttggtcccataaggccagtctgtttttgcattcctcagttctgatttcttttggcaggaggactacatgtggttgacagattatatctgaaaagggctttggtaattgctcgttctcttcagtgactgtgttgctgacagatgggcacagtgaatattgaaagtgttctggacctccgcttactccttcagctcatgagtgctgagcactgccagcacttttcttattatctattagcaaatttaaaaagaattgcttggatctttacatctttttggacctataactaaatcacatgtatggctaggttctttcccacctcttctacccccaacccccgttatgtattttttggaatagagaaaattctcaagatgttaatgcaggctggcatgaatgggtgccaatagttcttacagacttgttaaaagatttattttttgcctgagaattacacatatggcctagaatgataatattaggatctgtgttggttgagataattggcagatcacaccttaagaaaagtgattggttggcttgtttctttcattttaatctgttgtctccgtcacagtcaaattagcattatgtagtatattactacacttaaaaaattatttaacccatttatagagggcatctgtcggttgcatttgatttatttaaaacgttttcttacatggccaatttagtaacagcaagcaaaaccaaaatgagcaaaggagaggatcccaataatcccagatctataaagcggatttctcaagggggtagagataaccacctagctattgctaaatgtgatctcactcagttgaaaaagaaacaatcagaagtgagcaatgggagccgtgaaaccatctcaatgaagacttgttgccaacatggagatagaggatattggtctacagggtactattggagaggtaactgtgaggcttttacacccagacagcccttctgtgcatggcaagttttactgaactcctcgagatttagggccaattaattcatctgttttaagatgaattcatcgggtaatgtgttttaagattaaattaacttgtttgttcttgctttccagatctcttattcactgcatgtgtgtatgtgggtaggtgagtgagagtgagaaagataatatgcccggggttggatgtctgttttcatttattattaagtagaagaagatgctcacatacttgtaggtacagaagcttcaacatagcagtctttcacagtgtgagttatgatagacgcaatctaagagtgaattataaaagtgatagggccggaacagacttttattaaattttgggtaatattgtagattagaaaagtaaaatgtgttacctctacttatctttaaacattcactctatttaatgtattcatcagacctcaggaagcttgcaagtatattctgaagttacaaatttgtattttctttgtaagtaatatttagtaatattttcctttataaaaaacttttaaagtctaaaaatgccactgtgtgtcaatgtcctgtatcacctctctctcaattttcgttctctttcttctaataactatttctaaggaaactatttttacaaattattccaatgattactatcaaattagaagatctcttaaatagcatctaatgtgatttatagcagagataactaaggtccccaaaagttaagttacatgtttaagattacacaacaagttaagtcagagtatggagaggaacctagatcctctcatccttgttcagtccttttggctctaatgttgcctcctatcacattctcagtctggatgagttggctgtaaaatatcaagggtatgctctttgcagtctaatttagcaattatgatcaatgttgtcatccatgttttaataatagaattgtagagataaaatttgttttccgtaggtcatatatgtaaaaaatgctcaatacatatttattaactgagtgaatgaagctggtagttttgtttgacatatgcactttttctgactttcaaaaaaaaagttaaaatcagaaaagaaaccaaaatggatccatctggcttatttggaaggacattattgtgtaatgaaataccaacgcagtcacattatataagtcagtgttcattatcacagacaaatcagcatggtaaagatgatagattttcagaatagcatagggattcttttaataaccccctaataaatagatgcaaatagttttccaattgaacatacctttgaattattacccatattattgtcttaatttgttgaaattgttgtatttttgtaatgtgattgcaacattgcttttcaggaagaggagattatgattctgtatccccttttggtcctatttatcccttttaaatcagtttcacctctcatcttagacttatcgggatttttatgaatgtacctgactatccttggtacataaaaagaagactcttttcactttacttaatgctacaaaattttgagtgtagttcccagatggctaattatttatttggtgactaaaaatatagcttcttgttctccagtcacatatgtgattttgggatcttaagataaatttttatatctcatatgagtgatcgtagaatttccagccattatatttcttatcactatggctagcttgaatataataacatgattttaaaatatatataaccctgacatggtgatgtacttttgaaagctccttgtattagcaggttatttgtacagctgtatcaaaaagacttgcctcacttcagaggattatcgattaatttgcataaatgtatttatgcttgagagttaaagtaatgcactattagttttataaaacagttggcatagctgtcaaagttcttaatgttctttgcagtgttacagctagaatttcccagggcattgaaagaaaaagcaaagaaacaaatctttaatagtgttacattctgcttgttctcctgggcttgtattgaagcacaggtgttaaggtggtgttgaaattagtctggaatcatgaaaaaataaaatacaactctttgaggtagctagggcaaaatgactttgcagtgccacgactgctctgcccctatctgagaaaatgcttcttgtgctcggtagctcttgttaacttgaaaaactctagaattacataaataatgaatggatgcaaaaattcattggtttttgtaatgtagatgaaggtaagatgtcctgtcagaactgaaatttgcatagtagaaaaatttagttatcctatcttgttctttaaagcaataaatgactatgaatattcatggtcaattaaaatattaatggtatactgatactttagttttaggtctctagccatccataaagagtttcatttaaacttgactaacagtgaagggatactttagcatagtgtataatatattggcattttgtctctgaaatgaaaatgtagtacctgacatgagtaaataatttgcttactcttataattcatcatttcttttgataagaaaatattctcttcttgtatagactaaaacagggacacagtatgtatatcttttggtgttgaaatactctaatgtttttaagcactagtatttatctttatcatgtagttagagtttcatttagttgcttcaattgacttttagacttaaaaaaatttttaagtgtaaagtgtacagtacagtgttactaactccatccatattgtagttcaaccatcaccaccatctgtctccagaactctttttcatcttacaaaactgaagccatatccattaaacaataattccccattctccccttcctcaagtccctaataccctaataatcacaactttacttttttttttttttttcttgagatggagtctcactctgtcgccaggctggagtacagtggcatgatctcagctctctgcaacctccgcctcccgggttcaagtgatcctcctgcttcagcctcctgagtagctgggactacaggcacgcgccaccacgcccagctaattttttgtatttttagttgagatggggtttcaccatgttggccaggatggccaggatggtcttgatctcttgaccttgtgatctgcccgccttggcctcccaaagtgctgagattacaggtgtgagccactgcgcccggcccacaatattactttctatgaactggactccattgattcatataagtgaaataatacagtgtttgccttttcgtgactggcttatttcacttagcgtaatgttctcaaagtttatccatgtgacactatgtgtcagaattcccttactttttaaggctgcataatattccaaagtatgtatacatcgcattttgtttattcattcttctattgatggacatataccttaaatgtgtgacttacatggcgtgtacattatttgggttgctttcagcttttggcttttgtgaataatgctgctccacgaacatgggtatacaaatatttttttgagaccctgcttttaattcttttggatatctactcagaagtggaattgttggatcatatggtaatttttatttttatttttttgagggatctccctactgttttccatacgactacagcatttgactttttcacagtagtgcccataggttccaatttctctacaacctcgccaacgctcctacatttctgtttaatatattgatttttaagttacaaaagttgcgtattgtagagattcaaacgattcagagaggtgtaaagtaaacttgaaaatccttctttattttccctttgactcttaaaacattgattaacactgattgaatcagatccaagatgaggtttcaaattcctctaaaaatcttcctaagaaagctttttaatacctcccgcacatatgtgtagataactgtcctttcttttgagcttctcttttaaggtactgcatcttagtgtagtgacttccatttagtgaatgctactgaatgtggattcgtgtcagacactgtactatccatatgtttttcaaccttatagcaccagcagtgcctaagtcattgtgcctggcaagtcataggtgttcaatataggtatgatacatgaatacacatgtccagtctgggaggaacttttcaggaagtaactaacataggcctctttccttccgagtgctgtataagcagtctcatgctggtgttgctttgagcatgcattttccgtgttgtataatatattgctttagggtacacactgggcctgtgaagactgggcctatgtttcctgctgcttttgatacaggatcagaaaatgtttggaccccccaactgttctctgatttattaacactggctcagaattatggaagtttgaagttggctggaagctatgagatgattcactgagaaccttatttgacagctgaagagactgacatagtcaaagacttctactgttgttaggaacagcacttgttttaaacctttattttaggtcgcgggtacatgtacaggtttgctagataggtaaattgcttgccacgggtgtacagataatttcatcattcagatgataagcatagtacccacaggtactttttcatcctcaccctctgtattagtttgttttcacagtgctataaagaatgacctgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcagagcttgcagtgagccgggatagcgccactgcagtccagcttgggcgaaagagtgagactccgtctcaaaaaaaaaaaaaaaaaaaaaagaatgacctgagactgggtaatttataaaggaaaaaggtttaattgactcacagttctgcatggctggagaggcctcaggaaactgaggcctcatggcagaaggcaaagggcgaagaaggcacgtcttttcatggcagcaggagagaaggagagcaggggaaactgccacttttaaacaaaccatcaggtctcgtgagaactccgtcactatcatgagaacagcatggagaaatctgcccccatgatttaatcaccccctaccaggcccctcccctgacatgtggggattgcagtttgagatgagatatgtgtggggacacagagtcaaaccatagtaccttcctccctccctctaccctcaagtaggccccagtgtctcttgggcccttctttttgtccacatgtactcagtgtttagctcccactgataagcaagaacataatgtggtatttggttttctgttcctgtgttagttccacctagggtaatggcctccagttctatccatgttgctgcagaggacatgatcttgttctttcttatggctgtgtagtattcaaaggtggatatgaccacattttctttatccagtctactgaagaacagcacttttaaacaatgctctttatttttcaaagcctaattgttaaagtgtccttatagatgttactgaaacctccatatccaagataaaagagactgctttgcggggttgttaaaatcagtttttcaaacataattaatcaaataaaatttacctaatgacatttcagtagtccttatggggtcacaattgctctatttttttttttattttaaataaggtgaagtgtaaatgaaagtttttcgtaatgttgtttacatgtgcaaaatgattagataccttgccattttagtataaatatgaataatgatcatggggctaatgattaaaaataaaaaaattaagaaaaagacattttaaatggcaaccgaaacaaatcacaaggaccagaatttccctgtttctcaagcaatcagaaattttccaaacaataattaacatgttaacagaaaaaagaaatggagtctaaagaaatacaaaagagttcatgggggttttgaaaagttgcattctttgcagatgaattgcatcctttgggaaataacagtatatgtagaagttaagaaacatcagtattacgtattctttagtgttgtttaacagctttttgagaaataattcacatgccatgcatgcttcacatttaaagtatactatttagtggttttagtatattcactgagttgtacagccactgctccgttctaattttacaatatttttcttttagagtgtgttttttttctttgtttcttcatattctcaccaacagcctctcttcttctttatttacattttatttctttgagatcttgcctactttttttggctgtttcaactgttaacttggattttaaacactagtcctacactctagcttgttcttctcacttccttaatattactccgataatctcttatgtggcctactattttatgcattcattcagcatttactgagagcctgttgtgtgctgggcactgaagaatgttggtctagctggaggacagttacgtaaagaagtaatggtggcaccccagggactgaaatgctgttcaggatgctctgggaacatagaagggcacttgagaggtgcaggcaagattttgcaggagaaagaactcttgagctgaatctcagagtactgggtaagagttagccagatgtactagatagagaatgccaagcaaatggattatcatatatgaagcttctaaaatttgaaagaaccagttgtatttagaggaaagcaaccagttcattcagtggcatgtctaggagaaaaaaaagtgagaggtgcagctgaagggagagatggggaaaggcctgatttttgaaaggccttgaatgccatactaaggaatatcaccattatcctgaaggcagagatagactgaaagattttaagtggaggaagaaatgataaagctgatgatggattttaagcagaggattggtatgatgagatgttaggaggtctgaaggtaaatttggtaagccaaggcaaggagacagggtgtctatgaggtgattgtggttgctttagttagagataacgaactgtggctgtgtctggaggatagtgactgtgtgggtcggggaagaagaagggttataaaggacaaggaggagtgcgagatgactatggctcagaaaattgcatgctggaggtttaactttggtggaagaagggcaggatgtagggaacaagagctcagatttggatttgaacttgttgaatttgggatatatgggctgtttaggtgaaatctggagtttgggagagaggtctgggccacacatggctttgagtatcattagcattcaggttttaattgagttgacatcatgattgtgtatttgatcagagatacagtaagaatagcaaagacttgagaacagaatcttggggacccctgcaggtgagggattttgaaggtggaggagatagtcatcattatctgcccaaaacccttttcttactaaattgtcttattcactcaagattgcatcattctcaatgtagttggaagccagagttgggagtcttctctgacaattaactttgcgtcatctctcatcaaattattttgcttttttcctgtgcagtaccttttagatctgccctttcttattttttcccacttgtgtcactatttttcaggcctttgttttttacgtatttcagttttttttttgtttttttttttgagacagagtctcgctctgttgcccaggctggagtgcagtggtgtgatcttagcttaccgaagcctctgcctcccgggttcaagtgactctcctgcctcagcctccagagtggctgggattacagatacgctctatcacacccagctaatttttgtatttctagtagagatggggttttgccatgttggccaggctggtctcgaactcctgacctcaggcgatctgcccgtcttggcctcccgtgctgggattacaggcgtgagccaccgtgcctggtccagacttttatctctgtaatatatcagagttccatataagatttccactgacaagagttctgtgaaaaaaaagtttgaaagtattcgtttataaaaatacagatcctggcattcaaggctctttggagtctctccctatctaatttatttttttgaatgtaaatctcagcataaatcttaggcttctgtcattctgtgatattcaattttcctgaatttttatgtctgccttttaaaatgctgtttccattactttctttactcctcacacatgcaaaggtcaaatgcaataattcaagtctcatttcctcttcgaagaggaagcagtgtggtattttataaagctttctgcaaatccttgtgttatctgtgtaacttcaagtgacggactttcctaaactttaggtttcttatgtgtaaactagaccatgtgtaggttaaattaataaaatgaagtgtatagcacatggttactttttctgatctcggtcccttttgtgcactctcattcatgtatttattcatttaagaagtatttactttggcattactctgggcagtggtgatacagcagtgaacaaaatgaacaagaatcactgtcattggccaggggtggtggcgcacacctgtggtcccagttactcggaaggctgggtggaaggatcacttgagcctggaagattgacactgcagtgagctgtgaccacaccactgtacaccagcctaggtgacagagtgagaccctgtcttagaaaaaaaaaaaagtagctgtcagtatggagcttatgttctagaagaggagataaatgataagaaatacatacttttctttttctgagacagatttttgttctgtcacccaggctggagtgcagtggtgcgatctcagctcactgtaacctctgcctcccaggttcaagtgattcttctgcctctgcctcccttttagctgggactacaggcatgcaccaccacacccagctaattttttgtatttttattagagacagtgtttcaccatgttggccaggctggtctcgaactcctgacctcaagtgatctgcctgcctcggcctcccagagtgctgggattacacgtgtgaaccaccacagctggtctagaaatatatacagttttaataatggtaagtgctaaggagaaaaaggaggaaaggcaggcatgaagtatcaagagggatggctgaaattttatttttttaaattttagattcaggggtacatatacaggtttgttagataggtaaattgtgtgtcatgggtgtttcatgtgcagattatttctccacctaggtaataaatatagtacctgataggtggtttgatgatcttcaccttcctcctttcctccaccctcaagcaggccctggtgtctgttgttcccttccttgtctccatgtgtgcttagtgtttagctcccatttacaagtgaggtcatgcagtattcggttttctgttcctgtgttagtttacttaggataatgtcctccattactaggataatgacctccagctccatccatgttgctacaaaggatgtgatcttactttttttatttttaatggctgcatagtattccatggtcgtgtatatgtaccacatcttctttatccagtctaccattgatggacatttaggttgattccaggaatgtctttgcttttgtgaatagtgctgtgatgaccatacatgtgcatgtatctttatggtggaatgatttatattctttcgggtatatacccaataatgggattgctgggttgaatagacagattgaatgggaaaggcctctcagaagttttctcttcagaaattgggaaacacatgacatactcatagtacacagtctttgacatgctgttgtttatctagatatactcattctgtcagctgtgccctcacctctgttatgggctctttgtattccttatcccattttttttgtttgttttttgaggcagagtctcactccgtcacccaggctggagtgtaatggtgcgatctcggctcactgcaacctctgcctcccgggttcaagtgattctcctgcctcagcctcctgaatagctgggattacaagtgcacgccaccatgcctggctaattttttttgtatttttagtagagacaggatttcatcatattggccaggctggtctcaaactcctgacctcgagtggtccacctgcctcggcctccagaagtgctgggattacagcagtgagccaccatgcctggccctgatcccatttttattgcagtagaagtgtagtgacaaggaattggtaaggtatcaaaatagaacaggaaataatggaagaggcaagaccttcacatctaggaagagactggtggaattctatgaaagttaaatatttaatacttgttttgtccagtttttattagtccagacacttgcaaaatgaaaacgagaagaataaagactacctgcctctaccaggcattattaattgccctttggagattttgaatgaggatgttagtgtctttgagtttcataatgaaaactggaactatggggagaaattgcttgatctcagaactaactgaagctccagtgctcagagtcaaactaaactagacgggccttggacaggtggggagttagcagccaattttattcacatcatttgtcttttataaaaggtgtttgcatgtcagattgagcaaaaatcatggaaaatgcccaagttttaacatcattgtttgaacctatcagcaaaatcagatggcttgaatatgtaattaacagttaaatttgtcctccagatttgttttagcttctagcataccaggcaggaaattggaattagaaagaagaactcaggatgtgaaactctcatttctggttcagtttttttccaaagaagttatccagagaagagttaaatttcctgccaatgatgacatgaaagctatgttgttgctattgcttttgttttgaactttgcaaaaagaaaaaaaattcaccaaacactacactttgattagttctagcaggtttttttttccccttaggggagactatagactgtaatttcatcacaaaaaacatggtgcctgagctctaagcaaagtttgagtttgtttttcccttgaggatttgacattttctgtttcctgacatttttactattgttagacatacttctttgtattcttgccctatattcattccctaagggaaattgtgtattttatctactggaaggcaggaatgccttctgttttggacaagccatttaattgttcaaataaattcaactatagtgtaatagaccaatcattaggaactgggccatgtggcagcatttagattcatgagacccagattctcagttcattccaaaaaaggaattaaataccatggacacaaaatgaatgattttctttcctcccttctttctccccagggtttcccatttcaccctttaaaaatattaaatgatatcctaaatacaaaccaaatgctttttgtttcagtatttatggtttgcttatttgtggttttctgtttagtggttaataatttgcttaccattaagaaaaatactagcagattttttttgccactattctctatttgctctataaaaatgtgatgtccaaataaaagggaaatgaagacttaccactttttggccttcttttcagctttttgggtgtaattctgttttaactaataattaaatatatggccgggtgtggtggctcatgcctgtaatcgcagcactttgggaggtggtggcgggcagattacctgaggtcaggagttcaagaccagcctggccaacatggtaaaaccctgtctctactaaaaatacaaaaattagctgggcatggtgactcctactcaggaggctgaagcacgagaatcgcttgaacccaggagctggaggttgtagtgagccaagatcccaccattgcatgccagactgggcgacaagagtgaaactcagtctcaaaaaagtgtgtgtgtgtgtatatatgtatgtgtatatatatgtgtgtatatgtgtgtgtgtatgtatatgtgtgtgtgcacatatgtgtgtgtgtgtgtatgtgtatacacacacaaaggggacttcaaaaggtcatggataaaaggaattaaaagatacaaaataaaaatataaactttatttctcaacataagctccatcaaggtcaggacacttttataagtgatggtatcagccatttagtccttccctaaagaactgagggtactgggaacctaaccgtgtcagtgccatcttttttacattactaactgaagaaaaatgggtggcctttaaagatttttcaagattacctggacatttttctgctaaaagtttggctaactttctcaaaactctgtcataataagcagatggtatcgttctttggccctctagaaagctgatgaggagaatgccctgagcatctcaaaaaactgttgctatgacctgtgctcttcacctgtccatttttgcttttactgaaccccttccacctcttgggaggcattgctttgtgctttgtcttcaggatcacactggtaaagccatgtcctgtctcctgctacagttcttcagagaagtgcttcaggatcttgattattcttgtttaaaatttccattgaaagctctgctcttgtctgcagcagatcggagcacaacagttttgccatgcagagtagaaagtttgctcaactttaattttccagtcaggagtgtaggtaagctgaaccagatgggatgtctacgatgttggctattgtgtgtgctgttcattgtcggccctctttaattagggcatgaacaagattgagtttttcctcacaaatggatggggatggtctgctgccgtaggcatcatcctcaagattgtcttttcccttctgaaaacaagtcatctatttataaactgctgatttctttgggacattatctccatcatctttacataaagaatcaataattttgatgcaggattttttattccttagttcagctaaaatccaagttattgtctcacgaccagaaaaaattaggcatgcgaacacatttaaaggtgaggagagcggaatttattaaaagcaatctgtcagcagaaaagagggggttcctgctaataggctcccacctcacagattgaataccaggccaccacacacaagctgaagacccctggctcctctccttgtctaagtctcgaatttccgatgtctccactccattttcccagtgcacatgcaggcccctggtccgttgtgggcatgctcaggcaagaccttgtgcaggttcctttctctgcctcctgtgtctatcaatttcaccactcttccacccaagcttcactatattttttttctattttttaaattaattagtatttttattttagaggtagggtctcaccttgacacctaggatggagtgcagtgtaacaatcatagctccttttgatatggacaggaggcagggaaatactgggtagaaaacggcagggtccctggcaaaggctccaccctcaagcctgaacctgcagcccaaagtcctgttttctcatccaaatgctgccctttctaaaattaccctagcctgctctgccccatcctgtacccataaaaaccccaggctccactggcagaggagcagggcagagtggcagagaaggagagaagagaagaagcaaccatatgtcggggagaagcagcttgacttcagagggacggcttgatggcgggacttcggggaagagtttggctggggatggccgaacctctggggaagaccacctttccactgcatcctctttccagctctccatccctctgagagccactttcgtcagtaataaaatcccttgcatctaccatcttcaattcattcctgtgacttgattcttcctggatgccaaacgagaccttgggatacagagggctgtcacactgagctgttaaacacttagccatcgatggacagcaaagctaagagggcacagtataacattccctctggggcatcacagatcatgggcagggacctccctagacactgctacatggctgatacagggctcagccctgctggtgcccaaaggcacttgccccagcccctgcacctgctgacctgtgtgctccccttcctgtgaggggttgagggctgtgggctgagtaaagaagccaccctcttccggagtcccacaaaagggccaagggaactatcctatttcaattgcagcatctcccgagttgctgagagtataggcatgtaccaccacacctggctaatttttaaaattttttttggagatggaatctcactattttccccatgctggcctcaaactcctggactcaaactgtcttcccacttcagcctcccaaagtgctgctgattacagggtgagccttggcaccccagccttcaccataattttgatgttcgttcttgcctcaattttaacagaattcatgttgccctgttagaggctcttttcaaactgatgttttatcctttttagtgcctcaaactagatcctgttcaggcatgctatagcaagcttattttgatacaaaaatgtttgaaacccatgcatagttttttcatatgcattttctgtgaactttttaaagatctggtgtgtgtgtgtgtgtgtgtgcgtgtgtgtgtgtgtgtgtgtgtgtgtattttctagcaacactgtctcttttctttcattttgcactctgtatattttttgtaaagaatacatctttggatctaagtggccgatatgaatttgttgagactaacagtttttctgcagaagtgagtttcttcaggtctgtgcactgctggtcagaagggaccgctctgtaaaaggtgacacttgggtttgtggaacgaatgcatgtaggttggggaatcaattaaaaacactttcattttctctgtgctgtggcaacaaggtggatacaggtagatacacatggagcagtgatgtgtgctgtgatcctgagagtgccctttgaatctgctgagctaaacagtttttgaatttttttccactcagtactctaaaattcacctcctgggattattctttggctaaagaaaagtatgccaacatgtgacaaaatctgcacttgagttctttgcaggcatttcttttcttttttcttgtttttttgagacagagtctttgctctcttgcccagactggagtgcagtgacatgatcagagcttactgtagcttcaaactcctgtgctcaagtgatcttcctggttcggccccatgggaagttgggactacaggtgtgtgccgccacatccagtgaattttttaaaaaaatttctgtatagatggggtcttgccatgttgcctaggctggtcttgaattcctgggctcaagcaatcctcctgccttggcctcccacaatatggaaaacatttccatttggctactttagtgcatagagaaatgtttatacctgggaatatctggagagtcctagaaagatctacccagcaactaaattggtagttattaatttttttaaattttatttttgagacaaatttcactctgttacccaggctggactgcagtggtgcaatctcggctcactgccacctctgcctcctgggttcaagtgattcaagtgcctcagcctcttgagtagcaggaattacaggcgtgtgccaccatacccggctatttttttgtttttgacgtggagtctcactctgtcgctaggctggagtgtagtggcatgatctcagctcactgcaacctccgactcctgggttcaagcgattctcctgccttaccctcccgagtagctgggattacagccacgcaccaccatgcccagctaatttttgtatttttattagagacggggtttcaccatgttagccaggatggtctcgatctcctgacctcatgatccacccgctttggcctcccaaagtgctgggattacaggcatgagccactgcgcttggcccatgcccagctactttttgtatttttagtagaaactgggtttcaccatgttggccaggctgatctcaaactcctgacctcaagttatctgcccaccttggcctcccaacatcctgggattacaggcatgagccaccgtgcctggcctaaattggtagatattaaagcttatactttcaaaattaggcaagtcttttgttttggtgtcagtatttcttgtcattcttgatttttttgtgaaagattggagagcaaaagtggtatgaacagttgtcaattctgtaccatagtaagcactgtgatgctatttcattttgtttttacaagtgaaacaggagaatgaatcacatatcagcaagaagaggtttgttaaggcaagattggagatgctgcttccttgttttggttgtggagtctgacgtttcttcattagttcttggtatctcttgttcactatctgaaattaactccagtaatccttacccagcaggcataaccttcagagtctagcagaatccagctagaaatctttaagccacaggccatcttgctccctgaatcactaatgtgtaattataacgtgtgcgattataaaatgggaatcaatgtgttttggggagtctggattgacaagaataactgatgaagttcagttgtcagatctatatggtgaattatcataggggatgtttatggatgaaagctcttgaattatagaactctctcctgattctagattccttttcagttccatttcccacacatcaaaaggctttcaaagataatcctttcctccacttgtcacaactcctgcaccttgcttttctacatttttggaagagtgtttctataatagatgagcaagcatattttgagcaaatatagtaaaatagataacattcttaagaataatatgcaaaattattaagcaaacagaagtagaccagttttgtgttttattctgattaaatattaaaacaagagttttgtattggaacacacattttatgtagttatgtgacaatgtggaaagtttaattatttttaaagaatgaatttatcaaaaaaatgcctgtgcctagctgtagattaaagtaatgttcttctaacaagtaaaattgaagcaattaaagagactatcctcaaactgagatagtcatattgaccattctgagtgttattgaggcaaaactgtgttaagatgaactgagacagtaatcttagaatctaagaattgtcagaacccttaaatgtgaaccactttgatgcaaagtatctgttgcttcccattaaccaaaaagagagttgatgtgtgagtctttgtatattagagagacagtggctaaaaagtaactggaagaaaataaaatcagataatgagagatagagtaaaaaaagaatgaataatattttcatttgaagacctttctctcttcttttcctttggcaaatattattgagatcctaccatgtgctaaacagtgctttgggcaaggggtataggccctgaataaaacacacaaggtctctgctttcatggaggttacatttgttatggagagttgatgagacaagaaatacataagcttgagtcttttttttttttttttttttgagacggagtctcgctctttcaccaggctggagtgcgatggcgtgatcttggctcactgcaatctccgcctcctggttcaagcgattctcctgcctcagcctcccaagtagctgggactacaggtgcatgccaccacgcccagctaatttttgtatttttagtagagatggggtttcaccatgttggcaaggatggtctcaatctcttgacctcgtgatccacctgcctcggcctcccagagtgctgggattacaggcatgtaccagtgctcccggccaagtttgagtctttttaagcctactctggctcaagagcctgccggaataaaaaagtaaaaaataaattaataagcagatctgattatgggaagtataatgataaaaatgaagcagttgaggggacagagtaatgatggtagtaggtgtcagttgctatttcagatccaatggtcagggaatgcttccctgataaggtgaggtttgagcaggaactgaaggaagtcaaagaaccatgcaaatatagaggcaggggtggaggaagttgttgaggactagcaaggaaaccagtgtggatggaggagtgtaggtaatggggagagtaggtggatgaaatcagagagaacttttttccccatcgaggaaaggaagagaaggaggatggaacccagaagactgtgcaggaacatgcaggagaatcagagcaagtggtatcctggaggccaagagaagaagggaggtgatcaatagtatgtgtcaaatgctgatgatactcccagaagtagtgaacaaagttcttggtcctacaacctagaaagtctgtctctacctttcccctgtcttttgtcccttgctatgagatctttagtttctataaataatttgcttttattgcatatgctattcttaagacttttcccacaaatgtctattttgcatacttcattagattagcatctgcttttatgggatgaattatttctgatgtgcttattttgttttgtgtgtttgtatgtcagaaaaacattttttagttctttctatgtgtcaggcattgtgctgagcactttatgtgcatgatctcatttaatccttgttatagccttatgagctataactccccttatccccattttactgatatggaaaatagtgatcagagaggtttagaaatcagtgcaaggtcacataattagtcagtggcagaattatttttttaaacttcagtctttctcattctaaaattttcactcctagcaacaagaagttccttcctatacctcgcactgtcttctcaccaaatatctctactcttagaggttttctaagaagctgatggaaaggctcagattctagtatctccgcctgtatctacccaccttgcctctgtcttctctggattctcctacagagccaaataccagattctggcacccctgtctgcctgtctttgtcctggctaagtgtagctcccaaccagccccaccttttccccacactcccatttgctttgctccaacatgctatctttgtatgatgctattcacatgttttccgcttccgcccttgtcttcatatgcatttcatctgtgtaatttctttctctcatttcacagcctaaatggtgcatttctttggtgtctcaatccttgacctaatctagatttctttgttgctatttagtgaaaactctatttggttattttatttcacattggaaaaagaaaatgttccatggatttttgagaatttgtgtgatttctggctgtttctttatgtttcataatgtgctgcctcattttggagaaaagacaaaaataggctaactttgttttacaactagggaaaatgtgcatagaattgttcatatttgcaaaatgaattaatagaactacttaaaattagattttcctgctttaaactcccgttctttatcctctgtttccataactcagctatgtatttttgtttgtttataatcgtttgtttgttgtgtttggagcttggtaaaagaatgaaatgtttttgtagagaaattcactcttccccccaataatgtggctcccccataagtgcaacaagatgtctctcaaatagggtgagctttagttacatcataggtggtgggttccagcttcatttccctgccaatatcatggtttttcccttttccaagtacaaacttcatcttcagcttggttccaggatgggcactagtgtgcccagcatcatagctctcatagctataaaatccactcaagacgttcagagccagcaaaggctcatctctttctcactctcctttataaagcaagtgagcctttacgggaagaccctacgtctcattagcctgaattgtagaccttgcttgtatctatttatggccaaggacttcgggtcggcctcccatgaagcatccagctatccagaagaatacaatcagggttctttttagaggaagcaatcagggaggatatgaatctaggttgacagccaaatttttagtttgtcgtcttcagtatatgtggaatatcccctcagccagccagattgtccagatcaagtttggtgaatagtgcagagataattcatgtcactggagcagcccccctcctcacctttattggtgtggattagattctgctgcaagtagcaaagacctaaacaacggcctctacaagatggacctttccctttcttacttacaagtcaggtgtagttcagggctgatatgacagccttcttgcatagaatccttggaggctgggcgtggtgtctcacgcctgtaatcccagcactttgggaggccgaggcgggtggatcacctaagattaggagatccagaccagcctgaaccaacatggagaaaccccgtctctactaaaaatacaaaataagccaggcatggtggcacatgcctttaatcccagctgctcggcaggctgaggcaggagaatcgcttgaacccaggaggcggagattgcggtgagctgagatcgcaccattgcactccagcctgggcaagaagagcgaaactctgtttcaaaaaaaaaaaaaaaaaaaaacccaaaaaaaaaaccccgaatccttggaaagttaggcttcttctagatcattcttcggctatacagtggtccaaaatggtggccgttgcagctactgaatggagaaaggaacacagtatttaggttagtgcaaaactaattgcggttcttgccattaaaagtgatgtcatcacacctgtaatcccagcactttgggaggctgaggtgggcagatcatctgaggccaggagttcgagatcagtctggccaacatgatgaaaccccatctctactaaaaatacaaaaaattagccaggcatgttggcggcgggcacctgtaatcaatcccagctactctggaggctgaggcaggagaattgcttgaacctgggaggcttccgcctcccaggatccgagatggcgccattactccagcctgggcaataagagcaacactctgtctcaaataaagaaaaaaaaaagtgatgacaaaaacctcaattactttttgcaccaccctaatggagacaaaaggcttataccagctatcatgtcaggaatattctaagaagctaccacgtaacacttctgcttatgtctcacaggacaaaagccttacctaactacaagggagggccagaagtgtagtcttaattctgagaaaaaatcaggggagaataattattggccacagctaacagtttctgctgcaccctcatctaatcacctgagttaattatgttagtgaacagatgatcaattacttagtatttggactttgtttatctccctttgtccttttgaaagctgtgccaatatcagcagaatgatgtctgatgttctagagactgcagaacttattgtatgtggctgtcctgtctggcatagcagccacaagtcacctgaaggtattgagttcttaaaatgtggctaatgcaactgaggaaccaaattttaaatgtaatttaaattaaaaactgacacttgattcagtttttggaaacttttaattgtgtctagaacaactagggtatgtgagtctacttttgcaactgtacattttataaaatctaaatacagatcaggtatttccgatgaacatttaacatctgaattgggttgtactctaagtataaaatgcaaactgggccgggtgtggtgggtcatacctgtaatcccagcactgggaggctgaagcgggtggattacctggggtcaggagtttgtgaccagcctggccaacatggtgaaaccttgtctctactaaaaaatacaaaaaattagctgggcgtggtggcaggcacctgtagtcccagctactctggaggctgaggcaggataattgcttgaacccactaggcacaggttgcagtgagccaagatcgcgccactgcattccagcctgggcgacagagtgagactccatctccaataactaaattaattaattaattaattaaaataaaataaaatgcaaactggatttcaaagactttagtatgaataaaatatctcagttttaaaatgtgactacctgtttgcatgatattttggctatattaggttaaatgaaaatattaatgcaactaatttcacttgtttcattttacctttttaatgtggctactggaaaataaagaattacatatgtgacccacgttatagttccattggttggcactgttataaagcctcatctcttaatagaggacatgactctgtgtacaaatgaaaaggcttcttagtatctcctgatttcagaagaaacaaatttccaagatgaatacagctgggcattatctttttgtcataatgtccttgctgaatgctactgtcttcttctttctttatattcctgtatttctctacttctttcactttatcatccttttctcagccttccccttaaccctgcctctgccagaaataggacttctctaatggctgtttaacagaagatgaccatactgtgtaatcttcatgtgatatactttgctgaatatgatgtatcattgcctctttgatgacagttaccaaattagcctttcagacaataatttccatagctagatggaccttttctggacattcgtcatttctgagatgataaatgagcagagaccaaaccttttattttttgaaattgtgtggagtatattgtgtccagagcataccttttatttactatttcatttcttttggtatctctggtgggtaaagtggtgtgattcttattctataaagtacaaactcatgtccaccttgacattattactccaaaatatcacactacatgttaactatggagcaagtattagaaattgaacagatctctgattttttttttttttttttttttttgggagacagggtctcactcctgtctcccaggctggagtacagtggtacagtcatggctcactgcatcctaaacctccttggctcaggtaatcctcccacctcagcctcccaggtagctgggactacaggtgggtgctactgtgcctgtgtaattttttgtatttttagtagagacagggtttcaccatgttgcccaggagattcttgaactcctggcctcaagaaatctgttggccttggcctcccgaagtgctgagataagtcaggcataagccactctcccgtgacttttgaggtctttgaatgttgcttgcattgcctagcacttttatttattttcaaccaccaaccatctgtgaggatcttgggcaagatgcttcaccttttggtatcttggttttctcactggttgcttcagtaatatttgctttacctcataatactttgaggctcagaggagaatataattgcaaaggcaatttggacacttagtagctacgttattataagctattatttacatagacctattttcttcttcagtgaaataagagtggtgtagttttctactttcccaatcacctaggtgcagtgtaccctctattacttgcactaatggagagaatcgatgttgcaaattttccagaacgccaaataattagaaaatcattcagaaaataattcagcatttacatttacatatgggtctctcttgtgttccaagaattcataattcagaaaagaaaagcaaaataaataaataaataaataaagtctgactcagaagaaaataagctttacaacttgccatctttgccctttattcccagcggccttttgtgggacagatatgtatctatgtctctaaccggtgcagagttctagcttacagcattgttggcttatttttatttttattttttaacatttcaaacctttagtcagacaggaactgacttgtgtgaagtgtctatcttgttttctcagcttctatagcagtatcaactatgtatagattatgctaagaaagtatgtaattaaatactgtcaatgtacatttgaaagcaagtttgcagtgaatcacctatccagggaataatcctgggttgtcctgtaagagtacttagaaatgcaacagatgtacactgcgttgcccagcttcccctttgtttatatgctgctttttaaaaaattgaggaataagttgtttggcatattcttttcgtagacctctttgtgatcgggtttttttcaagggtaaaaatctgattgcttttttaattcattgaaatgctggattttgttgttttattggtgtcctttggcttggcatacttactgatagtcctgttatttttatttggagacatagctttctgtttattagtggaaatatatagtgaaaatctttggaggcctgtatgtatgtatgtatgtgtgtgtacatgtatgtgtatatatttatatatatatttttggaggaagatacatatttttcaaaaattaaggattagttcattcccttcaattctaataggccataaatcactctgaattgttatgcatctgtcccaccattatattcacatttcctggtggacatgatctttataaataaataaaacatttcaatccagcctctccctccccatcttcatgttcctttcccactgctactttccctacttctttcatagttggaaaaagagaaatcccctagaagtgggagtggagcagacaggatgggctagcagtttctgccttccttctctttcctccatcatgacagagaacagctcccctgtgctctcaccagccacagtagcagtggttgcacctgctgtatcttaaggtgtgaattgtggcctttgccatttcaccaggatgttgcccaaaaatagagctactggtggagttaagtcaagccacatggcttcctgaacatcggggctgtgtgtgtgttgccagcttggcactgaaaatgctctatcccaaatttctgttttgaagaaggcctccagaacatctctggggcatggaggcaatccaatccagatcctgcacctgcccacccagctggtcaccaattttacaggttcgtatttttcagtacttttgttaactatataacctcagttgggtgactgcatgcctaaatggcagtgtatgtgtgtgtatgtttgtaaaaatatacaactccaaatagagaggttgtatgtgatatcataaacaaatttgtatctatagaaggtgcatatatgtaaaagggttttggaattttgctaaattgagtccagcatgatactgacacactggcttttatgaaattggtttttattaaaatctgcaggtagttcttgtactggcaatggctttgattaagcagtgtagtagggtcatatcctagaataacagcatttccaaatccctgactgtttttgaaagaattgtgattaaagttctggctcttttcccatgattactaatgtctgctgagggttgagtttcccaggttgttattggcgattgagttgtgtggcagcccgttgtgctttcttgtcagtatcagtggcattctctagggggaagtgatttcacattgaaatgcgagaactaaaagctgtaacaaaattaacacggggtctagggtttctgatgtgactacaaaactagaatgggaatgtttcctaaagcctaattcatctgtgattgaatttcagactaaacaaagctgccatgatgagaaggtagagaaacccttctaaaagagattatggatgaacagattgaggaacatgatatggcagggcaaagtctagacaatcatatatttcagcttcagctgggcctttcttcttgacaggtgtgttctgtgccttggcatgagcagctcacttgggaaagcccgtgctgttaggaatgatctctttgcatgccaatgggaaatggaaaatgaactccattcttatataatatgtaggaaaaaataagtgttgtgtgtgttgggtggcaggcatggctccctaggttttaagatgtattgtggaattatgtttgtctgaaaacaattatttaatgtctactactaccccagttaatgatatgctcttttccacattgaaaaaatatgcaggattttagaaatcaagaatatattaggtgtttttttgttttttagttgctaccaaatttaaattttacataattttactctttcatctgctggtcttttaccttggaaattctagaacttaggtgttgattctctacctctgtaggttatgaagtgcttgaggtagagcactgtattttagactctttgttttctctctaggtgccatactcaaaatagttttgtaatgcctgtctggattgatttagagctgcttctttgtgctctacaaaaaataatttttaaactcaaatgcatcttcatgcagatacctaaatacaatcatttctcactcaaagatgggggtatcttttgagaaatgcatcattaggtgatttcatcattttatgcacatcatagagtgtacttccacaaacatggatggtatagcctaccatacacctaggttatatggtatagcctgtcgctcctgatatagtttatgatatgcctgctgctttacaaacctgtacaacatgttactgtactacatgcacaacgtgtaggcaattgtaacaaaacgggtatttgtctatctaaacatatgtaaacatagaaaagctacagtaaaaatacagtttaaaggtgaaaatggtccatctgtatggggcctttaccctttgaatagagctggcaagactggaagttctcgagtgagtgatgagtgaatgtgaaggcctagggcattactatattctactgtagatgttatgaatatcgtgcacttaggctacacttaatttatagaaaataatttattaataaacagcttactgtaacttttttcctttataaatttttatttttcaacttttttactcttgtaataacacagcttaaaacacaaacacagtgtacagctgtacaaaaatattttcattatatccttattctgtaagcttttttctaatttcagaatttttttttttttctttttaaacttttttgttaaaaactaggatataaacacacacatgagcccaggcctacacagggtcaggatcatcagtatcactgtcttctacccccacatcttgtcccactggaagatcttcagggacaatatcatgcatggagctgtcagctcttatgataacagtgccttcttctggaatacctcctgaaggacctgcctgaggctgcattacagttatctttttttataagtgaaaggagtacaaccaaaataatgataaaagtgtagtatagtaaatacataaaccatatcatagtcatttattatcattagtaagtaatgtataatgtttgtaattgtatgtgctatacttttatatgactggtggttcagtaggtttgtttttaccagcctcactacaatatgtaagtattgcattgcattgtgagatgttagaacagctatgccatcactaggtgacaggaatttttctgctccattagaatgttacaggaccatcatggtatatgctgtccatcattgtctgaaacatcactgtatgtatggaacatgactgtaattaaaatgatcttttctttgagttctgaacttgacacacttggtactgctccttcagctctggtttcatctttgctttaacttatagcactgatttctttttctttccttccttccttccttctttctttttttttttttttttttttttttttttttgaggcagagtctctctctgttgcccaggctggagtgcagtggtgcaatcttggctcactgcaacccccacctcccggatttaagtgtttctcctgcctcagcctcctgagtagctgggattgcaagcatgtgccaccacacccagctaatattttttatttttcgtggagatgagatttcaccatgctgtccaggctggtcaagaactcctgacctcaggtgatccacccacctcggcctcccaaagtgctgggattacaggcatgagccaccacacccagcctctagctctgatttcaagatgaaacaatggacttctggcctaacctcttcttgtctttcataggttgttaggtattcatgtaggaatgaaagagagcagcgaaatagtaggtgtgtctgtgtatgaacattagagactaattcatcaattcttcaacaaatgttttcttagtacacactattgtcagactctgctttaggtgcttgagatacaagagcaaacaaaacaaagttcctgcaatcttttaatttttttgaatatttcattgagataaaatttataatataatattttatagaattgtacaattatcactactatctatttctatcatttttatcacccctataggaaaccgctattcattaatagtcactctgcatccctttttcccacagccgctggcaaccactaatctattttctgtctctatggatttgcctgttttggacactaagtataatggaaccatgaaatgtgtggcctttattctggtttccgccacttagcataatgtttttaaggcttatccatggtatagcatgagtcagtactttgtttttcctgaagtaaggatgaccattgaaggagcaagctggggattgcaggtgggtcagagtttgtttttggacatactaagttagagtcatgcttaatggaattctagtgaagatgttgagaagctagttgaaaaccgaagtctggagttcaggagagaggtctgggctggagatatgagttgaggagtcattagcatatagatggtacttaaagccaccaggttaaatgaaatctgctagggagtataggtagagcagagggaggttcgggagttgagcctgggggcactcaaatgctaaaaggtcagaaaaatgaggtggaattagccaggagaccccagaaggactagctagtgtgtcaggaggagaatcaagacagtataaggtcctggaagctaagtgagaaggtgtttctagaaaggaatggttaattgtgtgaagtgatgctgctagatccaataagaaaataagaaagataaggacagggaattgttcattgactaagaccattttaagaaggtagtttccacactagcattggcaagagtgaaagcgagggcctgagagctgtgcatattcctgaccattcccatgctcctaatcccctacaagtcttctggcctcacctttacagtctgttccatctcatcatgccctttacctcattcctgtaagctaccacagagagtccagggttcactagttatctgccattttctggccccttatccccaatattgctctgtacatctctgtttccttccagtgtgcattacttgaacttccctgtttcatcattgcaaatcccttatatcctgaatatcttcactgaatactcctttaacctacttcctagagcagttagaattaaacacaatctccctcttgagaaactgcttcctttgctgctgtttattattattattattattatttttttttttttttgaggtggagtctcactctcttgcccaggccggagtgcagtggtgcattctcggctcactgaaatctctgcctcccaggttcaagcaattctccttcctcagcctcctgagtagctaggattataggtgtgcaccatcacacctggctaattttttgtatttttagtaggggctgggttttaccatgttggccaggctagtctcgaactcccgacctcaggtgatctgcccaccttagcctcccaaagtgctaggattataggtgtgagccactgtgcctggccctttgctactgttttaaatggtggctcgtctccagcacattggtgtgataggtgtcttccttgtctcttacaaatcgctttctttctcttctccctaaaaattcccatactttcggattattccatctgttattatttcttgtactcatttatagaccctaggattgtccctagctgtagatcctttttctagctgtagatcctacaatgcgtatttgctaatagtaatttattttccgagttttggcaagcatcattgtcacagcctggcttctatgtggtttacaatagtgaggatatgtttctagagcagtttttctgagacactagtaaatatggaagatgacaaatgcattaatcaggctcctgccatacggccctgatttttaaaaaatgcatgaattttaaatggtttgtatagttgaaaggagaacttaacacatgtgtctgacaagctgatcaaatgataaagtgaaggaaaattgagcctcaaccttttgggcagccagtgaaagtaaaggcacattgcagttttccgaggcagatggaatgtgaacaactaataaatcaggttttgaaacattgaagaacaacttatttcaatgcatatggtgttggatctcagacaagatagtattggaaataaaaatagattcggcagcatcaaaaggacattgtacctaagcattatctgcataacaatatttaaatgcatttcccagcatcaagctccaatatgtagtaaataaataattatagggcaacaaaaagagccttcaagatctctacagagttgtacataaaagagatcagagtgaattggcactatcacaagcattctgtgatcattctaatttctccatctctctcgtgctttaagaagatcagaagactgtaaatcgatttatagacttctcataagaaatactaaaagtagaagtgcgggttattataatggagaaatttgcattagtgcctgctatatgctatgtgatataaaatggaccattgcataaaactacataccccttaagtataaaaacagatttcagaaaagcaaagaagcacggctctgaaatttgaatttcatcttcaccaagtgaaggggtagtggggggagcaagccaaaattgctatcagtaagtcatttttaagtcatcctttattgactttttcagttgtaaatagagttagaaaattttcttttgaaattttgttttgaaatccggcatttgttagtagaatatacttcaactcaaagttgttcagaatttcataatagaattttcctgggggtttattgttaagctagattctgggatattggtttaatatagaacaatttaatctgagtttgggacttattttttgttaggtaaatcgaaaacagcaatggaaatacattttcccttgaaaaaacaggatgaggagtaaagtgaatattttctcttatattcctttaagatatttaggttaacagtttgtttgattaccccatttgagtttgtggtaatttctttctgccttctcagaatagatctatatttgttatgatcatcaactactgaacactattagagatttaggcgttatactgaaataggattaaaaaaagaatgtggtattcaaacttgctgcaacagtgtttaggagtgcattgtactaaagaccctagtggatgtggggaaaattaataaatggttgttatctgaagtaaatatgctgtatttctttttttttttttttttttttttggagatggaatcttgctctgttgccaggcaagagtgcagtggcaatcttggcttactgcagcctcttactccctggttcaagcgattctcctgccccagctcctgagtagctgggattacaggcacgtgccaccacgcccagctaatttttctatttttagtagagacagggttttaccatgttggccaggatggtctcgatctcctgacctcatgatctgcctgcctcggcctctcaaactgctgggattacaggcatgagccatcacccccaaccttaaccggtgtatttctggtagttttatttacttattttggaagaatttcaaataaacacaaaatttgggaaaatagtataaatataacttatatgttcatttctcacatttaagtgtcatattgttatcaagattttaccatattgggttcatctattttattttatttcttttctttttggaggtattttaaagcaacttccagtcattttgtcattttacccctgcttgcctgaattcacatctttaaaacctaagagcaccttcttagatagccacaaatccatcaattgggatatctgagtgtggggaactgtaattatacattttgcctccatttagggtttactgatttaaaggaggtaataaaaaaggaataatttttgttgtgtggaatccagtatgacagtacagaacttcttcctattattttatgtgtggactgtttccatacttaaattgaacttgtagctgttccaggtcttgattcagatgtttatgccaaatgagtttttggctattgtgaatatagcatattccaattacatgtatattgtgactgcagtgagttggaaaataattttctgatattactaattcataatagctatgtggcaattgccctcttctctcgattgtgtgataagcacagggaatacgtagaagtcagctgagaagaaacattaaaggaggaatattttccatcaactgcaactctcatattgacacataagtaaacatttatatgtgtaaagcatagttataactaaactgggaaaaatctgtatttaaacatcattgccttacatgtgattttatcctggggatgggggagtgataaaattataagaatcatgagaatagtgatagacacggtgggccaggtggggtcgagctgactcgctggagccaatggtgcacatctcttcccactgaacattctgctttcagtgacatcatgttggtagcttagaattggccacgatgggtgtagttacacaacagaaatcagcaaatgctacaacaggactctagcctctctcacagagctggttattaaacattgaccaagacatcagtagttatagtccatgaacaactttttacccataggatgagaggctcaaatgctgctttattgttctgtaatcttagtcttctaaaacactattcttattgtttcataatcacctgttccttaatgtgtgcaatattcctttttgttcttgatagacataactagatgtaattaaacttgttataaatttaatttcctttccatgatcctccatgactgggacagagaattctttagggaagttgacacctgctgcagaagccttggtaatggttcctgacttaatatttatggatgtaatcccagggtattttgatgaattcccagaatctcactgttggaattgattcttaacattctaatcaatgctttaaatctcctttatgagaccacaacaagtggactttcagcttttcttaggaaaaacaaacaaaagactgaagtttcagggaagaaactgtctcataagaaagtcattactttttcatgcccttcttagtaagtttttgcttttataaagtcagatctgccttcttgaaagttccaacctgtttattttaatactgtcttctaggaccacagaatataattttaactcctttttcatcatgtagcttttcacatgtcacaagatactaatcatattcctccccacacctccatttctctcacctaaacattccccatttcttccacttttttttatattcttgaatagagctctaaatcttaaacctgctttcctctgaggattcaactcttgtgattgcctcacagcagggattagcaaaacacacaagtgtttccatgttacagtaactagcatttataatgtcctttataaaaattttactaagaacttaacaccaatatatttgttcttttttactttttttttttttttaagacaggatctcactctgtcacccaggttgccgtgcagtgacgtgattagggctcactgcagctgtgatctcctgggctcaagtagtcctcccacctcagcctcccaaggagctgggatcacaggcatgcaccacgattcctggctgttttctctatttttttttttttttttgtagagatggagtttcacctgaactcccgggctcaaatgatctgcctgcctcagcctcccaaaggctgggattacaggcatgagccctcatgcctggcctttatttgttcatttaatgagagaattgtgagagagattatagactggtaattgttagattgttactccccaagaaaataagccagtgaaataggaatgagaagtgtgatgggctttggtgtagtggcagaggttttgtcactttagcgtggttgatgatggtctcagaaggtatagaccttgtgtgctgcttggcagggagaataggagacatttcagataactttgctttggagcagataggaaaagcattttgaagctagactttatatcagggtaaaaattaaggaaaagattgtgtcagaggttactctgagtttttaaagacatgatcttctgacattttcattgtgtcactcgcctgctctaaatctttaatagcttttcattgtacttcggataaaaaatgtcttttccttcataggacctaccacaccctgttgatctggtctgcctacctcccttcttcatttattctccttcatccctagtcttctacactcaacttttttcactgccttgaatgtgtcactgccttcacacatgctcttcctctgcccagaacacaccttcctctattctttacagactaactcctacccattcttcaggtctctgtgtgtcatttccatgaaatgaagcctgaaaggggtttccctggccttgatgtaaattagcccctaatagatattttagagattattgttaaatactacagagatattagggtctctcctgccattctcttctaatctttcataacacagaagacaatttgtaattacatatttatttgcactattgctgaatatcatttactacatgaaaataatctcatttacaatatggtcaactccatgagggcagggaccatgtcacacctaccatagtgcctggtatgcagcaagctgtttaataacaactattgaagggtgaatgtttggtgcttccctacagtgtttgtaatctttagtattcatgttcttaagaatatttaatgacatgggaaaacacttaggatatattattaggaggaaaaagctgactcagacatttatatatatatggtttcaatttttatgtgagttgtgagcttgtgcaaatgtttccttttagtgggcatttagtgagcattccctggtaatctctctcacaatcatatcttcatgggcagatttctggaacttactcttacttgctggtatatagaagtatacattttctgctgactagatttaatatttaaatgatcttatttatattggattttactctctttatatgccaaggaagggcttactcagaaggaggtagttgcgtaaagacctgagaaggtagggaagtgaggtctgcagttctggggaaagagtgttgacagcagagggaacaagatgaacacaggtcttacaggtcattttaaggagtttggcttttacttcaaatgagatgtgaagcctttggagcattctggagagaagagtaactggattaggcatgtattttaacagtatcactctggcatgtatgacagtccacctacaggggacaaggatggctgaagagagaccaattaggaggccagtaatgcaggaggcagatggtggtggcttggaaggtagtagcagtgagggtggtgagaggtactgggattctttatgttttgatgacaaaatggaaaggatttactgagggattggatgagaggtagacaaaatacaagagtgaagatgactccaaagttttagacatgaacaactaaaggtggttgttcttaccattaccaggaccttgtactgtacctgtacatggttggtacttcataaatactttttggatgtgtagttggcccagaacaacatgggtttgaactgtgtaggtccatttatgtgtggattttaaaaaataaatatattgaacaaatgtttggagattacctgtagtttgaaaaaactcaagagacaaagtgtgtagtctagaaatatcagaaaaattaaaaaaagatatgtcatgaatgcacaaactatatattgatattagtctatttttatcatttattagaaaatatatgactctattataaaatttaaaatatatcagaacttttacacaaatgcagaccatatatggtgccattcacagtagaaagaaatgtaaagaaacatgaagatgcagtgttaaatcataactgcataaaattaactacagtgcatactgtactattgcagcaatttcgtagtcacctcctgttgctgataccgtgagctcaagcgttgcgagtgtttgcttaaactgctgtgtgatactaatcatctccctgtgagcagtccatctctccagtaaatttcatacggcagtgagaagtgatctttggcagttctcatgtattttccatcgtgtttagtgcaatactgtaagctttgaataactccatggaacccatacaaagcaccgttagtcacagtggaagtgctcccaagaagcaggggaaagtcatgacattacaaaaaaaaaaaagatgctgaattgcttgataggtactatacattgaggtctgcagctgtggtttcttgccatatcaagataaatgaattcagtgtaagggccattgtaaaagaaaaggaaatttgtggagctgtcactgaagctgcatcagtaggcatgaaaaccttgttcttttcacgaaatacctttttatctggtattgaaaaggcagcttttatgtgggtgtaggactactataagaaaggcatacctatagactctaatatgattccagatatagggaagtcattatatggtaacttaaggcaaaaggaaggtgaaggatgtaaagctggagaatttaatgcaaattaaaaggatgcaaagggtggtttgataattttagaaagaagtttggcctaaaaaatgtcaagttaataggagaagcagcttctgccaaccaagagacagcagatgagttcccaaacatcattaagaaacccattgaggaaaaaggatgtcggcctgaacaggtttttaatgcagatgaaagtgccctacactgggggaaaaaatgccacaaaggatgtttattaggaggagaagcaaacaccaggatttaaggcaggaagagataggctaactctactcttttgtgcaaatgcagtgagatttatgattgggactgcccttatctgtaagtctggaagggaaaagatgaacagcagttgccagtcttttgtttgtacagtaagaagtcttgaataacaagaacctttttctggggtggttccattgatgctttgtccctgaagtcaggaatcagtaagggactgccttttaattgtgcaatactcctggccactcagaactccgtaagttcaacactgaaggagaaatattctacttgcccccaaacagaatgtctctaatcagggaatcataaagacctttaaggctcattgcacatggtactctatgaaaaggatcgtcagcattatgtaagagaatcctgacagggagaacatcatgaaagtctgaaaggattacaccattgaagatgcattgttatagaaaatgccatgaaaaccaccaaacccaaagtgaattcttgttggagaaaactgtgttcagatattgtgcatggcttttgaggatttacaagagagccgatcaaacgagtcatgaaagaattgtacatatggcaaaaaaaaaaaaaaaaaaaaaaaaaaagatggtggttgtgaagggtttcaagatagagatcttggagaaattcaagggctagcagacaacataccagaggaattaacaaaagacaacttgatggtgttgagtcctttcaaaacagtgccagatgatgaggaagaagatctagaagaagcactgccagaaaacaaattgacattagataatctggcagaagggttcagattatccaagactgcatttgacttcttttatgacatggacccttctatgatatcgtcactgaaactaaagcaaacagttgtaaaaggattggtaccatgtagaaacattgttagagaaatgaaaaagcatctgtaaagttgcactgagtatgcctgactctccggcctccccttctactttccccacctcctccacttcttctgtctcttccactcctgagacagcaagaccaacccctcctcttctccctcctcctcctcccccctcatctactcaaaatgaagaaaacgagggtgatttatttttataacgattgacttttagtgaatagtaaaattgtctcttccttatgatttccttatctgtagctttattataacaatacagtataacacacatacaaaatatgtgtttatttttctgtttatgttatcagtaaggctgctggtcaacagtaggctattaacagttaagtttttaggaagtgaaaagttacataaagatttttgactggaatgggagaagcaaccctatcctgctttgttcaaggattagctatatttgaatttaatctgtctgcagtctttttgttttaatttctgcgttctctattggtggagtggtgcttggcgattgagataaaaagtgtttatgctgaagttgtgctccatggaccattagtttttaggcttaagttgctttgtctagtattatcagagccttttcgttggtaacctctacctgtctctgttctctcctcagctaaatcgacaagtacattttaataaaagctttatctgtatttcagacttttgaaaaacaacatttaaaaagcagaatcaccaatctttaaagaaatacaaagaaaaagtgtttttccaggaagagattgtagcagtaattttatgtgatgtgtttagaaactgttgataagtagcttctttgttctgtgattgagtcactgtttttgatcagtcaaacgtagtatgtattgaataccaatattaggagttctgtattatgtgttaccattgccagtctgtttacctatcttattaatattggcctattttgtagaggaacagtgtcctgttttctctaccaaacaatggtaacttatgtttgtccctggattttattatgcatatataagttggtttccaaactcaagaacaatcattttgtcttgttggaaggcttttttattcctttggtttatcttgtaatagctttgcttgtaattttgtgtgtgctcttttttataccctttttatacatcataatgtgaacttcatgaggtcatggattatggctgttgcttatgtttatttcaccatgaacccactgctagtcacaaagatgctgattatagattactaagtatgggttattgaatgaaatgaaataattgtgtttccctattaaagcaattctgaaggaaatatatttttgaaaaccattgattatagtgatttgcttaaagttcagatacttgttttgaggtaaataattgagaaaatttttagactaaaattgcacagacctgtcatgaattttgcccatttttttcctttgcattgggtaatttttgtgacaatgatggcaggatctaagatgcttcttagaaaacaaagagagtatcaaataatcataactagatcatgtaaaactgtcagctgcaaatgataccagctatttattcctaaagctttactaatatagcaaagcaaaacatacagttcattctcatttagaatctgctagaattatcatcgatatcaacgattataattggactatctacttgaaaaaggtgctactatgccattttatgcagtatcagaaaaatgtaaataaaaccattggacagaatatattgtaaaggaaattttataatctaagaaatcaaaattcatagattggaggcttctcatgagcacatctggttgccttattttattgacaagaaatagaagtcccagataggttgatagcttacttaacaccgtatactttatgtcaaagttagacagagaactttgttttcctaatatctgattttgttatttataaattgcattgtattatatatcattatatttcactatatcaagttaaccgataacatttaaggcaaaagctgtattctgctctatattaattatttttggattatttatagtgattgccttagttaggattacaagaaaatggactaaaaccataaaaacagtaatagtatatctgagtagaatccaaagacacttgcactggaaaaactgagtggtgaggtgaagttatttgtagactgttccataaagagagggttgcgtgaagacttctctgtccagcataactagtattttcattgatcatttcatgaaaaaactaaaaatgccagataaaacattaaaaaatgtgttaaattgcttttatgaaagataggattcacataagcaaaataacacaaacgaactgcagagagatattagacaaagtactgctaaagccagttttcaccctaagggtatttaccaaacccaagtgaactagcatggcacaggagaacaggaacaaagcccaggacctgtgcaacctggggagtctgacagaagcatccccatcatctacataaagcatatggatcatctaaaaatatcatctctttcccataataccccacctcctataagagactaaaaggaagttggtcaccttgacacaggctgaggggagaaaaaaatccctaaagaattcttaactagatatcttgtcaaaatatacatcctctgggtagtgtgaggaaagtttaaagtgagaattgagttcaaaatgagttccaggttggtagtgcccttaagtggactagcagaactgttgctaatgtttgggataggacctactttcaaaccgggccttaaagaattgctgtagataaagatctaaggaatatgagagtataaaacatgcaaacatacacacacatgatacacaggataaagttaatcaggattcagtagaggtgaaaggagaagaaccagatcagcaaagacttccaataatgtaattatcagacacatgatacaggcttattttttaatatgattttaattaataaactttcaccttaatgactcctgccttttatacctttttcttgctttattgcagtgtttatttttaatggctgcataatattctagttatatatatatatttatgtgtgtgtacatctgtatttatgtttatttaatctagtttctgttttgcattttgagagcttttttttttaaagttcaatataccattctgtgaggaacatctttgttgccaaatcttaatctcacccatgctattattttttaatgaggttgggagtaaattcctagaactgaaattttgagatcaaatagtattcaaaatgttaattaacactttgtgcatgtgctttataacaatcaagactgagcaaatggaaaatgaaaattttgggtttacatgtaagtgtgctagacaaatgtggagcaaataagattggaaaaattcactactttttgctttggtgggtggtcgacattgaatttactgaattcagtgaaggacggaggtcagtacttcaaacatagaacacttaaccttttttctattggttggtgtcattattttgattgtagatatgtaggagtgctgtatgtccttttgttatcaatatagtactccatcagagcaaaaatttaaagtgtattctaccttggagatctgggaaatagtctgagtctggatagactataaaatgatgattatttttgtcaattatttattgaacatagtaaatgtacaacaagtaatattatatatcataatatgtaacattctctgtgaaaacaggaaaaatgcctctagcaattgtaattttgagtattgatctcgtcatggctcatattttgctggcttggaagactgattttgattttgttagaatattacaaaaattgcttcctagagtgtttggaaagttgactgttgccagttaagcctaaacagcaactataggtttgctggtaaagttatttaaagccacctgtgcctcagtaatccagatgcttctaatgagtcatgaaataatgctgtttctgtttagatgccagctctgattatctttatcagtaagctaaatggcaccatgttttgcaacctgtattttgactctgattttgtatttacagagcactcgatctctccggcttctcttagtcattttgagttatgcttgttatgccaatccgttcaaaataatttctttccaaatttgggagtacttagatttaagcacacctctgtgcgtgaagacaatgacagcatttaaacaacactatttcttctatatgaactagtactaatcatttccagtggcctaagctcttttgtggaccctttcacagacaaaacaagattgataggctcaacatgttttcagtttgaggtttattcacatcagaaatctactgcccaactggcaagccgtcatcagaggattctcagctagccaaccatacgctttaggtcagcaatgagatgggctcacctgattagagaacttcatggcattctgttgtccttcatatcactcttgctgttacaggaattacagagcaaacagtaaagtcttctgcaatctgaaacttgagtgagaagagaaaccatattgtctgttttaattgtgagggataaaacagaatagacacttagtacaaagaatgcagatagcacagatactttcctagttggcccagttccccagtgcttctgctgtagccatcatctgttatgtctggtaatgccttctcaatgattctttgacatacacaagaccacccctacaagagccaggtgagagagcctagagaagaaaatattaatactttctttctctgcgtgctgcctaccttctctgtctccctgttttctgtgtgtgtgtgtgtgtgtgtgtgtttgtttttttttgttgttgttagtttgttttgagacagagtctccctctgttacccaggctggagtgcagcggcctaatcttggtttactgcaacttccacttcccaagttcaagcaattctcgtgcctcagcctcccatgtagctgggaccacaagcgtgcatcaccacacctggctagtttttttttgtatttttaatagagaccaggtttcaccatcttggccaggctggtttcgaactcctgaccttaagtgatccacccgcctcagcctcccaaagtgctggaattacaggtgtgagccaccgggcccagccattttctgttaaccaactagttacttaaaaacaaaaaacctagcattagggtccagcctctttgaaaagcaatctggcagtttctgaagatgtttaacacagagttaccatatgacttagcaatttcagttctagatatactgaggagaattgaaacatacatccacacaaaacttgtacctggatgtttctagcagcattatttaatccaaacagtagagatgcccaaatgttcatctgctgataaatggataaattaaatgtggtgtatacatccattggaatattattcttccataaaaggaaatgaagtactgattcctgctacaccactgatgaaccttgaaaacattatgcttagtgaaaaaagaatgaaatgtaattagaagtagggttccccagctcacacacatgagaatctctgagctagatatactcaaatagccactaaaacatatttaatagattcaagataattaaatctggagaatcagttaaagagtggaaagagaagaattactgcagtcttccaaagtaaccttaaaataaagtgagttgtaggataatgtcacaaaggtaggaatgctcctcagtggttgtcaattaaaactcccttgtgccttgttgatcaaccatttaaaaatatgcgtggagtcactgtgtatcctttggtaattggctcatatcttacattttgctcttcctagaacatgccattttcagactccattatagaaacattgggcactgctgctaatggatcctcctttgacttatgctcatggaagagctccaggtgaacacattttactgatggctcaggatgagctattattaaccttcaaatttgttgcttcatttttgtttcttcccttgttatcttgtccttccactcctcttttaatttattgtaaggagataattgagaaaggtactttttttctcttgttttgttttctaaaccaagagactacctcaaaataaatagtagattattgtagaattcattgttatttaggagctagaatgtactcagttgttgaactacaaaaaaaaatatgatttttatttgtttatgagaattattttatggtcattagccaaaaatctaggagagagtcttacttgaagcaaaactccgattagttatttccattctagcagtctactgacatggacgtttccaacacacgtaagatactgcacatacacgtgacatgctgttctttttacttcaaaacatatgagagatgtccttctcacaataatccatcattaggtactcctaaatttagattctctgtcttgacattttgcctatacctgtgagtgactctagggaggaccaaaaggatctttcctttctcctctgggttgagatccttggaatttcccttatttccttcatttctctggagccttatggccacctttttaaggccctacctcttaatactgttgcatggcaatcaatgtgagttttgaaggggacattcaaaccatagcttttttctgtgttgtgaggaaactgcaagacgttgtttgggtcttggatgattagaaatgtggaaatgatctgtggtaacagtaacagaagcaagaaaggtctgttgactattttcttttgtctgtctgtctgtctgtctgtctgtccatccatccaataaagatagggtctcactctgttgcccaggctggggagcagtggtgcactcatggttcactgcaaccttgcactcctggactcaagctatcttcctgcctcagcctcccaagtacctggaactacagttgcacctcaccatgctgggctaattttttaattttgtgtagagatagggtcttgttacattgcccaggctggtctgtaactcctggcctcaagtgatcctcccatctcggcctcccatagcgctggaattaagggcatgagccgtcacacctggccgattttttttcttcttttgtaggagaaacagaataggtggatttctgtcagtgtttctgggatgacaggcaaactcttcacagttcttttcttgaaggttgcaaactttgttttttgttcctcccttcatgtttttgacatccagggagctctcaccagcaatttgaaggtgaggatgggataagtatcatcatagccgctactagtcaggagagacaggaaaacgtagagttctagttcttgctgctggaactgtattagagaggagagtatttctagcttcagttggaccactaaatgtgttttccccccaaacgttgcatacatgatcattatatttatatatataggacataacctatatattgtttctcttaagcttcacctacatttatagtgaggctttttgtgttttgtcttgaataaccagctgctttatttagagttgattccatggaaaatattttgtgtgtcaaactccatcacaatatcagggttcagtactccgttttagacttttcctgcactactgtgatctggatccttttattcaacctgcgaattccttggaaacataaaatgatactaagcacattgtaggatatatagttgaaaaaactgttcttggagaaacagactgaagtttgaataatgaacctactctatgtgtgaccttgagcaagacacttcatgccccttaatcccctgccatgagcctccattttttcatctctatggtagataataatattataggaatattattaggatgaagtgagtatttttatgtaaaggattcagcaaagtgccagtttcttagtagatgtttggtaaatcagaatcagcccctttcccttcttttcctttttttctacatatccaggataataacttggcacctgtcttaacctaaagtataacgcgagagctacacaagaataaaatataattgagcacaatattgacaagacgtttacttgtcttatgatgagaataatgaatttatttctatttgggagattatcttttataaataatactgtaatcaatatactttttcagccctttcttgaaacatggatttctcactgagcaaactttatgtaaaaacataattactatttgctcctagttggtttgtaggtagaattcacttggtctaaaaagacattctttctcgttttttgtttgtgcatatgttcattcaacaaatatgtactgtgtgcttattccccgggagaaactatcttaggcacaaagaatacaattatgaacaaaatagtattgttgttattaataataatgacacactacctaagagttgagtgcaataggtaattctttccttgaaggggcttgttgcctggattttcttcctgtgtccagcagcagctcacccttgggtaatacagtaccatcactaattctgatttacttgactttgctgtcatagtaaatcatttgagggcaaggataagtattttacctttgttttcttcttgatatagcaacaaacccaaggtcacatacttgtaacaaggttacctttgtgacaagtttagtggtggtggtaggagcagcaacagcattaagccataatgatcgcatgtgctttaagaataagcacttactaaggaatgtaatctaaaagaacccctctggcagggtgacagctgtgaattcagggaactcttgaaccattcagctggctcttagagccaattaaagaccccatttattgatgcagtcaggagttccatatttattatactgtatactatttcataatccttagaaagtagttatgaagcaaaatatttgctataaaagaattcaccttcactgtggttcttttctacgtggaaaggccaatttaaaaatcaggacacattaaaaatgtcagatggggcatgccacttcctatggctcaaaaagtcatgatcattttatgctattttcattggagcacttagtacaagatggttataatttcaacatctatacatttaatattgattatttttaattgaaaaataaagagtagggctgggtactccctactactttgggaggccaaggtgggaggattgcttgatttaggagttcaagaccatcctgggcaacatattgagaccctgtttctacaaaaaataaaagatgaaccaggtatggtggtgtgcacctctagtcttagctgctcaggagcttgaggtgggaggatcccttgagcctggaaggttgaggctgcagtgagctgtgatcacaccactgcactccagcctaggcaacagagcaagactgcatctctctctctctttttttttcttttctttttgaggcagagtctcgctctgtcggccaggttggaatgcagtggcatgatctcggctcactgcaacctctgcctcccgggctcaagcaattctcctgcctcagcctcccgagtagctgggattacaggcatgtaccaacaagcctggctaatttttgtatttttagtacagacagggtttcaccatgttgttcaggctggtcttgaactcctgacctcaggtaatctgcccacctcagcctcccaaagtgctgggattacaggtgtgagccaccgcgcccagcctgacctcatctcttataaaaaaaaaaagagtagggggaatgatggctaacactatctaatgtttttataaattaaaaaaaagtaaaaattaagactagagaaagttctttctgtcctgctaagtgttcccagcaaatttctaaatctttcacttacagtaatatttccacaaaaataaggcaagcatgttttacacatttgttgtaaagttggtctcattaatgatattgactagtattgtgttgcctaaagtaacaagaacaacattttttgaatttggactttctttctccctagtttgtgaaatcagttagatcgttctgtgtttggcaattctaatggaaaaggagaagagcatactaggcacagaacactgtactgaatgcccttatctacgttacttcccttaaacatcaccacaagtctttgaaaaagtttattgcaatccttattttataaatgggaatgctgacgctcagagaatttaaataattttatcacacttatgctaataatgaatagtggtctgatgtttgacacaagatcattttgattcttccctctgttccatagtcatttcagtgagaatcctgtttctatttctttctgaggctttggtttctgtttgtgttttattaatatgacaatatttattacaaaccacattaaactctagttgggtagaatcaaggaataaataaatgtggaatcttattacttaaaagtaaatgaattctaaaagaagggaccagcctatgaacactaagatgttgtcattccagcagttatcaggtggccttggtgcctgttgccagctgcctgggacagcgtgtcaaatcatcgtccttgtaatactattgtcagtttcccttgcattccagccatccatcatcattcgacattttctctggtgcctatcacctggcctctcacagctgcaattagactataaatataatgaagggaaggagtgctctgacctgtccagtgctctaaccaggattgaacaacatgttccttaagaaggctcctggccagcgacggtggctcacagctgtaatcccagcactttgtggggctgaggcaggtggatcacttgaggtcaggagtttgagactagcctggccaacgtggtgaaaccctgtctctactaaaaatacaaaaattagctaagcatgttggtgcgtgcctgtaatcccagctactcaggaggctgagacaggagaatcgcttgaacctgggaggcggaggttgcagtgaactgagatctcaccagtgtacaccagcctagggaacagagcaagactccatctccaaaaaaaaaaggttcctgacagtaggtcccaggttatttgatcatgagaaggctcatgaggaaaagtgagttttgtttctcacccagaatactgaaatgctgaagtagatttccgggggtcaggactcagaccttatgatttttggccgtgacctttacttttgtttctgacagcttgattttcaagaatattttcattgggttggctctatttattggtaatgtagtaagaaacatttgacttctcatcttcaagaggaaatcgtgacaaatgcagtatagatggcacttggtaatgaaactggaagagtatatgaggttcctgtaggtggaattctgtttaggtgttggggtagggaggagagtctcttttttcatatttctgcccgaactttactttttatttagcttaactgcactatgtgaatcagtagtcatccttctgtagctagcaggggtttagaactaatgaaagtattatttagtatctaatctcataccctgtcaatgtgcatatattttcacagccaaatcttcctctcactgacatttctagtgactctgacgttttatttttggtattgtagcttatcttttgttgtttttgttctctgtaatatggtcatcaacaaacgtttattaagcacacctactccctatacagctttgaggatacagggagatttgcttacctgtattagtttttgacagttgcttacattgattcgggttttgacagtttacatttattaggctttcacacatactgtctcatctaattgctataacattttagcaagttaggtcttttttcctttcattcagcaaatgtattcttgtataatcactttccaggaagttacattcctggtgggaaaaagtgacataaggaagaaaacacatagtaacagaagtgacttgtgttaaggttcataatgggttattttatacatagtcactgttaatgaaattgtggactttgagacaggggcatttgacagtttggggatagatgtgggacctaaagaaatggtacgaggggagagggacctccagatggtagcgcagtgtggctgaggcatagaggtgcgcatgcatagagcgcaactatacatgaaggttttcatttgactggagccaggttagtcaggtctgaatttaattaatgagtacctaatatcgtagcacttaagaatatttagaaaccattggaaatcatctagtctatctcgtaaaggttatcaaaagacatgttcatattgagtcgattattacattatttttatgtagacttatttatctgttcctgaagtgtggaatatatcctagtttcttctatacacatctctttcatgaatcaattctgactagattttataatcttaaaaggaaatatgttgttaaagaagttatatttatttatcatttttgtaaccgtaccatatgacctttcaaggaggattttattaaaagtgtagtgtttgtgtcagtcttcatgctttccttaactcagcaaaacttagcagcaccttcatatctctgatgcaaatattgtacaagatggattttttttaaatgagaaaaaacagtccatgatttttaattaagggttgagtatgccattgtattttttgttattcttaagaaaacgtatgctctgattagttggtagaaacaactgatccaaatgtctagactctgatgcctctgggaagtcctgatgatccagggtatggatttctgaagcttcacatgtttttatcagtcgatttccaagatgcccagagaccattaagatagataataaatcaagggagatttagctgtgtttggtaacatacaaagaactatactcagaaagaaaatgtttaatttagaagaaggaaaccaaatgttgcgagtgtagattgctagggttttgaggaagcccactaaatagtagccatctttcctgctggggttttgaaactattgagaaataattaaggtagatagttagtgaaatgtcacttttatattgatttatgctagattgaaggatataacccagtttgagaatcaaacaaagcttgctaactgaacatcacaattaaacagatttactcacccatttagaaaagatgttggcccacttcaagccttctctgacaaagcggggcctttatagctaaacttacaccagacaccactgaactatcttcaggcattctagtttctaaagtggaatatgggagttgctaagccatgcatgcccagccttttcttttcaatttttatcagtcaggcgttatatcacttcccctggagtgggtaaaaggtggagagaggtcagagattacattagttgaacttcattatagtggcaagaaacataagtgggggtagagtgtttttcccaacatccaaagtgatacatcttttcacattctaaactctctgaaattaggatgtatctgaaatcagtggctgcctactggaaaccagtcatggtgaattgtcacccacacagtgtgtgtgagcttgggttactccttgcaccatgacccttcattgtttccgttaatgaagcaattaaggaccatttgaggaaagagtatgagtcctggtcggaataggaaagccttctgtttaaaccttctgatagcatcaagaaagcatcaactttaaactttgcaggatggatatcagcagcgtggaataaaatataggatgcagcatggagcactgctttatgaaacacacgctgttggtgacactggatgacaatgtttagaaaacaaggacattgaaaactctttagtcagagtgattcggaagagctagacttcaaatattatttagtgttaagaataccttaacaaacttatttttcttatatttccttattgaatgtgcctgagaggtttatggtaaccatttgtttatgtaaaaagccaaaggagctattcaataaggaaaaggaaacattccaagaaagcattatatagtttaaatagcaggacttttttttttcttagtgatacataaaataatagtgtgtcttataatcattggggtcttagatatgataaagtgtgatcagttaggcttatatgaatctctgctccaatctttacacatgcagcaactttgaatggcaggcacttcatcctttctctgaaagctttatgtgccatactatccaagatggacactggtcattagagaccaaaattttcaccttaactgaattgtagccttgcactgttcctttaaatgtcgcatttattcttactgtgagtccatgttcttactcagagtaaaagtgctgttttttgttttgttttgtttgtttgtttgtttgtttgttttgagacggagtctcgctctgtcacccaggctttagtgcagtggcgcaatcttggttcactgcagcctgcacctcccaggttcaagcaattctcctgcctcaacctcccaagtagctgggactacaggcacatgcgaccatgcctggctaatttttttttttttttaatagagatggggtttcaccatattgaccaggctggtctcgaactgctggcctcaagtgatccaccctcctcagcctcccaaagtggtgggaccacagctgtgagccaccgtgcccggctagagtgaaaattctaatctgttgtttattcaagtgaggaagaccagatgaagtcattcaaaataatttcgtacataccgaaggttactgtttgcaaagatggtcctaattatgacagtataggactcatctagatatgcttggtttgtttatttataaaagtttcaatgagctaagtctgttttttttctttcttctgaaagggggtcctgatgacaacttaattgaaggtggaggaacaaaatttgtctgcaaacctggagccagaaacattaccgtcatattccacccattactaaggtaagtcaagtgctatgatatacttactgaagatcaatattttcattatttatgctggtctactgaatgccagttgttgagtcagcactgaaacaagtcataaaagaaatttattccatttttagggcctcactattaaagttagtcagtttagcagataatctcaatcccactgagtagctacttattttcaggagtaaatacttttatttgattttctttttttcacactcgctacctctgtccctctcctgccctcttcccttccctccctccctctctctgttttatctatctcaggagttggaaactgcttactggagaaatctactctgcacacgtatttttaaatacatttttattgacacacagacatgcttatttgtttatgtattgcccatagctgcttttgtgctacaagtgcagacttttaattgcaacaggactcatatggcccacaaagcctgaaatacttattttctggccctttacaggaaaaaattgcaaacccataatctgtccctctcatttacaccaatgtctgagatatcctttgagaattggcaggtctctgaaatatgatttataaaaaatgaaagacatatacatcaaacatatgtttttatatattgaatgataacatgatatgactagagtgaaatctattctaatgctcagttcattgtgataacatgattataggaaagtaagaatccatggtgcctccattaaagaaaaaatataaatcctaaatacttttaaaaaggtactttatgagagtggaaaaaaggggcaattgttgagtagataaaacgtttcagtttatgataaaaaagttctagagatctgttacataaccatgtgcgcatagttaacactactgtatggtacatttaaaaaaggttgatggtaaatgtaatgttatgtatttttttaccacaatttttaaaatgcaccttttgggatccagatatctaatatatcaattgtgtgttttctctgtaaagaaccagagtatatatttgtggcattttcgcataatagagcagaaactcctggatttactaaatgttaggtacttcagaatatcaccttacctttctcacatcacttctataatatttgaggcatttagaataacagttaaacaaatgctgttgaattgaccagatataatattatgtatattttctccaagcataaacagtttattactacaattatcctaccttctcattaaccgagacttactaaattgataccattagaactaattacattctaatctcttatatagctaaccagtgttctaaatcgtagtggattagtttcctcaattgattttaaatacaaaaacataaatatgtaaattaaataacaaaaacttgactttcacacaataaaaagtttttaaagaaattttattgcctttaagaagtctgttgtagcagagatttgtagcaggtaaattcatttaggaaccatgggattaagaaaattaagactattaagaggttaagagaattaaaactatttctctgtaggtttagttgataagtactatatgtatataataagtaaattataacatacagaattatagattaaataacattgattatttttatttgactttggtaattagtttagttttcactgtcttcttcaattacaattgatttctacttaggtaatgttgctaattgttagaaattggaaaataccttaatcatgataggcatcttctaacctagatttaatgccataatttgctgctaagttggaactcttgtgcttacatttattcccaagtagaaaagaaaccctttagaaactattaaccgtgttgtcagtaaccacttttcaagagatttttcctctaagttttttctttttaaatgtgaagttagaatgaaatatatatacacacacatatatgtaaatatatatgttagtacttattttacacttaataaaatgcatttttttgtagaagactctggtggaacttaatgtattacagttcttgacagctacttgttaagtctttataaatgctgctttgctagatagttgtttcaaggcttggtaatactcccagtggttttactcacttacttggtttctaccttcattcagaattttaacttactagtgattaaaaccggaaaaagtttgttccctgatgtagtttatcattcattctttctctgtgtatctcttaatggaaatccccaaaatattatgtggtctgaaaggtaagttcattctttgataaacggatgactatgatggagtttaaattagcccttggcccaaattgcaaccttgtcaaaaactcctgattggcttgtggaacttgaaatgactaagatcttttagtggatttttactttttttatttgagttttcacacttcagcatttcctgagtgttggatttattatttcttctaaagttcagaagtttagtttttgtaatgaaacgaaccagtgttcattatcacgcttgtgtattttattagtactattataattcaaaatttttcttttatattcaacaaatatttattgaatacttatgatgcatattttcctatctccaagttagatgtggtctcttgttcagatgtagttactcttatttttatgagactatgtaaataaaattgtgtagatatgttttctattctttagaatggtcattgcttttattctatgctagtttaagtgagtatgagttagcattctgttatttgaaagatagtgtagcctaatgggagaggcagtgcagaagaatgaaagctggaaaaatgtacaggattgcaaatttcaaatgaaaaacatgacaaataatcttggttcaggactaggctccttcactttagttttactcaatgcttgttactagactctgattatgccatgtcctggggaaagaaaaaaataagaccatatccttacctgcaagctcctctcttggtagctgcatgggttgcaaaaatgaagaagcctgaaaacaccacatattggcgaggacatggatcagtgggatgtcctataccttgtgggaggatataaattggttcagcctctctcaaaactggtttgacatgattgagaaatcacatttcctgttactcagcagttccctctcctaatgctcttgaatgtgtttctacttgttatcaactgactcatattatttttctgtcccaatttgccaaactctttttctaattgattacaataattattctatatttataacttagctcatattaaaaaataagtttggctgggcacggtggctcacatctgtaatcccaacaccttgggaagccgaggtgggtggatcacctgaggtcaggagtttgagaccagcctggccgacatggtgaaaccctgtctctactaaaaatacaaaaattaaccaggcatggtggcatgtgcctgtaatcccagctatttgggaggctgaggcaggagaatcacttgaacccggaggcggaggttgcagtgagctgagatcgcgccactgcactcaagcctgggcaacaagagcgaaactccatctcaaaaataaaataagttctagaggaacttatcacaagttgacttttatcaaaagtcaggacctatttaaacattgtatcatttttttttcttacgtggtctcttggcaaactcagatttgttttcagtggagggagaatccctttcaagtgcgtaggtccttcactttcctttgctactttttccctatgtctggtgtcactggtactctgtcttcctgaaactttgcatgactgttctatgcacttcatttattaaaatcattcagttcataattttcattcagctagcagtgcgttctttgcagcctagcgggtttctatattgacaattccaaccacccttctaagaataccacagagcagtttcccgttatgctggtttatatattctcagcagtcgtttttactctcctttcataaaattattataccgggtcctcaattctggtaatcttgctaacttatttttatactgttctcatagctactgcagttccatcactaggaaatctcacaggatgttagcgtcaaatatactgacttctaatttgttcattccccattaactccgcttatccctttacttgtttatttaatgctttccttattgttttttctttacagtcaggcatgtctcttagagagtaaatttctggaaagaaatgggctttagtattatcttccttgctttactcttagcctaccaagacattgtctgtaattaaacctttaatgaatgtttttaatgatagttttttttttgtttgtttttgttttttgttttttaaatagacggagtctcactctgtcgcccaggctggagtgcaatggtgcaatctcggctcactgcaaactctgcctcctgggtttaagcaattctcgtgcctcagcctcccagatagctggggttacaggcatgcgccaccatgcccggctaatatgttttagtagagacagggattcgccatgttggccaggctggtctagaactcctaacaggtgatccgcccgcctcggcctcccaaaatgctgagattacaggtgtgagccactatgctcagccaataatgggtcatctaatcagtgtttctgcctgtgggtctaaatgaacaaaaccgtattaaaacaaaggtttctagccatgcccggatagattctgaaatactttccctaaaatacagactctgaaaatgatataactgatgcctttttttcttccattgacatgtttcctgtctttcagctctctctagaagacttttaagacgaatgaattcattcttataaatggaatttatgttatgggccttgattttggggaacagaaggaagatatgttaatgttggaatttgagtgacattatttctcttcttttgtgtagttctgacatggatttaggtttctttccaaaaataattatttttgaataattacatcatggtagttattaaccatgatctgcatataaaggaacctttggcaatgaagtacattttattgcagtatcaaccacaatttaaatcagagtgacactttttgttacaattaatatataatgtagtcttttcaggaaatttgaaagtactttgtagctgttatttgtgggatttgtggggagaaggagtgagaatttatttttctctttgtgttttcattcatttcttattctttattctctccaagtctaaaaacagataatttattgtgccttagatttgttagtacagttctttcatgtagcaaacacaggtgagaacacaagttatttcttagaaaatctaaatgcttgcacctaaccagaagtatcattcagaaaatactctaatgcctttttttcttcctggaccaataaggtatattggtaggagcattgctaaattgaaacaaagtcatgcctttgacaggtgcacttagcacctcataaccacagagtcccagttaaacaggtggaattgtcaaagaaggatggcagcacttaatgcagcccatcactgctttagaaacagggtttagctaggacatgactcaggaacaagtacaccctggcccaaggaaaccttccgagtcctcacatggcctcttccctgtgcactgggacagagctccctggagtcccttcctcttacaagaatatcagctctatgggatcagggccctgccattgtgacctcatttgaccttaattacctcctttagagaatatatattaaaattcactgtcagaacagactattaattaaagtggtatttaatcgtccttttagcattggagccctatttcaactggaaaggagttttgtgcattgtatgagagagagagaaactagaccactaaaagtgaagtgttggggctgggtagaaatgaacacattctaagttttgatgtctgccaaatcactgtgagcctttgtttcccttatctgtaaaggaaggaaaaacattcattaagtgtttgatgacagtgtcttggtaggtaaagagtaaagcaagcaagataatactatacctcatttctttcagaaatttactctttaagagacaacgcttaaccagaaagagaaaacagcaaggaaaagcattaaataaatgagttggttggtttggatgttgctttctacctgttaagttttgtgattctgtgactgggcagtgcttttataatatttagggaatctgaaggcctggcattttgaaatttaaaagtttatgcaaaaagtgagttttatagtatgttggagaattgctgcttatttgcttcaactggcttttaaaaggcatttggctctttagggtaatgaacacttggcatgcatgaagtaatatgtttcttacaggagaaccaaagaacagttgtttgcagtcttgtagtgacatggcagaggcaggaggctggggacatggggatgatgatgccattcaaattgcaaagtgttactgatgctggttctgttgaacactgctggaatattgaatatctgggctatgagcatttttcactagtaattattcacacctcattaagatcagacatcagttaatgtctttctaggtagagcaaaaagtgaaatatttattggtcagtgagtaaagtcctggcatctaggtcagttaagaagatgaacctctcttggcaacttgggcttttggtgatagacagtatggttggctgtgtaacattcttaagactagtaacagtcagaacaagtagttgtagtcatatcatctaatgtatagagaataatttctaaaaattactcttagatgtatatgttacatgtagaaatcgccatattgcagcagtacagggtactgtttcatggcctgtttgtgaaatagctttgaaatgcctatgattaagagatgcttaaagttaggaggacaggaagtaactaaatccaaacctggaggagtgaaaggctccaaaggtgattatgctattaactagtaatttctgtttccaaaagtgacatttcaaagtaaaagacaattgtgattaacatttttattttatactttttgttttaataattatagtacttataatatcacatattgccaatatttccagatcaaaggcatatataatttgctgttataattaagcacattttccctaatatttttatctttgaaaaatgcagtgacattgttctacccatgtcagtttgatgtgtacattgatacttatttagcagaatattattctcagtgttcacaggtatgtgatatttttatacagatgcatgtttgttcttaatgagctaaagcctatgtagacattttgaaagatgttagtgattagacagcctagcaaataatgttgtagatcacatattattcatgcatgggaggaaatatagacaccttgttgcatttttatgaaacacagccatttttccccctatgctcagaattatgaaaaaatattgctagttttcagtctgcctgacctgtaaggtctgtgaagtgctgagtggttggtatacatagatttcaaaccctgtatttgagtaacttcttttgaattaatattataaatgttaaatgctataaaccttcaaaccacctaacttttggagattaaaaaatttcattctaaactttttttacttttatattttcaaaatgtatgacatatggctaaacaccgattgcaactaactgggcggttttatactactgaataaaatggagagccagtcaagatatcaacccatgtatctatgcacatttcagcagtttctaaagaggtgaggcatcccaatctagttagcacaaaagaataggcggtttctcatgagaaacagtagggaaaacgggaaatgttagtgaaaaacagaggagaaacagaagattttttatctatttacatatataaagagatcactttatatagaaatcacttaaagagatagttattttgttatttgttgcttcataagtatggattataactagttggttgtatgtttagagagattctactctacacaatgagaattttcaaatgaataaggcagcagaaataggaaagcttttcttgggagataatatttttcatggaaatgcttaaccagaagttgaagttatgatgcagttaactggttgttgaatttccaggtctacattctttaaatctctgattgtaagccttcctaatatactgtgcagcttcagagctcggggtagatatgtttcttccaatcttgctcatttgagttacttttttatacttcagcttaatgctgatgattatcattggcagagtcaaggagtatagttgacttctgtgtcgcttcagcattgactttcttctttggaacacaaagagactcatggaggggttgttagacgaatgccacccctccctaccatatagttgcttctgtcctctttctttttttcttctctgcttttgtttttgtatttttctttttccttttcatgtccagtaactggtacgtacgagtataacttaactcttccagtgactgttaaaggaaaaagaaaactagctttcttctgttgtaaaagctaatgtgggaccaacgctgtatttccaaataaacctaaaatcagcatgactttgctgctgtgattttgacctagatttaagctgatattttagatgcaggttttcgtctctttatcaattatttttttttattatcgattaaccttattagcagcttatatataaaagacagtagaaaagactattcagaacaaaatgcttgcataatttgtatgctgctttttatgtattctgaacatgtgttcgtcttttggactgcagtacccaaaatgtgcttattcagcatttgacgaaatatgtttatgtccagccacagggccatttacatctgattttgaaatctgaattgataatgtaatttggtgttaaaaataacataggcatacctagggggaaaatacagtctctccctttaataacgtatattcctttgagtgttggctatgcattgtttccttgtatgatttggaaaattattttatcattccccttgctcctcagaaaacagaaagacacacacaccccctctttccgatttgttctgtttctgttttgcattctttgttactgggtctgctatataataccaaagactcttctttggtcataagtgtcatttgaacatttgatcattaatattgcctactgtgtttttaaaaaatgtgtcatactgcctgtgaagtatttttcatttcatggtcatgaaatcttttttattttccttttgtagttaaacaaaaataggccccaaaataagcaatgctattttctcaggactttattatttattaaccgagaaaggaaacttctttgattcagcaagataagtgagaagagccagctagaaaggagaagaaggtggaagcatcataaaggaagttttagtttttaattaccttaatttcattttttggtaagagtagtggttatgaacctgggaagtgctgggtctgactttcttgttgcacttgaaataattgctggaatgtttgatgtttttatgttgtttttattagttgtgaaagaatagtaattttgacaattgctatttttaaactcgatgagcattcttcaaagtccatttctgtaaaataccacattgtaaatacatgagaaagtattcaataatgtcaagaagaaaaaaaaactaacactaacaagtttctagggtatcactctttagtgaaggaatatggaagtatgttacttaattggactctgtaaattcagaatctctaaattttaaaaatcttttaaaatttttattgagctatacatacatacattcaaatgtataaatctgtacacatatttttaaatatttgtatatttatatgaatttttacatgtgtatacataagtgtaaccatgacccaaatcaagatattagacatcgacatagatcattttcagtaccctagaagacttgcttatattgacagtcaatccctttccctgagagataaccattattgtgaattctatccctacagatagattggttttgcctatggtttaacttcatataaatggaatcatatagtatgtcctctttggtgcctgacatttgtgtgacatgatgtctatgttggtcatccatagactaacaatgatttctttatgttagtcattgtgtcagtatactactgaaatgagcaattataaaatataatatttaatcattaatttggaataaaagaactttcagaatcctgtgatcctaaaaactgttcacaatttaaacttcttctaaacagctttccaagaaatcttttgatttcttatcttgtggggccaaggaggttctcagggcagtaagagatcttgcggtggagcagtgtccagcagagcagtgagccagcatagctggaagccacattctcttcatgatgaatgtagactgtttcctacagctttggtagtaaaagctagcggagcaaaaattagttgacatgtttcctagactttgggttttctgatcagtcagtgaaaagataattggcaattaacatgagttgctacttttattaaagaaaagggatttttcttagaattaagatccatcctttttaaggaaagataattggcaacttaaaatcgacattctctctctctctctttttttttttaagagagaggatcttgctgtgttgcccaggctggagtgcagtggctgttcagaggtgcagtaatagcacactgcagaatgcctgggctcaagcgatcctcccaccttagcctccatacctggcgtaagtcaatgttcttaagccaacattaatatgtaggctagtttttggagacagtaaattcagtcaaggagggaggagagaagcttgacatgagggattagccaagaaccagatgcagaattatcacaggaagccatgagcaggtatggacccaattgagagaccctaacatagttgtagtgagttgggaatttacttttattgattgtaaatcacatccttctggtccctaacaggcagtcactaaaaatgttttgagtaaatgagcaaatgaattgaaggtaaaagtgatgggggcagttttaaatgtataaggcaaattggatggatattgaatattctttcagtatgtctacagtacctttcattgtaattcttgaatattaaaagatactttttaaatctctacactgtcctgagcacacatatatatatagatacacacacatacatatacgtacatacaaacacacacactcattgccttcactttagctagttgattattagaatatattctgtacagtcacatttgttccagccactttgtttttgaagttttagtacatctgcagcctctcctggtggctgccagtatcgctgtcacctgcaatgctttgccaaccacctgaagctctcttactctgtccagtgtgctgaaggtgctggcatccatcaatatcttttttgcatattctatttagttttgctttttgcatctgtgaaaaatagtagaacatcttctcaatgtaagagtggaaataagaatagtaaagaaaattgtacaaaaataggccactaaattcattctttagcatgaaattagaaatgctgaacaggttcgatagaggtgcatcaatgctcagaaatgcatctaagtgaatctacagctctttcttactttgaagcttttaagaaaattgatacgaggatttcactgaagattaaaaagaaaccaacatccttctctgaacgttggaggtctgtctgctttataagcctcaactcattatattttcttttttacatgtttttgattgacatgttgattttaaaaatgcaacttcaacattcagtgggagttgacagtatttaaactgaattttggggcaaaattcttcaatatagtcatatttttctgttatttttaattcattcttttttttccagcaaatactcgctgagtgcttactatataccagacactgtccttggctttgtggaagctgtgttcctaatgagggtattgtggtaatttgagaataagagaaaatctatgataaaggagtccctcattccactaatgctaaatttcttccagtttccttttttacacgtagaagattatctgttgtagaggcacagctcttttcatgccatttctttttcagaggcagtttcacctctgatcttcatcctatttccctccatcccctttgggatccagatcaaaaaatcttgaagttctacttagaagatccttgtccctcttaccccacacgtctagtgttgctagtttctaccagtcctgctttataaatatgtctcaaatttatccattccctgcttttgatacttgttgccattgctttagtcgctcagtttcctaactggtttctgctactccaaacctaaacttctttaatccatcttctacactacttccggagtgatcatgtcactcccctccttctttgtgatttcttatcctcagcccttgaagtggaattccttgttgtagaatagaaggcctgactttctgactttatgcacactgatctcaggcccccttgtacacttcaaagccacgaatccttcctttttccaggtctgtcatgctattttcaaaatttttttctttctaccaaaaatgcatctaccaacactgacctttgacctccttcattatctgaaagacattttatccttcaagaatcagcgcatgtatccccttttcttccaactttttcctgtgcctgctcttactcacccttacataatgtaagtggattgctgtctgcttttaaaaaattattgtgattttgccatatttttattatagcacctggcacattgtctggagatgactcaaaagagaacacaggtgttatttgatgtattagtcagggttctctagaacctcacacaatcacaaggtcccacaataggctgagggacccacaatagcctgcaggctggggagcaagaagagccagtccaagttccaaaactgaagagcttagagtccaacgtttgagggcaggaagtatctagcatgggagaagatgtaggctggaaggctaggtcagtctctcttttcacatttttctgcctgctttattctagccgcactagcagctgattagaatgtgcccacccaaattaagggtgggtctgcctttcccagcccactgactcaaatgttaatctttggtaacaccctcacagacacacgcacaatccgtactttgtatctttcaatccagtcaagttgacactcagtattaaccatcccaagtccaccccttgtcaacttgaacccatacacatctcctgagatcatacataatcttaaaataaagacaataataaggtcaaaattacgcctaacataatacaactatcctttgtacaaccagaaacacaccaatcctcagcccaaatgctgctacataaagttaacaatacttaaatgctgatatgaagtcaataaatcttatgtcacatgatgaaggaaaaaggaaataaaatgaagaaactttcttaatgcaagtgtatacatacacaaacatgtttttaacaaaagaaggaggaaatactcatgataattacagtcctcatttctgtaactggtcacgtggtcatggctggtattgatgactacttcctctactgatcattttcctttccccaatgtacagttaccgtggtaaaaggccagaggtctccttggggaaggatgggagaaagattcactgcataaattgtcagtaatgcggtaggcttcttcctcaaggggacccggcctcccgttcattcaaggagttctgggtctgtaaactggctcaagtctgaaaattgattgaggggctttgattctctgtttttataattcaaattagtcttttgtccatttgacctagaagttttctgcttatataaattaagtaggtatgcagtaggcttcctatcaatttcacttttaggaatgctgtgattaattagccaatgccagagctctacagaagtcagactattctgattgctgctctgcccttgctgtccattacggtagctatgcctactttgcgtttgatggttgagtgccatcacttgacccctgccatcttgggatgcagttattcccattgtatttaaattttgtagttgaatgactgtggttcccatggttagatctgttataactttattactatgattatgatgtttacttgaatatgtaaagtatataatagcattaatagctaacatttaagtacagtttgcaaaatatgtgaaaatacattgtcttttttggtcctcataccaaccctaagaaatagtttgaaggagtcatattatttctgttttatagttgaggcttggacagtttcttgtttaaagtgacatggtattagagacaaaacttaaaacccgtgaatctgattctaaatcttgtgttttctgcactttgttggatctggtgcctgggcatgaagagagccattcccaggtactccatgggatgtaccacaaggtgattcagggattcaggccacctccatttggtggcccccctcacgcctaggccctcagaatcttttcatttagtaagtgcatgagaaagatgggattgtagaactctcttttaagcatcatttccttcatttttctgtattcttcctgtggtgcaaactatttaaagttttgtgagccacagtgctcagccatagctgtatcccctttgcatctttgtatgtgttttctttctctctactcgatgcccttttcctcctccttcacctggtgaatttctgctcatccctcagcaacatcttttctggggagccttctgccacctttttttttttttttttttctttgagatggaatcttgctctgttgcccaggctggagtgcagtggcatgatctcggctcactgcaacctccgcctcccgggttcaagtgattctcctgcctcagcctcccaagtagctgggactacaggcgtgtgccaccatgcctggctaattttttgtatttttagtagagttggggttttcactgtgttagccaggatggtctctatctcctgacctcgtgatcaacctgcctcgacctcccagagtgctaggattacaggcatgagccaccacacctggccctctatcacctctcttattcctcctcttctctcagtggtccctttccttttcctctgtgcccttgtgggacctagcaggttatttcctgagtatttgttctccctcataaagaagatgctagggaccattttttgattggctttgcataactagaacttgaatgatttttagcacacactagattctcagtaaatatttggtgatttttatttggtaatgtgatttttttatggaaattaaggtcatatagttctctgtcagaaccaggatatcaagaacagggttgttaggaattcacacagttcatcgttcaggttttgtgctcctgtgtacctttggaccattgccccctaaaatagattttcatccaatgtttcttcttggagttgcttttgatatccaaatagacaaattacaaatatgcacttccaaatgtattttgtggtaaagttatgtaaagaggactagtttttatttaggtaattgtaaagatgaggctgaagcagataaagaaggtcttttgttttgcaatctttattgctttatgttagctggcaggctgcctgtgtttgattaaaaatgatagtctgtaaactccttaagttagaccattaatttcccatgacagcacacgaagcttctcctctcctcctctccccaaacagcatacatatcagaggagcctcctatgtgagacatttgtttaacgttgcctgtcagaaaaggtgctacaacaagtcagtcaggtttggagtttgcaaacatacttccaccttactgaacatcacaaaggctgtcaaaaatttcatgtccttatattttttcttctttccagaagaaaaaccattacagatgtaaatgttagagaaattttgtcatacactttggagcttctccaagaagtatttttcatagcttggaaaagaggaaggaggcctctgctgacacatttgcaatctttccagtagtttgtgtgaactttatagtttactaccctacaagaggctagatattttttcttctaaatactacttatatctcattttctttttttttcttgctttctctgaaaatgaaagtgtaagctttttcaaatggccttgatatttctaaaatttctgtttatttttccttttactttcttctcagtcttctagatgctttccaccaaacccacttctgggaattatccacatgtgtacttacttgggagtttgatgaaatatatgtatgtgtggtatgcatatttctgatattattttatttgatggatgttgaataactactaagagagaaaccagttgctcttcaaaatataattagcaacaccaggcctggagaagtttacatttggttgtgacaaagttagtagtatgccctctgcaaagaagagaaggggaagatggatgcatttctaatgcaatcaggaaacccctctataatttaaatatattagcatatcctaagaaacccaggtatttgaatgttcctaagacagctcgaagcctttcctaaacaagcatgattaaattacttggagcacattgaaacagcacacatggcccttaatggatcagcattatcaatatgcattttcacggccaactccaggaaagccatcactaaagccataaggagtcaaattaccgatgcagtcctaatgattttgcttgcattgctcacatccagtttgccactaaatgtttgacggcacgcaaacactgaatttcgcaaacattagtgtcatttcctacttgtccctagaaatagtaatgagcatacatcttgaatcctcttattttggatcatatacaagaaagtaaaagttttcaaatattctgaagtctgggcatgttaggataatatgacatggaactaattatgtaagggtacattctgggtcatttgaaatttgcgtatgtattgcaaaggtcacaatcaactcaaataaataataataagagctaaaatgattgagccctagtgatgagctcagctatgttatcaacactttgcatgtagtatctaatttagtattcctagcaactctgtgtggtaggaaatagtatcacccccgttttatagctaaggaacctgaggcatggagagatgaagtagcttgacaaagaccaggctattgtaaatgggtggctaggatcaaacctagacagaaggaccctagagccccaactcttacctccaactctatgcctcaggtgtgtgcctccatttaaaacccttaccagaggaggctcaaaggctcgaggactcttccatagtggctctcattaggctgtttgactctgataatccagtcaaacagtttatctacagtcaaacagagagtagataatccactctgataatccacagtcaaacagataatccagtttgactctggattatcaaacagcctaattagagccatcatggaagatttctggttcataaacagttctcctgttaggttaaaatacgtgatttttctgttaaaaaaatcagccctgcattccagatagttcccaggccaggtcaagatgagctcctcagaacactttgttatgttggtccagcccagtcactatgcccttctattagttttgcttctaaaagataagaatctagaaatagttgggccaatttagaagaaaacattatgtatttaatgggctaatataggtctaattactcgcataacttaaggacttttattaaatacatttacccaaggtaaattttcaagcccatttaaaatataatttaatttatttaaaagaaaattgatctgcacagattagggttgcctctattgccaaagaggagcacttaaatatttttagaagtgaacattgtgattcccctgttagcataggtcttggtctgaagtgaaaagaaaacttttagcaacctcacatgctgcctacaggactgtctcctttataaacattctctgttggcactgtcttctggagagcatacacttccctacatttcgtggcattacattatttctcaaatgacttctgcctttgtagaatcatcatcttttttccatgagatatgtgcaatataatattgttctcaaatattttagtcttcatgacactattgtgaattggctttaaacacatatatcccccaatgtacgatatattccttagtccttattttatagtaggatgatatagtgcgtgccataaaaggggaggaagacaattctgacttaaaagactgtttgttagtgccgcctttgaaccttagtcttacatgaggaggagtagatacatttatatatttatttggaaaaggtcgaataaaggatttgcaatttgattcagaaacgtcattaatttttaaaatttatttacttgcttatccttttctgaaaagactgtgaaacagttgcctgaatatttcgtttgaggggcagttaaaaacagaagttgtggaaaaacaatgtcggcaacaatttatgaaaggaaagcattggacatatttaatttttcttacccatttctcttgaaatacctgtgctttcccatttagtgcctttaatatcacaaagagagatgaaagggattaattttgtcgatggtggattgcactgaagcttgagtagacttttttggtagttttacaagcctcagtataccactcatacagggaaaagtcaccttggcttttaaatttagttgagcattttcttgagctattattttaaaataatagtgccccctcctcttttaaaaattactggcattgcaaacccttttttataatttcttcccaatgtttgcaaaatcccccttaggatacttatggttctatggaattcctcttctccagatattgacagaatcattaaacatgcctgaagcttcattattacttttccagcaccactttctttgctctttatcattgcatttagttatgtttcatctagttttcaatacacatgatagggttcatagcccagccaaatggaatgaatttgatagctaagcatttcacaggctggctctgtaacatattctgccagaccctactgtgtgtgaagcattactactttttcttttttttttttttttttaaccagtaaagattatttataactttgatttctttcatgctcatttgtgttcctgaagaagggatggaatggtgtaccccatcagagtgtttctcttggctttcctgtatgtaaacctcactaatactttcagtcaccaccttctgtgtcattccttttaagcaaaaggagaagaagtggaattgggttcaaggccatgctttgcttttcacaagagagtgctctcagaagcgctggtgtagttccaacaccttatttctactgctgcctgatagtggcttgaagtggttatttagagggagagggtggcttggtaggaatgtacttcattcagtatttttgttgatgctgtcattggaatgaacctcagtgaatgattttaagagcatagttcttagaagttatgatgataaatgactgaatgagaacctatttaatattatgtcactactttggggaaaaataattttagctgagtatttcaggagtaagagaaagtttatattcctaagatttagttattttctaggtttttatccttttataaatatacaaaactactcaaaacagacttggttaatactctgaaccagcttggaatacattcttttgtttgatcatttttcctctatttttcagtttggtaatttaattttacggtcatatgtatgtaccctggtctggagagttctctcacatggcatgattagcaattgtgtgtgaaatgattatgtggcaacattactagtgaattacagctagtctaaatactttgtgttttcacttgagaacattggctctggaatgtatatctggcaccgagaaggaaaaaggaaaaaaggcttgacgataaaatgcagccagagtgtaaattgtgaaatggagctctaggctcaattgatcctccactgctagcaacttgagattgtgcatttcctttctagaatgaaaattatgcccttttaagaatacttagtcaatttttaatcttcaaattggtgggtttttttaaataaaaaaagccagaagtttacatggtgtgtgtttatgtctgtatattattatacaaaggatctaaattataagccctaattcatgccacttcaaactaatggagtagctgtttcaaggtccctaactatagtagttactccttggaatgaggaagtgaatcttatattaagactttacactaataatcctggccgacttcgtattgaagcccaaatctggaggagtggtctcatcataagatgtaatcagcaacctaccctgctggatattcactgtttggatactaactgtacaataactgcaatggaagaaatacaaagcagaagtaaagccaggagacatattcctattttctaggttatttatcccataatagagagaagctgttcatttaggattataaataaagctttcttagtacatactgagattggtcagtttttttttttttttttttttttttggaatgggcatttattgtgtgtcctcaaagaaagaaagcaggagggagtttccttggtgatttaattattatgattgtgcaagtttctttgaatatgttcaaagtactccccatatgagaaggaagaaaagtcatacaccacatatcccccagtttctgtcgaaataagacctcagtgttctgtaataaaacgtccctttctactcactcccagcatttgatgtaaatgattgacagcatgtgtagcgccttctgttctttagggtctaggtcaaggaagacatcatagctaagaaaataaaaactcagaactgaagcaggaacttttcattcaaacttgaataaatctaaaggaaaaggatgttatatcttcaaaaaattaaaaaccaaaacaaaataagaaaaaaaacacaacacctatagtatccttagcactacagattctgtatttgttttgaattgaacattttctgaaaaacatcatgattcattagtatgaaaaattatcacattatcataagaaaaggattgttgactataatggaaataggctttggatcacttatgatacggataagtgcttagcctcatagcattaaaccaggattccaagatacagattgcttgtttattgcataggaagatttaaaaaattactttgaggacttttatctgatattagagttgcccagaaggaccacaccttgtaactcaaactgtattttttaaatatattttttgagatggagtcttgctctgtcgcccaagctagagtgcagtggcatgatctcgactcactgcaacctctgcctcccaggttcaagggattctcacgcctcagcctcccaaataactgggattacaggcatgcacgaccacacctggctaatttttgtatttttagtagagatggggttttaccatgttggccaggctggtcttgctgacctcaggtgatctgcctgcctcagcctcccaaagtgctgggattacaggtgtgagccaccacgccctgccgtaactcaaactctagaaggcaggtgcgacttgatagattgattttcattattggcttagaaataaacgggaaacctggttgattttcttttccaagtaattcggctgtgatgtcgatggtttataactgcctttctccccgtgacactgacagtaaatattttccatgtagatgaaaacctaccagtgtaagtattaatacttataatagaagaatgcacatttaaaaagatttacatgtgaaaaaatatgaattgttattactttcacatgcagcctagacatatagtatctttgaatgaatgtaagtgggagttggaggagagattttaatttgaaagtgaaatactggtaaaatacagtttgttgttgttattgttcttaaagaaatataagctatttaattgtctttagcataatgtagagattatagtgctttatttactaaacacagcaatatttttttttttaaaaaaaacaaccaaacctcagttccataaaagccacttagcagagggaaggagtaaagagtggagtttcccccttgcccagtggcaaagggaagccatataaagaagaaagacaaagacagaccagggtacaaagaggagtagtggggaaggggcaagagggagtcctggttcaagaaggagacttagagaaaaatggagattgcagggtggctgggaagagagaagcagccacaggtcaaaggccttaggtggcccccttggcctttccgcctccgagcaagcagctgtttttgctgttttaatgaatttcaactgtttctacattccaaactctcatcatcatcatcagttttacttacaaatagagaaatgaaaatagctttaatgcttttgtggcaatatcctaaaagtttacagaccacgtgctatattaaagtagaccccttttggacttaaaatatcagcctgctttttcttgtttgaaagagtaaaaatctttaggacataggaattgtaggaatttaaaactatcagtgacctattttggcaatgcttacaattttttaaattaggttaactcctaggcagagaacaacattggtaaatagtaactgagattggggccttgaagaattttgaaacctgaggttatatgtttgcatctgtaatagaacagttgtatgtaatgtttttctacatattacatggtgggcctgggggtgtcttcagagaggaagaagatcattattaatattaatatgttatattagtaagtagatgctatattttcagattctctattactttgaattggtttgtaatccaaaaccataacttagctttcactggctttttcgccctaaagaccaattgccatgataaaatgctctcaacatatctacctataacagttgagaatactcactgtactaagatgcccctttacttgtaaaactgtgtatcaagagtaatttgttaaagtgtacaggacctctctttactatttttgcactattttgtgtttgcacacaaatgcagcagtacatttatctctcagaaatttcaattctctctggcaggttgatagggtaaataccctctctaatctttttttctctgggtcttcagctctgcaaatatcccctcattccttgtaaactgtccaaagctcagcaaatacctttccctatatagctgagtattctttcccatgttgctccattttcctcccttttgacagataagaaaaggtaagcctgactttatgaacctttttctgagttgtcactctctaaacaactttcctatttctgaactgcccagcagaatttggagtgagcaaattagagatattgagaatggtgtactctctgtccacagctaccttttatgagtacgagaacaggaaaagggcaagagagtgcccagggcagcagagaattcagggctagagaaattctgtttctgttggccaaggtgaataggacacaagaaagtctaactacaattaagaaacctagtcgggaaaggtagggatagtcatggaagaagtgagtttcctctagaaatttttccccctttgggactcataaaatagggtttctaatagatggagttttgcctgaataagaaatcgagcagtgcactgggtggtctctgtcattacagcaccggttctatgcatgtgtgaataagggcttatccaaatcaatcctgcatgaaagaatataccttagtaggaatttaaaggaggaccttaaattcattagtattccgagaactgtgagtgaaactgtttagccctgaaagcagcaatacagctgaggttcaggttttagagtcaaactaatctaagttccattcttgttttagtcactgaacttccctaagcctcagttccttcatctgtaaaatgggaatgatattattaagttttatgggattattaggagaagatgagccgttatacctaaattaattagaattgtacttgaaacacaagtgttgttaaatgatattggtacaggtggtggttgtagaaaccgaaaaatggatggttaaatggattaacacttttagaggatctgaggggccttagcatttgggagtgttggttatggatagagcaaactgaagggtatggttgtattatctgctccttccctcttatctcagtactgggcgcagcagttctctttctttcttttccctattgctcaggcgtcattcataataaaatatagtcacacatcacttaaccatggggatgtgttctgagaaatgcgccattaggtgatttcatcattatgcaaacactagatgttataacctactacacgcctaggctgtatggtatagcccattgctcctaggctacaaacctcaacagcaggttactgttctgaacattataggcagttgcaacacaatggtaagtacttgtgtgtttaaacatctaaatatagaaaaggcagagcaaaaataccatacaaaatgtaaaaaataatgcagctgtataggtcctttaccctatgaatgttgcttgcaggactaaagttgctctgggtgagtcagtgagtggtacgtgaatgtgaaggtctaggatattactgaacagtattgtaactttgtaaacactgtacacttgagttacactaaatttatttaaaaatatttttctttcttcaataatacattaaccttagcttactgtaattttttcaactttatttaaaataaactttattttaaaaattttgtttatagttgacatattgtacacattggggtacagtgtgatgtttcaatacatgtatatattttataatgattaaattagggtagttagcatatctatcaccccaaacctttgtcatttctatgtggtggttactgttgtcttttctaagctatattgaaatataccatacactgttattagctatagttgccctgctgtataatagaacacctgaacatattcctcttaactttctgattctttcataatgacatttagcttaaaacacaaacacattgtacggtggtacaaaaatattttcttttttatatccttatagatgtttttctgttttggaaattttttatttttttactttttaaaatttttgttaaaaactaagatacaaacccacacattagcgtaggcttacacagggtcagtgtcatcaatatcactatcttccacctccacatcttgtcccaccagaaggtcttcaggggcagtaacacacatggagctgccatctcctaggataacaatactttcttctggaatacctgttgaaggacctgcctgaggcagctttactgttaacttttttgtttattttaataaggaggaatacactctcaaataatgataaaagccgagtatggtaaatacgtaaaccagtgacattgttgtttgttattcgtatctggtattatcaactttacataattgtatatactgtacttctgtaagactggcagtacagtaggtttgttgacagcagcatcagcacaatacatgagtaatgcattgtgctgtgaccttagcatggctatgatatcactaggagataggagtttctcagttccattggaatcgtattggaccaccatggtatatataagcaatccatccttgaccgaaacgtcatcctgtggtgcgtgactgtaataggatatattgcctcaccacagtatttgtagtatagaaggacttggagaaagatcacttacacttaaattattaaggtttaaatttgaagctttagtggcaaagatatcagttggcaagggggaattcataaaacacatagaatatactgctttcttttcagcctgtgaaaataaattaatgagtttgaatattggaagaaatagaaaatgaatttgatcttataaagcatccacagtatgtatgtatgtatgtatatctgtgtgtgtgtgtatatatataactggaacagtgagaatcactatttttgaattctgaaaatattaagaaggtaataaccccctcaaatacagaaaaagcgctagtaaaatggtgagtgatcctattaaggtaataatgcaaatgagacaacagccaactactaatgaaatgacccatcacagacacatatgtgttaaattaattgtgaagacttcagtgaatccttacagaacaaaaacacaagtgcctacctattttaaattgtttccatcttaagcagaaaatatttccagaaatagtagaattgcagttatttgtactaaatgaatcaggtctgacttactacgtatgatttgtgccagtacactaacataaatttgaatgttgtgaaatgatatagtatagctttgtagtgatttgtgtgaagttgtatatacttgtctgaactttacttttgatggtttaggaattaagttatgattttgggacttgaaatgagagtaattcagaagagcatttcaaataacaaatggcacttaggggaacaaaagctcatttatctaatttaacatatgctgtgaagatgtggagacagccaaggagaatatcagaagtggcacatattatctcttgtctttttgttcttagtctggaaaggtaaaatggcatttcctctaggaattgaggcatgactaagaaaaacaagttttgctaaatgcatggtgacagttgctggtcccttcgggtttcatattaaattaatgatgtgaatgaagttcagcaaatgagaagcatggacatcagtttctttccattcctagttaatattcaacccaggaagggatggtcattcacagctactattaagaaagctttagagttttgttactgagcatagagaaataaaattttaaatatcaaaattttacttccgagcattttttttagcatggatgttaaacaccatcaacagttctgtattagttctatcccaactcccttgatagatacaattaaattttactgatgttggtattttactaaagagggtcattatacttttagtataaactgtaattctaagcagaaatgatcttcagtttcccaaggacagcattttgtaagtggtgtgcgtgctttttgagtttcttctcatctaaccagagttgtactgttatgttagaaatcagtgtggatcctaccttggttgagtttgggctcagcattgggagataattgagttggttacgaaggctgtgtggagaaacttggaactgggagatacaggttctctgtgcatcttgtaatggtatgcatggtttttgctctttgacactttatactcaacgcttgaaataaatcttatagaattggctctgccatgaacctactgtgggtccttggactttgtcaaggcttagtttgcttgcttatttgttcattggtttattcattgattcattcagcaatcaattactgaacacccattgtgtggttggctctgtactagccaataggaataaaatagacatgagtcattccaaccctcatggtgctcacaggttagtgcgggatataggcaatcttacagaaagcagttaggtaccaaaaggatgggagagtatagtagagtaatctaactctacctttagggcagggaaatcctcctaaaataggagatgtctaaactgagaccctagaggatgactaatattcagttagggatatggagaagaccttttctgtcagaaagtacagcatgtgccaaggcggtaagaaaagagagagagcgagagagatcccaatacatccgtgaggactgtttgagtctaagatctaccagattatgccagtatgaacttgtttctccattagctcttgcactttctcacctatggtttgaaaatgcaaccaggtgattataggccacacgacccttctgccagtatgttttagggcctttaaggatcccagcaggttaaaatctacttatctacttacatctgccctgtgcccaaataaggaggtccacatctgttactgtgtctgtccctgccgaatatcctctgtatggccaggctgctatggggctcatgttgcccatgccccaaaagtacatgattgcacctagcctgtgggctgctgtctcttcacagcctgtgctaactgaaatcatgagattggctatgtctttggggtaacgctgcagtttacagtcacctcttctacagatttattatgatagtgaagtaagttgtaagcacaacggaaaattccgacaggaaaggatgtgtggggtggatgtgtgatcaactgaagaggtttcctaggaaggtagaaatcaaatgagatcttgagtaaaggtaacagaaaggaatactgttgcaataaggagtaaagatgtggtgtttaataatcctgtttaatctcaatgcatagtttatggagagactagtgtacctggaacagtggctgcatgttgatattgttgcaaatgatattgcataggaaagaaatgatcttttggtttagtttcaggtaaaacaaaaacaaaagaagtaaccttagccaatcattgatttggtgaagacttcagagaagctttttttttttttttttttttttttttttgtggttcatataaatgggaaaaggggctggtttctccaagacagaagtagctgtggtatctcctctcaggtaaaatgccctcaaagcattagtcattgaccatccataggtaatagagacatagactgtgatgtgagggcagtttagttccatgatttcttggctgtatgatatagggttggttgtttaatctatcttcatctttctaatgtggatagtagtagtggcagcaccaccagcagctatttcatagagttgctgaagattatttaagtatccgataagtggtaactatggtgacagttgtctgcctgtgtttgctaatgatgaacgtattcattccctcactcattgattcactgagcaaatatatactaaggatgctctaagggccttgtcccatgcctgcgttctggggaaaaattactggttttatattgttatttgcatttcttccctttttttggcaaaagcaaatgttttcttattttggtttcatttatacttttgcagtgtttgtcaaagtgtgttctaaaaactgcctgcatcaaaatcagcaggggttcttattgtaagtgtggattcctggtccttacgttggacctactgaatcagaacctctgggaagggcatggagaatcagcattttgagcaggctcttaggtgatttctatacatattgaagtttacaacctgttagggtcacattgtctccccgatttcccatttggtgctacactaaggaaaggctaacagtcactttcctcttctttccattacatacacagattttctacaactgtgaatcctgacaaaccctctttgctttactttgggtggagaaactgagcaatttgcttcttaagcaggcttcatttacgtggataattcccagagatcagtaagatatgactgaactcacttcctttctagttaagtcttctcttactagcatccatttctctgaaaccagaagcagaggctgacaccatcagccaccaacctgcagtgtcatggagttaccaataccctttccctttccccatcctggggtttgttattgccctggagcagtacatttagaattcacaacctgaatattaataacaagctaaaaacggactagaacttctatgtgttttcattaatttttttttttttgcagccttgaattgattgcttccctttccccaagcataccttctgagactgatttagtgtggcttgatcaatagactgcagaatgattaatttgtttccactcatttctttactgagtattttccaagcaaaggtgagttaggaaaccgtgaactagagtaaggggaattgttgaggcataaatagctgtctgcttgtgtttgctgcaggagttttaaaacagaataagcaggagaaaagaatggtggcgaaggtgcctacccctctaaggtattacttcggccacattgtgtggaagacttcttgataacaggagtatagcacaacgtgtcttgtttttgttttgggctgatctctataagccatggaaaagaatttattccatactgaattgtcttagtggaactctgcaaagtttaaaagcatccagtcagaagaatattaaacctttgagtgaaatttacagctttccttatctttttaaaaaaattattcttcacttttttgcctcctattacttgttagggagacccaatggtagttttattccttggggatacatagtaaatacttcattaaagttgagtacagaatttgatgaaaagtgtggatgtgtgggatgtactgccgccttcagaagtccacacactgcctggagggagagaactgctgtttattcactgattaagcacttgctgtgtaccaactacttttcatgtcttatcttaattctcataacagtcatttgatattttaaaaaaccccagaaatctgagaaagagataaagtggtttgctcaaggttatagaacagactaccatgtgttgtatttcagattttaattcatgtttgtctgattttaagttttgttcgcttgccagggtaccccacaaaaatgccaggcagggcattttcatgatgcacttgagatacctgaaatgacagggtagcatcacacctgagaggggtaaaggatgggaacctaccttccatggccgctgcttggcagtctcttgctgcatgctagcagagccactgtatatgtgccgaggctctgagaattaactgcttaaagaactgccttctggagggagaagagcacaagatcacaattaaccatatacacatcttactgtgcgaggtcattgagcaatacaggagggattttatacattttagcaactatcttcaaaacctgagctatagttgtattctgcccccttcctctgggcaaaagtgtaaaagtttgctgctacaaagaatacagaaaactcagaaagaaatgctaacatacacatttagctggccctatggatatatcatattaactgcttatcgttaggggctgtatatttgtaaaataaaagaattttgggagttccatctctcggctttggagcccccctccttttgtctctgtatggaggagcttcgtccttctgcctttttctttacctgttaaattctccactccttaaaactaaaaaaaaaaaaaaaacaaaaaaaaaaaaaacaagaattttgatcacagtcagactctgtattttaaaatacattgtaactagtgagctgggtgtccagcaggagtttgatatggcaccatgctttataggactatattggtagtcctgtaaagcatatatagtcctataaagtatggtatcacatcaaactccttagtacttagagagtagtaagaaattaaacgtgaaattaagaaaggctggagctaggaatttgtatttgggagccataataatagccagcatttttaatatgcttaatatgtgccaatctctgtgttgagccttttatgtggatgagctcattaaatcttcacaaaaactccacgaaggtagtattaaaacccacattttacagatgaggaggctggcgcagaaaaggtttttgtaatttttctcggttcacacaactgcaattgttagggcgagattcaaaggcaaacatttgtgatgtttaaatctgaacttttcattcctgtggtagtctgcatagaggtgattttggaaccttaaatatagttgaaaacagggctccatttaatcttagaacatacccgtattaagggtgagagaagtgttgaggtagcacatgatgagatagcaaaggacacagaaagaaagccagtttcgggaaaccatgcaagggtattatttagagaagaagagagttattaaaaactacaaagaactcaaggagaatgggagggaaattatcagatatagagattatgtgtctttagggactttgacaagaacagttttgagtagagcatttagtcatatctcaatatgccattcattttgaagctttggattagtttattccatgattatcctcacctatcacgtatggctagtttaagagcgttatttaatctagagtaacagttctgaatgttttttaacaacaacaacaacaacaaaatagcgcatgtgacacttcctttacttctttgtcccattcctcctcttttctaaaataaacaaatatgtgtataaaacaagaaaaaaaaagtgtgggatagtatctgctttactgagaacagcagaagtagctatttttctctattttgcctaggaagtattttgctaagaagcagtagatagaagatggcagtaggtaacggtaaatgtgttagtggactctcttgaaagtggaatttcctatactttttactaaggtactcaaaacatctcacagacctgcttcgtttttataagtatgtattgtgcaagtgatatggctgttaattttctttgttttcccttttgcagtggagaaagtgaaacagaaaggagtggtgtgggacaaatgcaacccccagttttccttttctgtgcagtgtctcctagtctgcatttttcctgctgatcagaacaaagtgtcaccaccattgtgaccagctattctgacttgttgctaaatccatctatagtatttgatgtggctcactggtatatcctctttgaaagactcccttcacttagctgccaggatacgcgctcttctaatttttctcctgcctcattgtctcctcccaactctgtcccctccatctccctgacctcttactagcctgtagtacccaggggttagtcattggccaccttttcttctttcatgtacactcacttccctggtaatctgatccattcctaaggcttttaataccgtctcaagctgatcacttccaaatttatatctccagcctggaccacttcactgaaccccagccttaaatgccttttgcttaacatgtccacttccttgttatattggaacctcaaatttaaaatatccaaaactgagataccaatattccacactctatgttcaacaccttctttcccttagtctttgcatttcaatttgtgggatgccatccttccagttgcccagaccagaatcccaggagtatcccttttctcacacaccttagaagcaacccatcagcatgtcctgttggcttttcagaaaatatccagaatctaaccattgctcaccaccttcataactactgccctggtctaagctgtcaacatctcttgcctggattaggcttcctaatggtcttatactttatctcttgctcctctcccttttaaccataatgatgcttttaaaatgtaagtcacattacaagaacattttggcacagaactttttaacagcaattcatgcagagtaaaagccagaattattttcagtgttttacagggccctaaataatctgcccctactggttgatgctgaatgcattttctacaatcttctctgtggatcacacccctccagccacactggcctctcagctattccttgaaccttaaacatttgcactacttttcttccaccaaacgtccaagaaacttgctcccttaatacctttacggcttttctcaaacgttaccttcctagtgaagcctacctaggccatcctgttgaaaactgtgatatcttcttccagcatgccctactttttaatttttttctgttgcccttattaccatgcacatattttatctgttatctggaaatagaatataagttccaaatgggcagggatttttgtctgttttgttcactgtagttttcgtaccacttagaatggttcctgacatacagtaggccctcaattaatgtttgttgaatgaatgaatgaagtttcagagcctaaaatagagtggttgagtcagggtatgtcagtgtatgttggtctgcgagtacgatttttctactgatctccaaactacagtctcaagacaacagttttccacctctgaacagaggtgcctctgaatacccagatctttatgtctgtgaacaagcactgcctattagagccaaacaagagaaacacatattaccatctccaattctttagaatccttttggcccagaatgacttcaaaatgctaacccataaaggcaaacaaatccagagacctttgtagtttcccttagcctctgctgcattagctgaagataaatctatgcagaattcacttaagggaacagacaactacattaagctgtgtaatgatgaacattaatggcctgtgacaaaatgggtctctgtaggctgagcaaccatgcaaggtggggatttttccctgtttttggtaaggtaatgaagaaggaaaaaaaaagtctcatccaaagatgcaaagaaacaatctgctggcccaggtcattttcatggtatctttttgtttctcctttctttgttttgtaagtacatgcattttggctgaaaaagatacaggcaccattttacagtggtgggggaatctctactttgttaaagaaaaatgcaatgctctttatttccaacctggtatagttcattcattccttttcctgtggtattcacatgtcttgcaaattgttatgttgaattttttagttccttgttatttttacttgtagacacttacaccatggtcacaggaatctatactgatttcttccactttccatgcatttgtttccattattaatttaagtgagaagcatgtgtgtcattccccttcccatttgacttttacatggttaactggtgatctcaagttgatcagttaacttttcctattgtgcatgattgttgtggggatcaaatgtgtacaaatacgcttcataaattgctgtaaacatttaagttaatggtgcttatgtggatattagaccagttgatttgtagacttgaatcattctaagacttctgaaagtaatccttctggcaaattctataaattaaggtaattgggatatatatacatatatacataaaatttggggtttctacaagttgaccatgaactattgaatgatctgaagtggcctaggatttttttataatctattcagaatgtcactgtgacacacatactatattttcagtatttgcttctcagatattcagaacactttttaccctacagcagaattatttgacaacacatttccttcctgccctctgaatctccctggatgatctacaaaaatatagcatctccatttgtgacaatataaaaccctggtatgactcttttctataaattcagttttattgccttcttccaaagtaatttctgttaatccagccagaaccttcatttttgttttgtcattttcaagctagattctgaagtaacagaactgactacaattttagcctaagaacaaaagagtttcaaggcctatttcaagaccctggttttgctacctcatctactaaatttatacattctaggaatccatttactttttaaaacatttcttttcttattttcagtaccaatttgtttccttcagctttcccacatgcatgacttttatagcatggcataaagtagagtgctctgccatattgatttaatggtatgtttcaataaatttcccctgttacagttcttgctccataccaggcatccaagagggaaatagacggatgtgctggttaactaattttaaaagcgaaaaaattccattttctccatcctttaatgtcatagctgtcctgccaatgacctgatactgagatatattaggttcctctgacatatgttacaggaagtagtgacctgaccttttaaaaattttattaacatttataaatttgttttagtgtattatgttggaagcagtgatttttctccagaatggattggggtgactggtgtacagattgatagccatgtcatatattaaggtggtggacattttgtagagtccaccatctctatactcacaatatattgtagagtatagagatgctgtctttttttcccctccctcttctctcctgcctttaagggttatgctaatggggatggaaacattcaaaatcttactttaatgcagtttataagcaactagaaccattactgtcagctttttggtagctggttggctttgactattgcttgataaaacattgagacatggacattcatccatttattcactcaacctttgctcagtgcttaatgtattccagacactatgccagtcactaggcatgtaagagtgattgccacaatacctgcttccaagtaatttatagactgatggattaggacccagtagtatacaatcaagatcctaatcaaagattttttccttcttcaactctgttcaaagcccagataagtatcatctctctgtctctttttttaaatttttgtttatttagagggtgcaagtacagattcttacatgcatatattgcatagtggtgaagtctggacttttccagatgggtgtcttctttttccctcctttccctgtttctctttccttttcttccattctctcttagcacttcctaggaaataatttatatatatattttgtaggcacaaatacttgtcatacattaagggaaatctttattgatgtaaagcattggaacttagctatatccagttttattgccttagcaattctcttctttcctccataccctaagtaatcgaggagagtgtggctttagacaaaggacacctctcctgtgacagaaaacacaggagccaggagagttggcatgctggctttctaacctgcttgctgcaagagcagttgtgagcaatgatgatgactgacactcacatccatcatttgccttcttccaaatgcttctgaaactgaaatgaagcttcccaacacctcagtgagtatagatggctgttttattttatagtaagtatttgtttattttctagacagggaaattgagggactgagaatgtaagtggatagataaataagttatggacactgctgggaagcattagctaatgtttattgagcccgtgtggagtgtaatactttcctaagccctgtgcagtgtattttgtttctagttttccactttgtacttgagggaagtattccatggatcttcttgttttgaatttactcttttgtcttcatagaaggttattgttttgttgttgcacatttcacaattacatttgcattttcttcaaacattttgttttttatctttgctatgcaagacttaataacaggaattttcgctgtatttccaggctcactcactcagttttggaactttaaattgttccaacagtcactcagttgttggaactccaacaactagtgcatttggtaagaactcttacataaatagcctttacaatcaaatagacaaaaaatagactgtgcaaccaaaaactttttgctgttttcccacaaaattatctgaatttgtttgacttgagatttttctttgtaattttctcatctgctgcctatcctaagatttaggatgtttttaccttaatagccatatcatgttttaggccttagtgggcctctctccttcatgctctacagacaaatataaagtgactcagtgttaaaatctgatacactacagaagcactgtatggtttatattcggaatggttttttatgtcaaaggaagtgcaatgaatataggcaaggaattaaagccattaaatgtatgaatggaaaataattttatagaaggtcttatttttctcataaatgtgttccagaaatgtaagtccaataaaaatgtatacatacagaatattcagtggtcatctttcggtcgtgttcacagtcatttgcctaatcgcctgttttctgaagcttttctataagcagggcaccccattataatggtaacaatatagtttttttcttgtaaatagattatagttcatacatctgattcacttgttagtcaattgtttggaattcagaatgcattttctcatagacatcatcttatattatcttgattggtgcaaccctttgcaacacaggtttatccataatgtatttctagtatcatactgtggctttctgaaatttaactgaagtgttaagcatgtgtcctgggaatggatttagagtttgacttgagattctaggagcacatttcttcctactgaatgctgtttgtgggatcagaagctcatgtgatgttaggacatggtcaacagaggggatgttaaagcttatttagtccaccttcctttgttttgagaatgagaacatcacctccaacattcccgagttatggttccaaggacctgggccagaggtgcctttctggagagagccaggtggtgaggggcagcctccaggggtcactggtataagaggcaggatgtggcctgggtcagatgacagctttggggtgaggcatgggaaggggaggaggtgatgggggtctgaggataggagtgaatatgtgggtcccttttgttatgcacaatagaattgttctcccaattttttttttttttttttgcctgtcacttcatactctattctatttacttccctttctagttagtaaggcatgttgggtgaactccccttttttggcaaaaaggcatttacctttctcttccccattaccactaccagcacaccaatacagattttccccctcgctcagggaggccatgactggagggaggggtaaggagccaaatcgagctgtctctggtggatgcagcctttacagtggtgagaggaggagccgcgggatgtaaggaaaaggagctcctatggcctggctggagtgtgcagtggatgaggctgcctcaatgcagggcgagatccacacatcacatggtgggggaagccattgctgaggtggggagggtaaacaatgctagctttttggccaggccagggcacctgtgtgggtgtggggaggacggttgaagagtgctcagtgcttttctttggaatcagaatttctgatttagtgacaaatcatggaaagtttagaatggaaactttttaattttagaaaccaattaaataatattcaaacacagcagtgaataaagaactatgttcgctaaatgcctgtgtttaacatgtgagaagatatgtcccttgaccctgaatcttctaaatatgtacagttttaaaagatagaaatttatagtgaaatgcatttgcgtatatttggggtaagagatggtgttcagaaagagagggaagctagatgggctgaaacatgaaataaattccttcagagtcccttccactcatgtaaagctccttgaagggcgtcaggagacaacattcctgtttctgaggaacacttacaaggactctaaggaatgttgtttcccttattatatttttatatcaaaacattttatttccacagttattttctttacctaatctggcattgtagctgtgatttggcgggggatggggtgttaggaagttcattttcttttcaaaattgaagtttttaatgaacttggtagatttcctgaaggttagttccttcaacttttggtattacaaagtcatgattagttttaatggtgaacattaagattgcaaataactgctgtggcgagggtgtttctttgtgaatttgaagtgtctcgtttaaagattggtgcctacattgctaaggtgcataccaccctcagtagctatattaacttatctcaggttgcagagtctttggggttgtgcttgggttaaaattctagccatgcagctttgtgacagggaaagttctttaatcatttgaacttgtttcctcacttgtacgatggagcaaatacctagctcaccgtgttgttcaagtgtcaactcaaatgatattatgtgaaagattctggcatttcctagctgcctagccagtgtatggtttgtttcaatttgattccatgtgtgactgcatgctcttggcctattgctaacgagcaggcagagaaacagcagcagtacagtctggctagagggcgtctgttgagcctccaaacattgaaggctactttgcctctttgtcaggggcatgagcctccagaaactctttcctagatgcgctaattgtgtttcttcttcctcactgtgtaacatgttatactgggaatctctcctgaatgtttgtttgtgtctctatctctatattttctatgacagtatttgcctgactgaggtaatcccaactggagggctgaggtgacagatttggagaacattcttacaacatgctgttcaagcatttaccaccatgatgtaataagtgtttgtatttaacagtatttatttagttcctgttatgtatcaagtaatgaaaaaaacctgctttcatggagtggacattctaatgggaggggcagacaataagcaaatgtcaaatgcctcaggtgtgttaagtactgtgaagaaaaataaagcgggctaaggaggagtcagataggatgctgcttgccatagggtgctcagggtgcgtggtcaagcaaagacttgaatgaattcagggaacaaaccatgagatacctgggagagacgcattcctggtagaggacaacagccctgagacccgtatacctgaagacaagtgagcaaggaagggagtgtgtcgaagatgacatcagagagatgccagggcaagattatgaaaggtcatgtagatggtaataaggactttgaattttatccacagtgagatggggagctattggagagttttgactagagggctgtcataatctgctttcacctttttaaaggacagatttgggccaggcacggtggctcatgtctgtaatcacagcactttgagaggccgaggcaggtggatcacttgaggtcaggagttcaagaccagcctggccaacatggcgaaaccccatctctactaaaaaatacaaaaattagctgggcgtgtgttggtgggtgcctgtaatcccagttactcaggagactgaggcaggagaatcacttgaacgggggagtcagaggttgcagtgagccaagttcacgccactgcactccagcctgggcgatagagcaagactccatcttaaataaataaataagtaaataaataggatggatttggctgccgtatgaagaatgtgctgtaggggagtaatagtagtggcagagagcagaaagccattgtaataattaatggtaagagatggtaacagtggaggggagaagtggtcacattctggatgaagtgtgaagatttgccagtgggtttaatgtgcaggtaagaaaaagaggagtcaagcatatcgcaaaggtttttcacttaagtaacagcacaatggaaatgtaatttcagaagaccataggaagactacaggaagaagctagctggagagtaagatcgtgagtttggtttgggacatgctaaatttgacatctctattagatagtcaagtgtatgtgttgagcagctagttgaagtacatgacactaaaattcgtaaatgggaattagactagcactgtccaaaagaactttctaccatgatggaaatgttttatatcttcactgttcaatataatagccactagtcatgtgtggatattgagcacttaaaatgtacctagtacaggccaggcgtggtggctcacgcctgtaatcccagcactttgggaggccaagacaggcggatcatgaggtcaggagattgagaccatcctggctaacatggtgaaaccccgtctctactaaaaatacaaaaaattagccgggcgtggtggcgggcacctgtagtcccagctactcgggaggctgaggcaggagaatggcgtgaacccgggaggtgaagcttgcagtgagccgagatcgcaccactgcactccagcctgggcgacagagtgagactccgtttaaaaaaaaaaaaaaaaaaagtacctagaacaactgagatatggattgtttatcttatttaatcttaattaacgtttaaatagtcatatgtgtgtagtggttacttattgcttggcatggaagactatggatataaacttgaaagccatcaacattccagtgttttgtaaggttgtgagactggataagtccacctgggggaagcacaggtaatgaagaaaagacatctgaggactgagacctccagtgtagaggttaggaaaatggaaagctaccagcaaagggtattccaaaagcaacagatggtgaggaaggggaagaccaaaagaaatcagtttccaggacaccaagtgaagaaagtgttttaatgagaatgatgaaatgtataaatgctgttgatctgttcatcaccttcattatagagcaagtcacgtaaggatttatctctttgaaacccagtcttatcccaggccctagcaaatagttattgctttataatcacttttaaaatgaacaatgctgaacaaattaatgggttactcgattagcctttaaaattttttttcaggaaatatgctctcttctttgaggtccaagcactgccatcttatagctgctacctgttggaaatcccagattctgttaatgactgacctcttactcatcagccacccaccatcacccctccccagttcttccagggcttattttagaggagctggattggagatagcctcagtatttcttatttcagcagttgaggttaaagagccaaacatctgcttagctctggactttctctttctcccttactttgctcttctttggttccttaaaggagtacttaaagggagttagtttctagatggggaagctagcatctgtatgtatacttggactgtggtaactggtaggaagttattgtgtatggttaaaaagtagattttaccccaaatctctggtagctagatctgattatttttccattatttttctcatcttttaattcttctggacttcaagtgttgagagttaaccttgcatctcctgtctttctcttttccccttgaatgaagttccattcattgttccggtgtatgccctgattcagagtctttcttggtctcaccacacacacccttgctttgtcttgaagtactctaacatgtctgcatttggaatttctcctgcatgtcccaacctctggttgtattctttgcacctggctctgccttaccttccattctgtatttgatatactgtttcctgtgctctctgagctattacgttagcatagaggtaaatctgaaaaacaagaagacaacacacatgcttcttttccttgccatttttaagatgttgattataggtcttgtgggaattctgttaagtatgtttttcaataattactatggcattctgttactactcatttttcttgttccttatatctgtgttgtaccagctcataatactaaacaaatattgtaattgacaaagaacatgcatcctcattcctattgttaaagccactcacagtcctgtaggaagtgttggtacagcactgtatgaggaagagcagatgctagggttgtatggtgccctattcttaagacctactgtgactttctatagtggagttcaaggaaggcaaggaatttgtgtcactctcaaactctccagattttaaacctgccaaggaaaaaatgcagagctggagcttgccttgaatgattaaaagtcacatgaggaatggggaaagaaaatcccaaaggattgatggctagaaagtagtttatagtcaaaagctataccaaaagcaattgctcgaaaccctagaaaccacaaatggaaatgagagtggattatatatagtacaaaagacaaatacacacacattccccacccagtgggctttactataaaacaagccaattaagacaaaatgcacagtaattaggaacatcttaggtggggtcagggttgctggatttttttatacattcatacacttaatttattttaaattttatcacgataattacattgttttaaggtttgaatttttgcaattcaggtatataaaaatgatagattaccaaatgagtttggtgtgtttaacctcatgattcacttatatgccaataatgtgccttgcctagaatgtttgctttctaatgtttctgtgttactccagctgcctccctttattgctgtcatattacaatgaatgttttctgcatatttatgaagagcctattagcagcatagacttgatttaaagaacttctccagtttatgaatacagttcatctcttgtgaatgaatttagcactttaatgctatttatttactccacaccataaaatgtactataataaataataggtcccttgggcctatggtaaaactcactgatcatcctctcagcaggaagatgaacacaacttgagtggagaagtaaccatcaaagttcaccatgctcactgggatgtcatttatatacctgaatctaataaagacagaattacagtgcttaacattgtgctcactactagcatctgaattcagtgagactcagggagggaaaagactcagtcacattagcaacatcttagaaggtgatacaaagtctaaattggcaattcaaataagaaagtgttctttaaaagcatataatgcttaatttcttatgctaaatacacagtaagttagtgttttccattttcttcacccatggaaaacccttagttttggagggttgtgtttttggtgggggatggtagggggcaggggattgcttcaaaatctcttctctgtcaattccatttggagttttcaaggcgaccccagctgtcagctatccataaatgcaatatctacaagccaggacgtctgtgtggcatttggtcagtagggccattctgttttatggttgaagtccagaaagagtcaatatatgagtgttcaaaactctttctagatgaatgtatgcctgattatattctaagattatttgggttatttttgtgttatctttgtttttatttgatatgatttgcttttgtagatatttgttcctttaaataaatggtcacaaatttgaatgcttaaaatttgaaaccaggcagtgtattatagaaacagtataggccatagttctgtatcagggaagagttgactttattctggaagatttttaggtctgatttactagttgtctacttctatgtggacaaatcattctgctttgtagattatttgatttagagcagactacatatctgatggctctgccaagatgaattagcccctcactacatctccagataacggcgtaggagtgaggaactgtataccgtatccctctaaagagaggcttcaaaaagcacaatcttgatttgggtggttgggaattgttcctttgttggacagctttaattattaaattgagatgaaatatgccagcttatgatttttaatactaatttattcaacctcaaaattcccagtgcaccatttggttctcttctcaggcaaattgttagtttctgccttgtgtattatttatgcttgtactatgaataaaggatgtctcatctctatgtggcaatgtcgtctgcttcatgagctgacagttttgaagaggaacatgagacagtcagatctgttagtgcaactcagtcaagcaggtggtcgcaaaattcgtggcgtgagaattgcagtcattcattcattcattcaaaaaatatttattgagtgcccgttatgtaccaggcactgttctagatactagatggtactcatcctctatatcttccttgtactctatgagaataaggttgttgtctgatcgccttttatcttctacttcacccgacaaagtacattacatttagaatgggcgcaaaattttattttaaacaagtagcataccaagtatgcctcttttgttttagctgcaactgctggaatgggaccgagtatgcctattttgaagagcaacatagagtagttctaatcactttatgacacccgttaaatatttcaatcacattagcctcaagtctagactgaatagcaccagttcttcttctaaatagtttggctgcccttctgtgagtcttttctagttgactcttgtctcttttcatgtgtaggaaccaggactgaagacagtaattgtgagaggatctagcatgtacaaagtggaagggagggtgttatgtttctgtgatttattactttcccaaaagatgttttatcagctaccaccctatccttttttccccaaggcattcttttctctctctaattaagtaaataaattaattaataggatatctatgtggtatctaactgtgtatacccttgagctatttattttcctatttttctggtcattttcattagttaaaagtctgttcttaagatctcttatttacagtaggagtttcttatgtatattatagaaagctattcaaaaagttatattcatttaatcaaaaaataaattattggggggtatgtagtaaactctgtgtgtgtgtgtgtgtgtgtgtgtgtgtatgtgtgtgtgtgtgtgtgtgttgagaacaaagtgatgaatcaccaaggcttcagagttcttgcctcctttattctgacagtcattcttatttatgctgataacatctgtcttatccttacaaggtattattctgttttattagagctccctgtttcatatacatgagaaaaaacttagtggtttagtaattcttagtgtctcccttgtctctaatgttttgagttttaggaaaaaagaacagaagattcttgttaacatctttgttaccgttaagatgtattgttgtttctaggaacaaatgacaaatcccatgtctttgtcattccataagccttctaccaaatccatgggtcaaagtgccgtatgcaggtgatttactgtgcttgatttgttccatgatttcatctttagacacttccatctttgtcaaggccatgctaatctcaccacagagaatgtatactagaatttctcaaatgtcaaatatattgtgtacacttaaaaaaaagattgtcatctaagtttatcaatcataaaaataaaattccatagtttcagtttgcaattacaagcttgtgtcttaaagtttgttttgctccgatttttaatttggctttttctttctttatacatttcagcttccttctttctctaggttaatttcgcaaatatttcttaaatgttggctatgtgcaaagaattgttttaagcaccttaatagctacaaagataagtaagagcttatctctactttctcctaccccaaggccacccaaacctgctaatcaatcttaaatccttctctttctgctaaatatcattagaaggcatcactttgagggctttttttgtattagttgtaactgagggatttttaaaatattttaattggttattattggtagatatatttgagagaccttacatcacatagtgaattaggatgtttattgaatgtcctataatgtgttcaacagtgtactgttgttaaaaagcatcattataattgtactctaaaacttgcaatttttaatgtcttcattgcctcctgcatttgttgaaatcaataataaccttttaaaaagtatgaactttatgatatgtaaattatatcgcagtaaagctgctatataaaaaagaataacctaaagtatctaaattatattattgggtgttaaaacacaaatagccttctcttgttagatttaatcccacatgtaacaaatttgctgggccattttgcagcaccatagattgactgctttattccacatactacagttctaaaacatgaggaaatcttagttaactaattgaaacactcatttggataagaacttgagcatggttcaataattctcaatttcccactttgcttgtaaaacacaatgtaagtatggaattaccctcttcacagcttattgcactatgtgttcagtcacagagaaataatttaaagcagttcacttccaactgtttccctcatgctgacccctttcttaaagtaacgaatttctcaaggttatgtttattttgaaattataaatttagtcacatacctggttggtttcattctccttttgttgttttcccctttggaatttccacactgtgtcaccaagcaagctcttgattgctcccaccctctttttttttttttcttctttgttgagacaggttcttgctgtgttgcccaggctggagtacagtggtatgaacacaactccctgtatcctcaacctcctgggctcaagtgatcctcctgcctcaggctcccaggtggctgggaccacaggcgcatgcctccacacctgggtagtgttttttgttttgtttctttttgtagagctggggtcttgccatgttgcctaggctggtctcaaactcctgggctcaagcattctccccgccttgacctcccaaagtgctggaattacaggcatgagccaccacacctggccagcttccactgtctttatggctcctcgtcctgcctggttaatctcatacttctttcaattaaatactttattttattttttatttttgtgtttattctttatgcattgaaaccgatgtcataacttctgttttgttaaaatctttaaggcccatcacatatttataatttaggtccttgccttggtgtgttttcctcagtgctcccaaccatagaaaagcaggacaagtttacagttgctattcatctaagtctgatgcttctttcccataagttgttttgggaattaagcatcttgctgaaagtgaatgtgccattttgaaaatcttagcaaattacattttcagaattttatagggcctttttttccctttcgctacctttgttccaaatcatgcttttgaaacaatctttctcccaaagcatttctattaataatacttttcagttctccctcttataactcattgtgataaattacctcctccctccatgatgttaatgttctggaggcctctgagagttctcctcatggtggaagtccactacagagctgctgagagcagagcctttagcctgatgttccaggagctcttgctactgccccatccatccgtccgtccgtccatccatccatccatccatccatccatccatccatccatgaatgattgctgctctatcatgcctcatagctggccctggggagtggttttagctacacttgaattccaccttttcctcataaagtggtatggacatcatattaactataacactattataatcagttgacattgccagtcattatttgagacaggtgtttgttcttctagaatttgcattttctcactgcagaacactgtagaatgttaaagctaaaagattgctcataaatggccatatgtgagaacatgcagtacattaacttgctcatttgtttatgatttaattatgagagtaagtggaaaagaaggtttagagtggctaacaaatgatactgtctcaatattaaatagtgggggctttgttgttgtttttataaattgggtgaaagtccttcatgcttttaattttttttatttaagtaatttatatgttttctcccttccaaggaatgaattttattcttcatcataatccctgcaaattagaggctaaaaatctttgttttacatctggagaacaaatggatgttcctgcttcattctcagacaagcaagtgattgatagctttgatatcagattctgaaatgaaataaattttgtctcaatttgagagaaaatagtgataatacaggtcctttctgccaaccaactcaggcatatgggccttttatttttttgatcttttttcattcactacaattctaaattgaaaaatctcacattttcttctaaagttgatttaacaatatagttaacacttaaaaatatctaaaataaagaatataacacattctactgaaataggcagccagcagtttatacatatttggtctaatacattcctcaccttacataaatctccagaaaagctataggaaggaaacacattcccctgacacgacaggacgtaaaatggatataaaccaattactttttgcagttcccagagtctcaggaatactgacccttctgacttcattttcaagcaagaactctccacccccatcttgtaaggaaaaataattgagctgaatttctagcaagaagcgaatcaagattttcaaagaataatttcgctaggacctatggagcaaatcacctttcaaacatgccaaaggtagttatttgaatacatttaagcccctaatcacagaagtcttttgatgaacttttcccactttaaatacatcaaacgaagcaaagagagtagagaaagccattagaaaatcattataataaataccaacattgatctacttcttccctctcctttggaacctcccctttccttgtttttaaaccttttagttgagctttatatagcaaagtaatcaaactctcacaggccattataaaagaaatttaaatgatttttacgaaaaccattttccttgtttaagatttcagggaacctggtcagtactgtgagggctcagtttttggttgtgactttcaagttgaacctttttgatggtaaatagcctcctgcttatgcctgtgtgttttgacttaaaaaaatcaatctctgagaaaatgggcttccatcttcctttcagccccgtctcctttgatgattgatgttaattcagtaagctgctgacccaagaaaaaaagaattgtttgtgctgttgttttgaataaataaacttacaaagaatcaatggctgtaacttagagaaattaggtagtagagagcataaagtctctgtcgtgtttctcatgtaaataaagcaaagtaaagggcatttcagcaccagatatctttttgaatgatgaaaacttgcttcaagggcaattttttttttaaataaatgttctctctgtatctatagtgagaaaggtctgtagttgtgacaaaaataggacaccttctacttattcacataataattcgaataagtagcgaagcaaagcaaattccttagtcactgggcccagcttacattcaatgttgttagtatgtggacttcagtcttcctaccatagtttagagaaaactttttgaaggactttgtaacaccatgattcaattacctcctcctgggtcccccctacaacatgtgggaattctgggagatacaattcaagttcagatttgggtgggcacacagccaaaccatatcatggagcaaaatgattagcttgcatattgtatgaatttggcctttacttctcggtgtttcagttatctcactatgagataaggaagtgcctccttcatcggttgtacgttttagttgtaaggattaaataaattaatacatatgaaatgcttaaaacagcactagatttataatattccataattggtagccattattattattattattagagacagtatcacactctgtagcccaggatggagtgcagtggcatgatcatagttcactgcagcctcaaactcccagggtccatcaatcctccggccttagcctcccaagctgggaccacaggcacgtataaccatgcccagctattttttcttttttaagagatgggatcttgccctgttgcccaggcttgtctcaaactcttggactcaactgatccaggcaccttgtcctcccaaagtgctgcgattacaggagtaatccaccatgcccaggcagctattatctttattacctaaatagatttacttgattttatgacttttatattatcatttaccaaagttgtaaatttttgtatttttaaaaagtttccattctcaaccattttggtatgaaattcttcacccatagtaatttgaaaagtatatgttatgtgctattctcgtgatagtgaataagtctcacgagatctgatgggtttatcaggggtttctgcttttgcttctttctcccttttatcttgctgccgccattatcacctcccaccatgattctgaggcctccccagccatgtggaactgcaaatccaattaaacctctttttgttcccagttttgggtatatctttatcagcagcatcaaaacaaactaatacaccccatgtctggaattctcataccaggtttataccattaagtttgttggagtaacactcagataagcgtggatggcattgtggaggaagggcaaaccctgagcactttcttaagccacctttctcatgcacacattattattcccctgcctgctagtcatctaccacatgtaaagtagtggcaaacatcagacgcttttaccaccacatagagtttgaggctctcagtcaaaatgactcaaatgccgcacctgctcggtcccagagcacattgttattttctcaagtaccgatacgtgcttttgaaggaaaggaggtagtgcagacatggcaaagggatgtatggatttaccctcttgtgctgaacaccatgaaatgcttttctttaaacaagttggttttctgatcttacagagatgttgtcattctgtgaaagggggaaaactgtgaaggctcatttaaaagtcctcccttctcaccttgattttctgagcactatgactcttttgaatgtcatctctcctcctggtcttttacccctctctttctttgtgggacctgacttctccttccccttgtgtttatattgcatagctcattctagctgacacattttgttagtgttatcagagagattagaaggagtaaagtcactgagagtgttgtttctccttcttccaggtcaacaggcttactttcaaagatagcactccttgtttgctctgcttgggccataattgagcagtatcaagtttgcagtttattctacgtctgacttgttaatttaactcacagtgtactgattttatatgcagcgttggttcatatcttggggctcagaatctaacatatatattaaactgtcaagacactggcagtaggagaatgaatgcttcataatttgatcatctgagccattttaactaatatctgtatcttttgaatcaaatgaaaatatactgtgataattattctttcactgaatgttaattaagtgttgttttaaggttagaattatgaaaataatttctagtaaagcccccgtttaaaagctctacccctaaaaataaaacaagaaaagcaaggaaaaagaaaaaattcctaccccacatagcacattgtctcttttttccaatttcggggcactcatgtgagattgtaggcattcttcaaccacgaagcaactttaccaactctgttaaaattgccacttttaacatggggaaaaacaagataatatttattaacatcaaaatataacaagctggtaaatatctttactatagatctaaatgcacaaaatatagggctgcaaaataaaagacctagaaaatataattttttcttttttcaaaattaagcatagcatattgagcaaatgatcacaaagtacatccaagttagtttatacatgtttagcaatctgtcctatatgatttagaaagctacgggatcacatttgctgttttaaatatttattgttctgccatagcatacactgcttatccaaattatttagacacctctactttaacgaactataactcgtagatcctacttagcatagatataaggaacttgagtgagaactggtcatattgctcagaaaagatgtctcaggatgtagtatcattcttgctttacaaatcaaagtgttcatccttcatgataaaaaggttatttaaaatatcagaatactttattctttgagttgtgcaatgcgctcataactttgtaaaagattcaaaattgatggtttaaatattatgtgtaaacttgatatgcttctaaagacaattatagtacaaattaccatattttggattggtaatttgaaaaatactaaattactttgactttttaataatttggtttgataaggtagaaggcttttccatgatatctgatagatttgtgggttctatgtctaagaaaatgcaagaaagaaaaaatggtgaagaaaatatgttagaaaggaccccataaaaagaaaatgaaaggactttgattcctggcaaggttgagtgctaaaatatgtggtaaatttccagtacaaaggagttagaaatgttgggtaaaatgcaataaacttctttttaaaaaagtattgttgaccttctttagagagtaagcggtctcctgggcatgcaaataaagaggaaactaaaaaccagaacagtaaatggacactgatattgcagctgccttggggcatttgtcagcctcaggaacctagaggtccaagttttaacagctggatcactactgaagacagggccttgggcctgtacaagaggggatggagaattgaaacctcctttttataaagcatgtaatttttgaagggttacctcgtcaattaaagggtagaatagaaaaaaatccaatcagcaaagggagatggcaaggaaatttgtcttggcaaaagcaagcagttcttctcttgaggaatttgccttcaatttaggcctttgttcttcccatggataaagtcttctaaaacatgagttcacaacccccaatcatagaaatatacagggaatatgtaaccataagctggagtcagcagaaacaataagcagttggtatggtcaggctttgcgtccccacccaaatctcattttgaattgtaatctccataatccccacgtgttaagggagagaccaggtggaggtcatttaatcatggagtggtttcccccactctgttcttgtgatagtgagttctcatgagatctgatggttttctaaagggctcttccccctttgctcggcacttatccttcctgatgccttgtgaagaaggtgccttgcttccccgtcaccttctgccatgattgtaagtttcctgagacctccccagccatgttgaactgtgaatcaattaaacctctttcctttataaattacccaatcttgggcagttttttatagtagtatgaaaatggactaatacagcagttcagttagttcccaataactttagaaatgagatttctgattacagaatatcaaatgtctatgttttaaacatttaagaaatagaaattgaataaaaacatagtaaaagtagtaaaagattaagatgctgccagagaagactaggccgacttgagaaagaacaagtatacctctaaaaatgaaaatgttaaatatttaaaaatttctataaatttaaggtgtacaagtgcatttttgttgcatagacatattgcgtagtggtgcagtctggtcttttagtatagtgatcacccaaataatgtacatcatacctattaatttctcatccctcacctgcctctcacctttccaagtctccagtttctattattgctcactccatgtccatgcgtacacactatttagcttccacttgtaagtgaaaacatgagtatttggctttcttgtttcatttaagataaccgcctctaattctatctatgttgctgcaatagacatgattttattctttttcgtggattaatgggttatcatgagattgggactggtggctgtgtaaccagaggaagagagacctgagctagtacagtcagccccctgcccatgtgatgctcagcaccacctcatgactctgcagaaagtcctcaccagatgtagccccttgaccttggactttccagccttcataactgtaagaataaatttattttctttgtaaattacccagttttaggtattataagcaacagaaaatggatcgaaacatattttgagttcagaatttctgtattggcatttccttcctctcattgcctcttagcatttttttcccacaccataggactctactgttaatgaaaacccgatagtcctatagacagttgtttttggataaacacagcaattgatgcttctggccctaaagtttgaaacttaacatttgttttgtctgacgtccttcctcaggaatggactttcaggcctcccaaaaaagtatctaagaatcaaaaagtaggctaaggacatggacagttctcaaaagaacatatacaaattgccaataaacatatgaaaaaatgctcaacatcactaatgatcagggaaatgcaaatcaaaaccacaatgcgataccaccttacatctgcaagaatggccataatagaaaaataatagatgtgggtgtggatgtggtgaaaagggaacttttacactgctggtgggaatgtaaactagtacaaccaccatggaaaacagtgtagagattccttaaagaactaaaagtagaagtaccttttgatccagcaatcccactactgggtatctgcccagaggaaaaaaagtcattatacgaaaaagatacttgcacatgcatgtttgtagcagcacaattcgcaattgcaaaaatacagaaaccagcccaaatgcctatcaatcaatgaggggataaagaattttgtgtgtgtgtgtgtgtgtgtgtgtgtgtgtgtgtgtgtgtgtgtctgtgtgtgtgtgtgatggaatactactcagccataaaaaggaacgaattaatggcatttgcagcaaccttcatgaaacttgagactattattgtaagtgaagtaactcaggaatggaaaaccaaacattgtgtgaagttcttactcaaaaatgggagctaagctatgaggatgcagaggcataagaatgatacagtggactttaggcactcgggaaagggtgggaggggagtgagggttaaaagactacaaattgggtttagtgtatactactcaggtgatgggtgcaccaaaatctcccaaatcaccatcagagaacttactcatgtaaccaaataccacctgttccctaaaaacctatggaaataacaaattaaaatattatatttaaaattaaagaaaaaaaaactgaaactcaccagatcactaaatccagacaataagatgctggacccctcattcaccataattgcttccttgcccatccctagttcccgttttctttacagattctttcatttcttcgctgctatataaacccttagttttggtcagtcagggagattgatttgagactgagttcctgcctctttggctgtagcacctgactgaagccttcttcctttgcagtaatcaccatctcagtgactggctttctgcacagtgagcagcaggacctagactgaacttctggtgtttctgtaacattaatacaagtgctaatttttctcctaactagttatattcttcaatctgtccttaaaaaataattcaaacaattggtcattattttagcttaactagcttttaaatcagttaccatgaaatgtgacttggaaaaaaaaacccgttagataaagatatttatttaacataaatattttcattgcatcttaaaatactagtgtataactctaacaaactgtgtgtatacaggcatgtgtgaaatttactttttttaggattagagaacatctatatttgccttcaagctcccttaaaatagtttagggaaccatttagcatcactttccatgccattgaactcagagttaaaatcgtgattgagatacttataatgcaaatagaaatgtcccgaggtcattgtgtaattttataggggtcttcaccaaagcaaggaagaaggcagtaagttttatagcgtgataggtggcctttatgtgaagtgggttgaaatgttgctctctgtgtaggcacacagtgcatggaataggcatttcattatgttcatatctacctgtatttttcctttgatcaatgcatatgtttgattaaacagaatgaaaatctacaaaagtgaaaatacgtattgaaaaaagtaatagcggtaaagcagtatcttgcagctttttactttgagtcccagtggattagcgattttactttactctagaaatgacagtatagtgatgattatttttcttttgggactgataagaaaagaaatggtgcccaattatattagtcattagtattctttgttataagtattatgggaagcttgtggagctagaagaacgtggcctgaatatatttttaaacaagtaaattatctttcagtattggcaaaaaatgtagtttgtctgccttagaaaaataaaacgttcatacataatttagcttgtctgtcattttaaacaattcagaaggcatagccctgtcgtctaggcctattttttttttgtcaagagatgcttcattggttcctgtgtgaaagtgttgacatttatattacactctgaatacttaagaaaccagaggattccagttcttttggaattaaccaatggtatctcatctactagtcaggcattcacaacattgtgtgcacatgctgaatttgtgctaatggcttcttgccataggtacattttgtgaatgtgactatttatatagcttctttcatatatggcccagtcctcattcccttgtagccaccctccttccccaaatgtgttgctttatgttgaatagtttggaaaagaaacacaatctggaaactatgctgtggtctcttaggtagaataaccaacacacccagcaatttctcagtgaatggctgtcatagtagaggtgattattcatgatcatgatgaaatactttccctgaccaatttaagcttcctcctttagtgttttcatagttcctcttacatctgtttactctaacacatataaaatacagaaagctgagcagtctcatggcctaattgaacaaaccagcccaacagtgagggctatgaaggaattgttaaagaaaaaaaaatcagttaattcatgatacctgttaaagatagaatttattcaaggggggctactacaatggggttttgtagtggggtagaaagatcagtttcaactgcgaatatgtcaaggagaagtagagatttatagccaaggatatggatgtggctcaccgtatggaaaattactaagaagaaacatcaagggtaacagtgttctggctaaaccaacttgataggattattgctgaaggcaggccaaggtggtaaaacacggaaggcagggattaaagaatttgactagatatcaaaggtagtcagatatcaagggtggggaggaggaatttgatcagatattcagggtgagggacttttcctcaactaacccagtaggattgttgctaaaactggactgaaggagccaaggacagaacccaaggtcagggaccttctcagaaagagggctcagaggagccagactcaggtttggtcaggggaaagaattgtcagaagacaaaattacaacaaatttagcttaaagatcttaattgacctttatttgcaattttagaatcaagcaatgcctcattccataaagtagaatgagtgttttgatgagctgagcagatgaggttggctttacagactaaaaatggctgtggaaaacaaaaacagactgcaaaaattggattggtcatttcaaagctctttttttaatgaaagttaaagcacagggaacttctttatcatgccagctaaaactggcctgtttggagatttggctatcatctctctcctggttccccagaaggtcagataaataacttgctttcagcttggtggcttggtacttcagcatgagttattccattttggtttggtctcttgggtgtagtgcgggagctcagtccaaaccaatagcctcctgtaaattttatttaacagtctttgtcagaataaagatatttacttttaattttcttgaagaggagaaagtcactttttaagattcacttcacagcaaaactttgtaaaagccctcgtgagatacctcctcctcagcgcaaagtttgcagtcatggcagcagctaaaaatgtgcctacaggccgcatgccaccatgccatctccctgttaccattaccttcttctttctctccttcctgctgatgcagcagtgcctccttggatacaggatcattcctgctctaggctttttcctgagaggggcagctctcctgggattctggcgaatcaaatgcttcatctcaacagatttgtttatattcgccccttttccatgtggtgggaggaaaaactttttcactactttctttaattcaatgcttggggactgctgaattagaataacagaagacagattaacaggataaaagttacacagtttttattaatatttacatacatgggagttcacagaagagaaaatcaaaaaagtagtctcagggtcttgtatcattcaaacataggacagggcggattgggcttcaaggggtcataaattgtggggaagtgactaggaatatgggggaaactaatggaagataggattattttagtaagggttgctaattcagtctcatccaggtgccgactcctcatcttgtgataacttgtgataagagttgctctcctttctgtggtccggaagtacggagcaccctcacaagggaaatttctgccctgcttttaagcagataagggagggcagagaactcttctgcatctgttcattctcacttgccttcagctcaaaataatccttgtgtttgagcagcatattttagggtagtatatcctcatctccttcatccacaaaagatttaaggtggtttttacagatgcaattaagtaagctaaacttaatgatatatgagaaatatgaaactaatgaaatgatggctcaaaaagtcagaagcagccattgatgttagtggttggagatggactgtgaatatgtcttgagctttccagcagtcagcacagagatgcacatagatatacctcatttgattccttgggtctatcatataaaataaaccatttgctcagaagaattatctgttcctgggaatgggatagcttctagagattctcttgaagataatactttgtaatgtaatgcgtatatttttaacaatgaagtaaatgcagtacaacagagtaaataaaatattaataatacatatttactgagtatattctgtatgccagaaacacattaggtatgctggatatgtaatagtgaaccagacagacatgacctgtgtcttcaaggagcttataaatataatggggagagacagataataaacaagaagtaagcgagcaaaaatatcagatacttatgaaatccagtaagtggcaggtaggaaatcaccagggagtaatacaataaagaataaaattaggtggccactttgagaaggttcagccaaagttgcttcctggggagatgtattcaagttgagaatgaaaggttctgaggtgaggaagagcttagcacatttcagaaattgaaaagcagccagtgtgcttaaaataaggctatgcttaaaatcacaggaagccttcacatggaaaagttgctaccctttgaccatctccactgtgtacgtcataatctcatggctgatgtttcagtctgctgttggagagaccatctcatctctgatgggaggaaaaataatatagagggaataatgataaggctgggtcaagagtgtctttggaagacgttcacttctcacctatgcataaatagtgaggctatggagtatgtctgtggtagttttaacctgaaaaatttatgaagcagtagtaacaaaaaaactaccttagcgccaataaacctaagtagaaaagacaatcaagccaaaagtaatcctcaagagagtatttctagagtccagctatgagcagtagaatttcctggcatactctccaaatgtgattgcaaaatatacacattattagttgtaaaaaaaaatagtttttactaaagtcttttctctaccaatctaggaattactcattgtgtgcttttctttttacagcatcgcaggctttattatttgtgtctcccctaactgagctcagatcaatggtgtacaactctttaacaccacctcctgccctgggacactcacagggtctttggaccttttatgggaaatctcaggaaattattgttgtgtgaatgggaagatggaacaaatcccagatacttgttaaacacttccatcttatccatatttgagtgattccacttccataatctccccttccaatgaatcagaatccctctggattgccagttgtgagaaaagaaaatattttaaaagtcaatagagttcttagtccttttcaaacttagtactcagtctgtgtccagtagcaatacgtatcagtctctgtgtaaaaatcagtgtatgttcatgtacgtttttattcgagagttttccaacagcaccttaacctttctcctcctccttagaattagtatttctcaataatattgtcaatgaagtagaaattaattatttgccacatgttcggtactgtgctaagcgcttcacatgttattttattccatttgtaccttggtcctatgaagtatgtcctgttgtatcctcctccttgttttggatagggaaactgaggtccagagaatttaagtaccatgccccttgtattagggttctctagagggacagaactgataggatagatgtatatatgaaggggaatttagtaagaagtactgagtcacacgatcataaagtgaagttccacaataagctgtctgcaagctgaggagcaaggaagccagtccgactcccaaaacctcaaaagtagggaagccaacagtgcacccttcagtctgtggccaaaggtccgatagcccctggcaaaccactggtgtgagtccaagagtccaaaagctgaagaacttggaatctgatgttagagggcaggaagcatccagcatgggagagggatgtaggccggaagactcagcaagtcaaaattcttccaccttcctctgcctgctttattctagccctgctggcagctgattagatggtgcccaccctgcttgagggtgggtctgcctctcccagttcactgactcaaatgttaatctcctttggcgacaccttcacagacacacccaggaacaatactttgcatccttcaatccaatccggttgacacccaatattaacccatcacactcctaattacacagttagaaagtcgtgtagccacgattcaaacaaacccaggcaatctgattccagggcccactctcttgataatcacatggatttaaatcaataaaaaaaatataaaatgctgtctatattctcggcatgggtgatagaaaaatagccgtgtagataaacctagcctccgtagtccctggcagagaaaggctgtaaggaaagtgtcttttctgtaagaggaaggggaagcaggataggaagacacaactaaggtctcagatgaggcttcagaaaagagattatttatgacataagcttcagtgggtatggccaggttgtgtaggggtgttcaaggctgaagagataatgcttaccagggagtctcacagagtaacccctggatgaacatctcttaagattgttagaaatgctggctgggtgtggtggctcatgcctgtaatcccagcactttgggaggccaaggtgggcggatcatgaggtcaagagattgagaccatcctggccaacatggtgaaaccctgtctctactacaaatacaaaaattagctgggcgttgtgtgtgcccgtagtcccagctacttgggaggctgaggcaggagaattgcttgaacccgggaggcagagattacagtgagccgagatcacgctgatgtactccagcctggcaacagagtgagattccttctcaaaaaaaaaaaaaaaaaaaaattgttataaatgctaagtctcagacctatggaagcagaaacactgaatgttgggccctgaaatctgcatttttaaagcctttacaggtcatccttaggtatgctcaaacttgagaaccgctataaatgctcagaagatgagagaatgtgacttatttcaagaattacaatattatttccattcctctcccttgcaacctaaaagaaacagagttgtttatcatactgaaattgtctacctttggtctaacagtatgtgtaaagaaaagcaattgaagatatattctcatttcatttatttttattttttaaattgttacataatgtgcatattttgggcgttcttctgaaattttgatacgtgcttacaatgtgtaatgatcaagtcaaggtaattgggatatctgtcactgtaaacatttttctttatgttgggaacattcagattcttctagctattttgaaatatgcagtaaattactaactgtagtcaccctattgcaccatcatactctagatcttattccttttaactgcatttttgtacctattaatcaacctttcatcatcttcccttcccactaccttttctttgtgcaatggcgcaatctcagctcaccgcaacctctgcctcctgggttcaagcgattctcctgcctcagcctcccgagtagctgggattacaggcatgcaccaccatgcccggctaattttgtatttttagtagagatggagtttctctatgttggtcaggctggtctggaactcctgacctcaggtaatcggcccacctcggcctcccaaagtgctggagttacaggtgtgagccactgcgcccggcccccactaccctttctaactatggtaatcaacaatctactccctatctccatgagattcatttttttttttttaccttaccacatatgtgtgagaacacacaacatgtctttctgtgcctgggtttttttatttaacataacgacttgcagttctatctatgttgttgcaaatgacagcttcccattctttttaatggctgagtgatatttcaatgtgtgcatgtattgtagtttctttatccatttatctgttgacagactcttaggttgattccatatcgtggttattacgaatagtgttgcgataaatatgaacatataggtatctttgatatattgattttttttattatatgtctagcattttttttaataagaaagtagactttgtggatagcaggtttccacatttcactttcacttttcacctctttctcaatagttgaatcccttcccaactagcctcttactcttaagagacttcatattatttaataatgttataattaactaatgacatattatttaagtattggggtaaaaccaaaccatcatcaccttaaataagtctgtattgataattgttgcagtgatatagagatagcaccttttctagtccattatcattgatgttcattgagttgtctcagcaatttacaaatttgaaatggaattccagaggcatctgaattatgcttatcctaacaattatgttgtatgaatcaaatgctattacagtaaaagccaaggggaccatccaaattcatttgttatactgaaacacaactgtatgtggggattgcttgaaataatgttttattatatgaagattaacatataaatatggttcaaatgtttttcatgttttagaggttatttgtactgcttcttaggtcattaaaaaataaaacattttactgatcaaggggcatttaaagcatgacagtgttaaagtatgccccggctggcaaagcggacttcctgtggctaactgaggtgctcattaaacagatcaggtggccgtggctgggtgagggagcagtcatgtactctgtgttttgcagagatgctgttaaagtgtcacaggacctccctttctacgatcatgccaaaccagtttctgttgtcaatgcagagataggctgtagctggaagtcccccagctgaccaccaacagaccacctgacaccaaccaactgaccactgaaccagccaattaagaaagactggtgatttagggcttaaaggtcatccagtcaatactattcctcactcccctgactctcctcctctgtcctacagtttttgccttcataatctctgactcttcaacccatcctcagagccagcacattttcagtttgcactgtaggtttctggtccccaatctgcatattgcttatagaaaatatagctcctcttttttttccccatgtaccttatggtcttatattaacagtattttaaatgcaaaacaaacgtatgtttccactcaaattctggtctctttttctgtataatctttgttgttgttgttgttgatattgacaagagaataacataattattgatttcttatagctgctttagagcagtgcattaatcccactttcctctttactatgtttctgttgttgcatttaccacaattttatttaatttctttgtttacacatcagcctctcccttactatgtcatgagggcaaaatgtcttatttgtcactatatctcttgtccctggaacattattagtgtagtttttctttctgatgattttacaaatggctcaattagtcaatcatgtgcaataattcatttaataaacattttttgagcacagactttgtgttagtactgttacctgttgtaggaaatttgttctaagtcctggctgcatcatgttacttagggaactttgaaagaggctctttactcctacactccatccctggtgattctcatactatagggtaaggcttgggacctgggaagtgtttgtttgtttgtttgttttaaaaaagctctcatagtaatactagtgttctgtcatgcttcaagataaagagattgtcctttcactagactggatatatcatattcttccttttctttgattaatatctttgtctctgtttttttaaattttttgtttctattcacaagaaaaaaatagaaattgggagacttgagtagcttattttcaagtttaaggaatgggaaggcacttcaatatagattatcttatttcacttaataattttgtaaagtaaatgttattatttcccttttttccattgagcattgaaggtttttaaaacttacagaaagccacaaaacgagttaatgttagaatatggcttggaatccagaggtgtgtaactccagagctcatattcttttcccttaattaaaagcaatgttaaagaaaaaaattattcttggcacttgttaaagatggtgagggaggctttattcaaggggccttggccataggtatggggaccactgcgatggggcctcgcagtgtgggagagagattgggctctaccctgattccaacaaggacaagtggggatttataaccaaagagcatgtggtgcaggattgggtggaaagtccctaagtggaagcatcacctgcagggggtttctggctaacccgacttgataggaccactgttgaaggcatgccagatgataagttatccacggtggtcagataccaaaggtgggtgattttccctaaactgacttaggattcttgctctaattggattctacaaaagcagagagggaaacccaatgtctgcttactcagaaaggactcagaggaggctggctcaagtttaggtcaatgaagagagtctatcaccagctctgctgtaaaaccaaagttagctgttttataaatgtgttgtactgactgcatatgtgttctgttttaaaaacagaagaaaatgaatgagttatttcattaaaaaatgtaaataatttatgaaaaaaaattatgttgatttatgtgtgtgaccttggttgtgttgtgttttgtttacccctgctctctgtatcagtgcctttccgcggcgggggtggtggtgggggaatcctggtctattgtttttttaaaaaacattgtgtatagtttaagtagtgccttcacttctgtgttgagactgttattcttaaagaacatgcaggccagttgtggtgactcatgcctataatcccagcactttgggaggctgaggcaggatgatcgcttgagcccaggagttgaagaccagcctgtgtctctacaaaagacacaaaaattagctgggtgtagtggcgcccgcctttagtcccagctacttgggaggctgaggtgggagatgcacctgtgtgtatgaggttgaggttgcagtgagccaaaatcacgccacggcactccagcacagacaccagagtggtgtcaaaaaaaaaaaaaatatagaagatgcgatgcatatagatatacaactattttttcacactacagactagactatataactatttcttaaacttacaaaaacagcaacctatattcagtgtgcacattaacacactctgtgccttgtttttttcttatggcaagtatgttggctattgtttttctgtcttggtggctttgaggccatgtactgtgattttgcatagcatgttaaggtttagcagttgatggttaatttatttgtgtatgatgtgtgtctgcaatatggaaattaaaagctgactgtaacaataaattatgaaaatgaaaaagtaggcaataaaataggcatgtgctttgcaagttctatagcattatattgtatttcttgtaaaactgcactaccttgaggttgctttctagaagtaatgttattgtttagtatcagcattcactttttttagaatcacattgatagatatgatgtaaatatttgcacaggtgaaattaaaatacacagtaaagaggatagttcgaaatcttaagagagggatatatttaatttagagtgtttaaaatgcatgttcttacactcttctctctgtttggaattctctttcccttttttgctcctggagcaaattggtttgcagcccctcaggtccattcctcaaaagagccttctccgcctgacactttcctagactgagtcagtgttttttcccccagtctgtacctgcaatggtttttttaagtgtatgtcttatcaacctaaaataagcaacagaaagaccaactcgccaaagagtttattcaggaatagcaggggagcaatccagaatatgcctgctatgatggatcataggcgcttccagagaggcaagggaaggtaagagtctgtaaaggcaaaatgagggaggttacagtagttgtttagcatcagttcgttagtggaacaggcagttgctgggctggtctccttgtagaactaatctgtatgtagggttgcggtggcctttatgtaatgttgtggttttggcagtctcttatgataattcctgttgtcaagcaaacatgcatgagggcctgtctttcatcgcatcctggctccattttgttggggtttgaataagtgactctcttttgacatggacaactttcacagtcttctcaagtacatgtgagctccttcatgtaaggaccatctgtgggaggtcccatagagtctgaaacattgaacattcactaaatgtttgattttgatttaatgaataaaatttattgtttgcaatagaaaatgtaacagaacaactaatttcacattatataattgtgacatatgttatgattcttattttcagaaaaaccgaggtctgaggtagctaaatagctttctgaagtcatacagattgtcccttagatttagtctgacattatgttcatgtgttattcaatcctatatgcttttcaaaaaaacctgcatttgcccagctacaatccacatgacactattgcttccaagaaatgtaactggaatcatggccagtggaggggaaatggattttggaaaaaactattaagtaaaagttaatagtattttttacttttgactccaggacttttctcaactataatgtgctaaagtgcatagtaccaaagagattgatttaacacgcaatattttacagttatatgttaacagaagccctcttcaaaattacttattttctcttgagggactatttttttttaaggatgtaatttggaggagctacactaatctattctgtaagatgttgattcaagttctttatatcaaagtcatctcaactttgtatgttaacaaaagaaattgaaaatatattggttgtgggctcttttcctatattcgactctgatatgctctataagttttgacaaattccaaaattgcaggaaattgtttccatttattcattagcaagggggctatctgaggagacacatggtcaaatactcagcttttggatttgtgaatttcagcttgtagtcattgttttgctaagaggtcttagttaagatgtatatgtcagatcatactataataaataatagacaatccaaattcatttactttactggatttatgtttttattagctgaaggaggttggcttggtaattgttttttatatggagacttaagtatcaaatatagtctaaggaacattacagggacccctctctgtggccattatttttagttagtaaaggggaaaaagaggccttctctgatagtcagtattaacttagtttagtagtgtctgttgtaagataatttaacttgatcaaattcaaatattaggcttagaatgagctcaggagttcaaggtcagccagagtaacatagcaagaccctgtctgtatcaagaaaaaaaaaatataatgtattcttacctggtgtaataaatagaaaagaccaggtaagcagtatgagaataaaaatatagatacgtatgttaatgaaaataaacattactttgaacttgcaagtggtattccaccaaagttaaaaacatctatgaagtcttacttttccaacttgaatttatccatagataattaaaagtaaaatgtcctagacttgagaaattttttattatccaaatagctcttacatgcccccaaaagatctccacagagtgcaagagacttcataattcagcattaatctgaattggaactgagttgaagcataatattgccttaaatattttaatgaaggagaatattaacctgattaaacaagatcaacaggctcaaaatggaaacatttgcctgtttaatcaacagtgttttagacactgttaaggattttgcatacagtggggccttgttatgctggttgttggttagagtgattcccccattatccatgggaaagacattccagggcctccaatggatacctgaatccatagatagtgccaagccctatatacactgtgttttttcctatatgtacatacctatgataagatttaatttataaattaggcacagtcagagattaacaacaataactaataataaaatgcaggttgaatatcccttatctgaaatgcttgggaccagaaatgttttgcatttctgatttttttcagattttggaatatttgcatgtatataaaatgagatatcttaaggttggaccccagtctaaatacaaaattcatttattttcatatacaccatatacacataccctgaaggtaactttgtataatatttgtgataattttgcgcatataacaaagtttgtgtgcattaaagcatcagaaaacaaaggtgtcactatctcagccacccatggggacaatctgtggttgtttggaatcactgtcatttttctttttctttttctttttccttttctttctttctttctttttttttttttttttttttgagacagtatctccctctgtcacccaggctggagtacagtgtggtgatcttggctcactgcagcctcgacctcccacactcaagtgatcatcatttctgactctgaatgtataagctactgattagcaatcattttcttacgcttattcacacataaatacttaatagcaaaatatataacataccattaaaatagtgaaaaaataatgtgttcggggtatctaagcagcacagcagcatcaccagaacacccgcatcagctgctgaaccacagccagctttgtcgccaccaacgatgctggtttgttcattctcttctcttctcttcccttcccatcttgacaaggtctcacgctgttgcccaagctgcagtgcagtgatgtgatcacatttcactacaaccttgaaatcatgggctcaagcaattctctcacctcagcctcttgagaagcctggattgcaagtggggcatcatgacttccagccaatttttttttttgaattgctatgttgccgaggccagtctaaaactcctgggttcagatgatcctcctgccttggcctcccacctcactgggattacagatgtgagccactgcacccagcctgtattttatttatttaggtgagaagaaacatcagaagcagttgagggaccaagaagtggatcacctagggatgaggaagcattgtgctaggtggcttttaaaaatgcttccagcagagtcatccgtggctccataacaatttttgtcttagaagtctttctttaattttataaactgccatgttctgttatgaatgtgcactgctctagtccttcagtaagctcatcacatatttgcaccatgttgtctgtagatagtaattttgcagtgttaacaatgccatctttatcgtcactattatcacaatcaccttgattcagaaccattttggttattttgccatcagtcaatgaatgaaataactgaagcctcattatcaatgttaaatttctttaacatccacttcttccagcatactgatgaattctgaagatacatcttttgcatatgtaaggagatcagacttttttttctcacttgacatgtgaaatccttcaaagtcagcattttgttcatcattatcactgaacatagtcacaggttagaagctgtgccaggcacgcaccactgtgtctttagtcacagtgttctaggtgttggcaacagcatatgtagcattatttatgctaaactccttttgaatatcttccacaaccacaccaatgttcattgctacgttgctgctagcatgttgttcaagaatacatttttatattcactctacattgatgtaaggataccttcgtcacatggatgaattaataaattcacatttagggggagtatatgtggcatgaacatgatttttgatgagaatttctgctggaggatgagcagaacagtggtcaaggaataataaagttgtgcatttgtcatcccggccagcttcctttcagtgagcacaagtcactggtacaaaatgtttgtgaaaccgatcagaagagatatccctggtgataaatgcctttttgttcatataataatagactagtaagaaaatcactccttgaaaactgtgagatcatagccttttcctatcataacaaattacgcttatgcatgcctactgcattagaacatcccaacacagctgttctgtctttggcatccttaattcctgtaggagctgtctcatcagctgtggccagtgtcgttctgggaccatacaccaaaacagtgatgttttaacagcattatagacttgttctggcatcagatttccatcagcgatgaccttggcaaattcatcagtgaattgctctgctccttcatggtcagcagatgctttctcactgtataaatctttaaaacaaattgaattccatgtttaagtttctataagtagcctgttgaatatttacagttcccttcaattttcagttcatcttgatagagctttgcttgtttcatcatcagcaataccattaagaggcatgtgttcactgtgacactgatcaatccactctttcaacacctaagattttaaaaggaataaattaatttttaaatagtgacgagaacttgccatgttgcccaggctggtcttgacctcctgcaattaggtgatcctcccgtcttctcccaaagtgctggaattacaggtgtgagccaccatggccatccctaagatctttatttttagctttatgcagtgtttttgtatttttcgttaactttgtttatcactttcagcatggaacttcaacagtttatccttgttcttcaggtcatatatggtggtcattgtaacaccgtagtcttctgtgacatgttccatacttacactgctattcagtttctccaacagcctgactttcagtgctatagagaaacataaatgctttccctttttcctatcactgttattcatagccttcttgacattttcaacaatatctttcaccacagagcagagaataagcacaaaaatacagtgagtaatgcacgtaggtcttagccccatcctggggaacctgtccttgctgcatctggcctgtacatgtggcattgtattacactttgtgagtgtgcttttatgggagggatccgggtgtgtgtggaaaagatacattgcagctgaagggaagaaaaaaatctgtcctgggagggtaatttgttccttgggagtgctgaataaactgtgttgtacacctgaagttgaactgtgacttgtcatgtgaggtcatgtgtggaattttccacttgtggcatcaggtgatgctcagaatgtttcagattttggagcatttcagatttcagacttttggattagggttgctcaacatgttgaacaattataacaatatgctgttaataatttcacagatttgttcttaccttagatcttagtaacctcagcatatgattttattttctttccgtaagttaagaacttttaccttttcacttagcagaaaagccgggtagatactatactttttaaaaattaagagagaggcaggcacggtggctcatgcctgtagtccaagcactttgggaggctgaggccagtggatcacttgaggtcaggagttctcaagaccagcctggccaacatggtgaaactccatctcttactaaaaatacaaaaattagccaggtgtggtggtgtgtgcctgtaatcccagcaattcaggagtctaaggcaggagaatcacttgaacctgggagacagaggttgcagcgagctgagatcatgctgctgcactccagcctcagtgtcagaggaagactccatctcaaaaaataagaagaagaataattaagagagattatttctaaaattataaatgtactggaactgctagttaaattctgtctgcttctagtagaaactatagttactaaacaaataaaaatatagtagttcctccttatccacaattttgctatctgtgacttcagttacccatagtcaattgtggtccaaaaatattaaatattaagaaagcattttatggcttatttttggtatatccaaattgccagcatcactacttttggactctggggccattattaagtaaaataagggttacttgaacagaagcactgcaatacccgtctgagagttgacttcataatcgagatggctacgaagtgactaatggacaggtagcgtaaaacgcacggatacactagacaaaggaatgattcatatcctggatgagacagagtgggacagcatgagatgtcatcacactactcagaatggtgtgcaatttaaaatgcatgagttgtttatttctgaaatttttcgttttatatttttggaacacaattgactgcagataactgaagccacagaaagcaaaactgtagataaggaggaattactgtattttaatttgtttattaaacttcgtttctactagaagcagacagcatttaactagcagttccagtgcagttataactttagaaataatctctcttaatttttaaaaaaagtatagtatccacctgccttttctgtcaggttgtgtataaacttccctcccagcgagtttgaattaatgtcattttgatgaccaccatgtgtatgtgtaagtgcaattctgtatctgtgtgtgtgaaaaattgtgtatgaatccttttattagttccattagcctcaatataattaaattattgtactaaaaatatccagataagtaatttccagcatactactatgattttactttataagaatttacaaaataggcttatcaattacaaaaggatacagcaaaggagatgtgcacaaacatattagtatttgtacttatatttacatttatacacacatacatggaaactcacaagtcatcattagacatggcttttggttgactaagagccctctctgataggagaaatatagtgcaagccacaaatgtaattttatttccaacagaaataatatgagccacatttaaaaagtgtaaagaaatagatgaaatacattttaataatacattttattgcacccagtacatccaaaatactatctcttcaatctgtaatcaatataaacatttttaacgagatattttacattctttttttcatatcaggtcttagaaacccagtgtgtgttttatacttagagcacacctccatttggactagccacatttgaagtgcttaatatccctgcatggcttatgagtggagcaaggggaaaaggtggagagggaagagtacctgtctctcttcttctttgcttaagggcactaatcccatcatgagatcccacccttatgaccccatctgaatctaagcacctcccaaaggccccacatcctaatactgtcacactggggattagggcttcagcctgtgaatttggggaaacacagacattcagaccatagcatttataacctcaagctttcactgtctctatcccagtaaaccagagctcttgtaagacatgtgtgtgtacacattaagtggccttttttttttttgcctgttcttctttaagaaaaccaatataaaattgaagctaagacactaatttaggacataattaattgttgaggtgctttgaaggatctgtattgaagcatttactggtaaaagtatagaatttaacatagatccatgattagccaagaaaatgacagaaaatgtggtggtgcatgtctataatcccagctactctggaggctgaggcacaagatcactggaacccaggaggtggaggttgcagtgagccgagatcatgccactgcactccagcctgggtgacagagtgaggctttttattgacatatcaaaagaaaataaaagatgatagaaaagccattgttggtttttttttttccctccacaagagtctactcaaaaaagtcattgttaaagagaaacaaagaaaaagttaaaaatgaaataccaattaattaagttttctattttagtgtagattttaggaatctgcccaatttttgctcacctcccaggtgcttatttctgaacaatatttgccctttattttttatttatttatttattttttttgagatggagcctcactccatcgcccaggttggagtgcagtgatacaatctcagctcactgcaacttccacctcctgggttcaagcaattctcttgcctcagcctcctgagtagctgggactacaggcgcacgccaccacgcctggctaatttttgtatttttagtagagacggagttttgccatgttgggcaggctggtcttgaactcctgacctcccaaaatgctgggattatgggcatgagtcactgtgcctggcctcatttttgtttttgatggaatggaattcctggattttgaaattctgaaactctggttatcatgagtgacagtgaacaattacttagataatggaatgataaaaataccagaaatttttaaggtgctctgtggttcatattatttataatgtgcttttttgaaatcttcaagatagaatctaataaaaactttcagactcagaagttggaagtaggagtactgacttcttagtataaggtgaagcagaagtatatgactccttgttacaaggagaaaaagacacaaaaaggaagaatatgtggtcaatacagaaaaataggaattcttcatacgtgacttgataaactaaaataaatgaagaatttgaggcatttattatcataatctcttgttgagtttgtgatgctgagtttgggaaagaacaaacattttagttggctagatggggaacattgatatgaaacaattcagtgggttacctagtcctaataaaagaattccattccacagcatggagaaagagagatcaacattaattgacattgaatggattggaagaagacaatcaacacatttattcatttatttattcaataaatatttattggacatttattatttgctgcagaacagacaagattccctgccgttgtagaggttaaattctgatgagagagaagtgtccattttgttgtgagcactgtgatgggttcttcccgttcattctctcatttaagtcctgcagcaacttatggcattatcattatttcccatttaaagatgaccaaactgagtctcagtaagttgctgaagattacacagcttgtaagtaactggaaaggtaattgatgtatacttattaacagattcatcaagttacatgcattaaatatgtacagcatcttgtttgtctgtcagtcatatcctaataaagtggtttcaaaaaacaaaaatctcagttggtctgaccccatggatccatagctccactactgtactgtctccttccatggtcacactttttataggaatcccttaccaaatgtccacatttaataattttagaacatgtgagtttgctcatcattcagttgcattttttcagagcagttattttggagtattaggcttggttatgtcttcaaagaaatgacatctgatgtggctgttctgatctggttgcacaaatggctacttctcgtcagtaacagcaggaagatttgtaatgggcactgtgttcagaaaggttctgatcagcagcttcctctttactagtgtagtctgtgtaattgcaaaggacaacaagttatcactaggctgtgtctgccaaggtggacattgatggaggtgctgtagaaacatatagattttgtggaggaataggacgtaggagatgacatcaaggaggaagaaaagataaaaaggaagcaagacagttccatgcacagaccagtcagctacagtgaagcatcctgcaaactggcaaactgattatcagcagtggctgtcaccaggctctgccccagcaggtgagagttgctacctgccaatttgtttagacaccttgtttgttattagattaaggttttgaatacatctgatccaagagaatggggcataatcatatttaatgtggatttggccagacctcagactacatagctggaagattatgtctattcattgcctaagtgagtttagcattgttttaaaacattctctgatggactcatcactatcataatctgttttctttttttttttttttttttttcaaagtggtatgtggtttcagtgtcgtcgtgaagactctgtggctttttagccaaatcatcttaatgccaatctcttactacttgtgaaaccttggataaatgacttaatctcttgtctcagtttcctcctctataaaatggggatagcaatagaacctacttgatagcatttttgtgagtaaagcactttgaagagtgcttggcacatggtaaatgctgtaggcattagctagactgctattactgtgattattgttattgctgtagttattattacacatatgttattacaccaaacttaaattggtcaccattatcctcttagcatcaaatgacagatgaacaagagcatttacttttagattcctggcactttgcctatgagtgttgtcatttttatcagccataaaataacttatgagtttaataaaatatcgtatgccatagtagccaggcatttagagaatacttgggaggaagtgcagcagaagcagcaatggtgatagtctgggcttctatcacagggtgggacagaccttggagatatgctgtctcctctgtacttgatctttcatgtgccatccggagtcttccctcttgctcaaaggcctgggtcagtgcatccttagtggctcagtttgaatggggatttcactcagtgatgagatgatgtggacacagaaactagttgtgataaaagttggtagttgcggccgggcgcggtggctcacgcctgtaatcccaacactttgggaggccgaggcgggcggatcacgaggtcaggagatcgagaccatcctggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagtgagactctgtctcagaaaaaaaaaaaaaaaaagttggtagttgcagatacaaaatgctactgcatgagatctgtccagtagcctcaactatttttaatatgcagtcagagagacagaaatgtatttcagggcagctgctaccaatttctttttttttgttttgttttgttttgacatgatactttttgccagatactgttcttttctatagagtaatcctaaatcagaaaaccatgtcatgatatcaggcttaattttaacagccagaaaaaaaaaatcgccaccaagatataaaacattttacaaaatgaatgagggaagagattttgagcacagtattggtaaagtagagttcaaggggtgagagatgtgatacaccacaccgtccccacggaaaaacagcaatacaaaatgaactgtatcattttttactgacttgttctgttggtgattgaggcatttcagtgcacaaccaggaaaataataggttactttcacaatggtagaagtttaacaaatgctcaattattcaccctacatcatcgctgtcattggtgagagttttactgtatgatattgatgcctggcttctttcttattgctgtattcttttcagattcaatctgtctgcaatgggccactaaacatttcaatttgctacctgtggagctggattgcaatgctcagactgaaatgagaaaaatggatttagtgaaactcaaaatagagagagtttcatggatttttgtggaaggatgcacaaactgaaacccactgataaaaatacacacgatcacttttgagtgtctcataaaagtacatggtattaagcaattcatggatgtttttagggaaaatagactcagtgagatggagactgacaagactcccaacacttaggggaactcagactctgtcaatctggggtgtagttgtgtatactcagtgccattatcatagtccttgaatacagtatttgtaaagccgtacttgtttaggtgcacttaagagagctgagctagcaaagaacaggataaagtccaaattattttctggccaaccctagcatttagttttttcctagcaggaatcatttaggagatttcctggttgggagagagggttcatttcatatgggtgcctcttattattgtcatttcctgactgttgcccatagttcttgactgactgtagtactcactgtcttaccatgccttcctgtttatttatttatttatgcccattttggatttatttttctctttgactatcaagatgctctaaaagtttccccacattgcctaaatttgagctccatgaaataaagtggatttgacaaacatcaagaacattcagaagtacttgatagaaaatgcaagtattaagaattagaggcttaaaaaagactgaagtaccacagtaaggtgttacttcaagcccactaggatggctgtaacataagaatgcaaaataacaagtcttgccaggacattaaaaaattggagccctctggccggacgcagtggctcacgcctgtaatcccagcactctgggaggccgaggtgggcaaatcacctgatgttgggagttcaagagtagcctgaccaacatggagaaactccatctctactaaaaatacgaaattagctgggcatggtggtacatgcctgtaatcccagctactcaggaggctgaggcaggagaatcacttgaacccaggaggcagaggttgcggtgagctgagattgcaccattgcactccagcctgggcaacaagaatgaaactctgtctcaaaaaaaaaaaaaaaaaaaaaaaaaaaaaaaaaatggagcgctcctacactgctggtaggaatacaaaagggttccaccatgatgcatgatggcaggtttggccgtgcctcaaaaaattaaacatagaattagcatataatttcactattcactcctagatatatataccaaaaataaaaatttaaaaagggactcaaacaagtacatatacacacacattaataaagctctattcacaatagctgaaagatagaaatagcccaaatagccgtcagcaaatatatggataaacaaattaatggtatatccatatagtggagtattattcagtgataaaaaggaatgaactaccaatacatgctacaacacggatacacctccaaaccattatactaagtgaaaaaggccaggccccaaaggccatatattatatggttcaatctatatgaatatccagaatggataattttatagaaacagaatgcagattgatggttgccaggggctagggaaaggggacaattgggaggaagtgcttactggataagggctcttactttggagtgacggaaatgttttggaaatagagagaggtggtgatagcaaaatatttattgtactaggtgcccctgaactgttcattttaatatggctaattttgtattatatgaaattcaccttaataagttattcctgaggaaaaaaaatagctaagaattcttatctgggaagacaaagtaaagggttaataaagacaagtcctcatatgcagtaggttttataagaataaccaactcatctcctcttctacagagttgcctaagtaagaaaagataatttatagtggaaggaatatggaccatgttcattcctaccaactagattgtgacctccctcagaatggggattattctttgacttaccaattatttttttttcacaaagttacataacagtcattaatttcatcattctgaaatattcataagagcttgctgtgctataggcattatgttagtcttggggatataaatgtgagtaagatagatatcatctagaattaaggttctgtttgaatagaaagaccaaaaaataagtaaacaaacacaagaaaggtatttgatatggttaggctttgtgtccctacccacatctcctcttggattgtaatcctcataatcaccatgtgtcaagggagagaccaggtggaggtaattgaatcatggggggtggtttcccctatgctgttctcgtgatagtgaatgagttctcatgagatctgatggttttataaggggctctttccccatcgcttggcacttctccttcttgcctccttgtgaagaaggtgccttgcttccccttcaccttctgccgtgactgtaagttttctgagcctcccccgccccaaacatgctgaactgtgagccaattaaacctctttcctttataaattacccaatttcaggcagttctttatagcagtatgaaaatagactagtacagtatcatagaacataagagctataatggaaaccaataggaagctgagacatagaaatatggcggggaatttggtctatactgcttgataggatacacagagccttggatgtgggcacaaccactgtcaggcccaccctcacaccagcatcagtactaggtagaagctttctagagttgggagagagttttttctgcaaaaaactcttttgcagtttaaagggaagataacctgaggacaggctgaccatggactaggcaagagccaagggagtgacagacagctggagccacagttcaccgtcctggaaccctccccaccttctgactaactgttgcatcctcttgctgctgaaagcctactgacggagaggtcaccttggatgtttcttccatagtctgtattgtatgttcaggaattttaggaatcaattgtgttagcaagtcatccccattttaccagagtgagaacaaagcctctagtggtgtagtgacttgcctaagactcagccaggattcaattcctgatctttagaactcaaatctagctgtcttttccattcatattataatgattgtcataatataataaaagtaacaattggccccccatattcctgggttttgcatccagttcaactgagtataaatcaaaacatcattgcatctgtattgagcatgtacagactttttttgcacaactgtttacatagtgtttacattgtattaggtattgtaagtaacctagcgatgatttaaagtatgtgggaggatgtgcgtaggttacatgccaatactacatcattttatatcaggtacttgagcatccatgggcagtgggctgggttggtcctggaaccagtccccatacagataccaggaatgactgcactagactacaaaagagcaaacagatttggactttagcctctactctgctactgtgtgaccttgagaaagacatcacatctctgggcttcgtttttctctgtggtatgatggggtaggttatatctgttgatctccagctcttcttatggttctaatacctgattccattaatatttcttcttctgttttttctttactcctcaaaatcatcatgatcatcacaaaagagcagcagttttttcctgggttgtataaataaaggaggctagacagcagagaatggaaactgtgggcagccttgtactgggtattccagtatctctaattccaaactagtatatgtttttaaataatttcttttagagacagggtcttgctatgttgcccaggctggcctcaaactcctgggctaaagtagttcccctgctttagcctcctgagtagctgggactacagttgtgcccaaatcagttattttccagacttcagtgttctcattatcctttcatttcttgtggctaccactgaacactttagctagaaaaggtgaaacctgactgcagaccacaaaaacggatccggtctcttagctcctttctctgccaccctcaaagtagccattaaatctttcacattttctaatgactttttttttttttggaagggggagaaattgggaatgcaagcaatgggagagatacaagttatagtaatataaaaagttatagtaattcagtcatacagtataaaaacccttatattttgtgtgaatataggaaattttcttttcttttttctttgagggccttatctctgctcttgtctgctgaattcaaagctgaccactttctacctcttctgcattttgtgtgttgtttcagcagacattgttcgttgttttcttttcactgttagaggctttcagagagagaaaggaagggaagagaagggaggatgctagggtaccagtgccctttcactcctaaattctcatgagtctgtactatagacccatgaggctgagcagtttacttcccatgttaactctaattcttagtctagaaagcatatttttttcattggaatgttactgtcaaattgctatattattcctgttcaaatggggagaaccatttataggtgatgcagaatcattaaagcagttaactctgctggagaaggtggaaggcacatggtatctcaattgagaaattcttttcctgcttctttaaattattaaagtcaaatacttaaagagtacatgctacaacactacattcaaaaaggtttattctagcatgatacttaagtattctttttctagatgcatttcattcatttaggcatccattcatcaaatgtttattgaatacttacaatgtgcagggcactacagagtgctgggcatgtagcaatgaaaagttgacatgggactctgtctttaagtggctttcactgtgttggagaaaacaaattgaaaaatgtaagggcttgttatagagctgaaatacttgtatatgggagcgagtcttgggtgaatgcaacctatgtatacagataaggatttagaaaaatgtaagagcaaaaatactgctttagaaggatctgtaagagacattctgcctattcacagaatagtgtatacttattacatctaatcttgcctgatagacttgaaaacataaaatggtttttaatatagattatgatatggtctcctgtcatgacatatagaaatggaaatgcccccaaaaaagagcttacttctagaatatgtttgtaattataggatttatttgttttacactacttagaaaatattctttggccgggcactgtggctcatgcctgtaatcccagcactttgggaggacaaggcaggcagatcaaaaggtcaggagattgagaccatcctggccaatatggtgaaacctcgtctttactaaaatacaaaaattagcaaggtgtggtggtgcgcacctgtattccaagctactcgggagtctgaggcagggaaatcactagaacctgggaggcagagattgtggtgagcccagatcacacccctgcactccagcctggctacagagcaagactccatcttaacaaaaagaaaaaaaataaaatattctttaaaagtacatttcttcaattggccataattcataccagtcctgtgttctttgagctcaactataaattaagaagcaagaaatttagtttttctttcatagttacattttttaaaaaaattggtatcccgaatagattccaataaaaaaaattccaaagatgaactgtaaaaacttctgaaaggttcactatttttcttatcctttaaggtggctactgccaaagaataaaatcagtgaaattgccttttgtgtgtaattcaaggttaataacttgtgggagaactttcgatcataaagtgagctttataattttatcaatgataggaacaatcttctattaggttagtattattcatttaatagctaaagagttggtgtatttctcattcagttgtaagtgttttctcccttttaatctgatccattagagcactactagaatgtagctgttttggctgtgcacatgcttgccgccccccaacccgtgaggtcctccatgatgtgctctccacactaccccatggttctgcataaattttttgaatatattgtttatatattcatcttactgctagattgggagcttcttgtgccaagacagtatctttgtgaatccagtgcccagcacggtacttggtgtattagatgtgcatatgtaaataatgagtagatgaagtgtggtcatgtgaaggatagaatatacttacacacatacacacacaacaagcaaatatacattaaatgcctattttttacatgtttatatctgggcctgttgaagttactaaatataaggctcttgtcttatccttggggagcttacagtttcattggaaccaaaattaacatttgtgaaaaagttgccttaactaaagatggtgtatatctcaaagccttgctttattcacaggctaaaggatcacctctcttataaacagaggctaaagaactccttttaataaggagaatcagggacttcttcacagagggaatgggactttagctcagccttaaaaaagtgagtgagacacatgacaaaaggcactgtcatataggtggtgatggtggtttcattcactagattccatctaagtctccattcatcatgcaccagagttcaacactgattgcccgcctcacccagcgtgggttaaggaataggttttactggtgaaagggaaaacttacaaggctaagtcagcaagagaaaagagggagtactaggtatactaggtttggattctgctgaacctactctgtgggtttgagtttccctggtattccgccttaccacagggcaagaatgaggaagcattcttattggtggggaatacagaggctacttaggaccaagcagttcaatttagggccccagctgcctagagaagttgtctgagaatgtcagctgctttcctagtacttagatgcctttagactgatgtgaattggcagttttctctttttagagaagccaccagtgctgaggagaactgatttgggaggaaagtgttcacctacccaagccagcccattgtccaggcaacactgggtcagctctggggtcactatcagataatcctgcttcttgcactaccgaggttaagaatttgcaccctagaagacttcaattcaaatccctgcttccccactcactggctatgtaacctgaggcccttaatgtctctaggccttagtattgtaaaatatgaagttgggatagtaatagttcatttttcctgggattgtagtgaggattaaataaaatagccatgtaacacatggtgaatgtttagtaaacattagctgaaaaggaaggatcctctgagaaagcgagtggtgagaacatttttatgggcatagccatgctcagggatagtgggtggacccactttcccagtcttgttagggaaagggctcattctagggagaatagactggatttgtggagggcccttaatgtaagaccaaagagtcctcttccagtccatttggagccattcgtgattttcacgtcgaaccatgtgagatggtttggctgtgtccccacccaaatctcatcttgaattgtaactcccacaattcctatgttttgtgggagggacctagtaggaggtaattgaatcatgggggcaggtctttctcatgctgttctctcagtagtgaataagtgtcacaagatccaatggttttaaaaagagcagtttccctgcacaaactttctctctttgccttctgccatccacgtaagatgtgacttgctcctccttgccttccaccatggttgtgagacctccccagccatgagaaactgtaagtccattaagcctcttttgtaaattgcccagtcttggttatgtctttattagcagcatgaaaacgaactaatacactatgacacatagaagaatttttaggaaaaatagtgtggtggtaggcattccacatagattggaaagtaaacaaattaaaagcaggaagaccttttaggctagaagtaatttattttccaggaagccatggatttgagttttttgaacttcgacttccatctagtctgccatcagccttcattcctttcattaagcccttagttgcagtgtgcctcagacctttgtctgtctgctgctcttcatcattgtgtgcatggtttgaggcttagcattgcaaaaaagagttaagaagtaatcaagattattttaataaggcatagtgacaaaaacaacataaatggcatttctctgaagtgagttttggtgatttctcattaaattgaattggcagaaactcagaaacaatactttctcatttcaagaaatagtaattgtttttaatgtagcgagccagagttctataaaagattgcagtgtcttgttcaacattctgttttctaaccccgtctagcataatgcttgtaagaaactaacttctcaggaaaggatggatggatggatggatggatggatgaattgaaggtatgcaaaggagttcagattcattggaccttatcccactgattgtgattgattatatatgattgtctaatatgttctcaccatcgccacgtttggctgtggacctcttggggcaaggtctgtgtctgtttttctcactgtattaccagttcctatctcgttaactagaatagtctttcattaagtgggtaagtgaatctacccctgaaataatgctaagcgtggggttctgggagagtatatcaccaataaaggattatgttctggccttgggccttaagccactcacttaagatctctgagccttgatttccttatctgaaaaaatgtgtatagtacctattttgccaatacataataggttaaaatataataataccttagagtaatactaattaaatctgctatatgtgcaaataatcaagagacttatttaatgaatgttgcgtataaaccttcataattatgagattgcaaggcataaccaccggtaaggaaataacctctttacccaaggaaaccataatgcacaaaacagtcgaccataggatcttattttgggggtattttattttctattcatgttaaagcaaataaaatagtcccttttggaatatatcaagttatacaactagaaatttctgatagtttggtggattttgcatgcctgcctcagttgttttctgttaaaataccaaagaaaaataaatttcaagagagtcaggacaatatcttgcttaacttgttgatgatgcttaacggcaacctgctattgtatttagcaaacaataatatttccatggtagataaagagaagatagactatttggagatgtagaaaatgaatattccagcaagaggatagataacttcaaactgacctgactgctgtcctaagcatgccaccacaaaaacagctaatagttatttaggacttaaatttatctgataattttgagaacaaaatcttttgagctaggttataatataggagccttcgattttcctacattaaatgtgtagcttagtggtatttgatgttgaaatggtaattttgctctattccttttgcttctggtagacttgctcttgaatttactacctgtatccaattaacggaaaatagagaacttgaaattcagagaactcattcttcccatcaaaatatgtactatacactggccttggttttgggtgaagatgagaaaatatggagcttaattttcatttttttcattaagattatgaaaaaatctgtgttttgcacatttatcagcaatggcattaccttgcaatttactatttcccatactcataggaacttattataaagaaaaatacctcaaaacattatcagacataccttttgagtgttacctgtttgagattcttatagtatccttagggaaagagctacgaatcaaaactggtaattggaaccattaataagatagagattctcataatttgaaaccagggtggtgtgtcagaaaaacgatacgtttggaagtcaaggagtctcattcctgttcctaatgttgtcagaggccagattttatcacattagacataggccagtttaagatttagaaaaagaaaaatccagataaaatatgatgcttggtgtatgacacagtaagtttttgaatctttgtggtcaaccagaagcaccagttctttttcatgacttcctaataaatcaggcgtctcttttcatgtagtcatgggttaggtttacatggtaagaaggaatttgttgggagacaatgctccatggatcgcttgtgtccatgtgtcatgaacagaggcacagtgacacccttttggttgtgacctgaaggatggttggttagtgaacagccttggaagaaagagataatgcctcccactaaatgatgatattctggctactatttttgtggggagtaataaaatatccttgtccctgacccaggagtttttgtttgtttgtttgtttttaatttctaccagcatctgtgaaatgatggcaggctaacttgttagcttgcaagtagggtaaaacctgagattcttcacagtttctggcagaattgagtttgaacatactgaatttaaagtaagggacagagatgaagttatatacctgatgcaatttgcagctgcatataaattctggcacgcaaacaggaggtcagaactaaagacataaaaatgtggctttatgatttcttgctaaataggctttgccctgtatcccatttgggacttggacgcctgaaaactgttctttcattgcaatgaaatgttggaaatctattgataatgcactttgattttgagagtgttaagacataaaaccagagaaaactggtatctctggccacacatactcagctactttacctgagttcattacattcttgttacctttgcatttatctagagtacagtctctttaaatggagaaaatagttaatgtctttctcctttagaaatcaagattctacagaatgagaaatgctaaggaagcaatatttttttttccacagggaaagggaaactggctattgttaaaccctgcctttggcaattgcatgtctctatcagtagccaatttggaaatattgaaaccctgtctttggtgtaatacaactggtgtagtaagcagaggtgataactgttacgtacttcaccttgaattttaggcattttaaaggtcattggggaagggaaaataatccattaatttttactagagtgttcatgtaagtgtcttctgctgtgaaaatcaatgtaaaatttcactgccattcaaaatgcaaagtggtgtataatatcactactccaaactgccctaaattgttgcatttttaaacaagcaggttttgagttatgcccttacctcgtaaattcagcttcacagattggattattgccatgtggatgtagtagcaggaaaaataaatttgtgtcagtctgaattctacttgtgcatttattaaactactcttaaccttttcttaggtcagtgatcatcatacagatttgcttttatatgccttagagaaaaattcctctatgagtattatttatgagttaagtgttacttatccatttacattagtaatcttaaattatttacctgctttggaattcatatgttacaaatttgccagatgaaagctgccagatgagtgaatatatttgtgctacatgtctgttgctcattaaagtagctggtttgggattcacagcaaaaataaaaagtgttacaaggggtagaaaagaggggagaagaggtcaggcagtttatagcaaagtctgctgtgctgcagctggcactagctggcgcctttgggcagtttctgctaaaccttgagcaattgctttcactcttccacctcccatgttgtttcattcattcaatcttagatggaattggttagagaggagaaatagaacactatttaaaacaagagaaatggtatatccccctctggcagagaacacaggtaagacattacctcttgtacttgatgggagaacatctttttttttctttctttcttttttgtttgtttgtttgggacaaagtctcactctgttgcccaggctggagtgcaatggcgtgatcttggctcactgcaacctctgccttctgggttcagcgattcttgtgcctcagcctcccaagtagctgggattacaggcatatgtcatcatgctcagctaattttttgtatttttagtagaaacggggtttcactatgttggttgggctgtacttagactcctggcctcgggtaaggtacatgcctcggcctcccaaagtgctgggactacaggcgtgagtcaccatgcccaacttatttatttttttctttttaatgagacagggcctcactatgttgcctagtctggtcttgaactcctgggctccaacagtcctcccacctgcctcctgagtagttgagattatagatgtgccaccatgcccaactgagaatattatcttgatctactaaataaatagattttatttccataatgacttatttagaattaaaagcgaagccctgagttatatatatattaaaaaaacttacatgcatttgctagtcaggccagtttaacttatgtgagagccaaaaatcttacataattattaacagtttaatgatgatagattattgattataattaaacctaggctgtcagactaatcaatggtaagtttagtcttaggccttgagttgctaggtcagatctggttttcccaggctgatatttcaaaagtcttacagtcttcttttgttgagaatccttcacttttccagttactccaaaggagacctcagtcagaccaaagtttgatggaggtcaagttaaaatttaaaccatatctggaagcaaggtcagtgcagcaaaggcacattctaaagcattacttcatataccttaattcttccggaaactcgtttgctgggtgttttcattcataagttcatttactcagcactcattcaacaaatattttttatttttttcaacagatatttattgagcatctactgtgtacattatattgttctaggctctggagttatattagtgacaaaacagaaaaaaattttgttcttttggaacttgcagggaaatacagatattaataatatcatatctattattttattaatgaatcataagatacagataatagatcatttggtgacaagcaccatgaaggtaaagtggactgaagggctcattaagaaagggatctctgaaggtgatatttgagcagaggccaaaagaaatatgggaacggttcatgcagttatttggagacagatgttctagcaagagggaacagcaagtacaaagtacctgaaagaagcatgtgcttggcatttggaggaactgtgaggggactggtaggattagaacacaatgagtgagaagtgaagggagatgaggtcagagaagtggtgtggaattggggatgaagggtgatcacatcataagccatagcaaagatgtttacattgaattaaaaagctattggaaggtttagcgaagtacaggaaaatgatgtgactttggttttaaagcggtcctgaacaatagcactttctgtgatgatggaagtagtctaaaatctgcagtgccctctaaccctttgtggttattgaacacttgaaatgttgccaatgcacctgaggaactgaatttttaaatttaatagaattttaatttaagcagtaacatatggctagcgtattggtcagaaaaattttatacattttcacaggttgctttatggagaatagtatgtggaagcaaagaggcaaaagcagggagaagccttaggaatgcagatcaaggcttagcaaaaattttttttcttataaagggctagctagtaactatattagggtttacatttcctttttcttgtttgtttgttttgagatcgagtttcactcttatcacccaggctggagtacaatggcgcgatctcagctcactgaaacctccgcctcctgggttcaagtgattctcctgcctcagcctcccgagtagctgggactacaagcccccaccaccacatccagctaatttttgtatttttagtagagacagagtttcatcatgttggccagactggtatcaaactgcagacctcaggttatccagccacctcagccgtccaaagtgctgggattacaggcgtgaaccactgtgtctggccagggttgacatttcatagggactctatgacaactactgaagtatactattgacagtatgtaaatgaactagcatggttgtgtttcaatgaaagtttattcattcattggtcagatttggcccataggttgttgtttaccaactcctggtgtgaatgagaggtgcgatgaccaggcttatttcaaaggtagacttgacaggatttattggtggattgcatgtgtggtgtaaaagacagaggaaattcaaacaaataacttaaaggtgtttggactccacatttgacaaaaaggagttgctattcactgtgatgggaaagacttggatagaagcagatttgggagaaactgttaaatttggcttgaagtttaagatgtctgtcagttatccaagggaagtttggaggtgaggactgagatctggactgcagctatatacacttgatagttataaaaaatggtattaaaaccatgggtaggaataagatctcctagagagagaatttgacaaagaagagaaaaaggtctgaggactaatccttggcatacttcagtatgtggtaaaacacatacggaaaactgagaaaagaagactgcagaagggtgaaagaaaccagaaagtgatgttttagcagccaagtacaagtgtgtcaagtaagacttcatcagtacttatcaaatgctgcctggtacgtaataggcacacgtatgtgtgctgagtcaatgaataactgggtacgtgctattctatactgacttctgttgagttctaatgtacaacacccccttaccccattcagaggcctttaatggctccccattgccaactccttgaccaggaatttgtattttaatatatgactgagttgaactgcaacacctcttcataggcctccaataggctctgcaattttgcatttctttatttactcattctatgcaaattccttcatgtgtgaaatgccattctgtccttctttgcctcttgaaatcttatccctctactaggagccctttcaaatgccctctcctaaatgagtacttccccttccctccacttctcttctaacctgtccttaaacccttgtcatggctctactgacatgcatcccactttccatttggttccagttgttcattttgttttgcacatgatattctaggatccctgtgagcaggtgcatgacaccatagtggaatgattgtgaacatggagaatggtataaacagacctgttttcaaatactagttttttatttacgaacctgtgactttcctaagtaacctaaactcctgaaggctccatttcttcacttgtaaatgaagacaaataaggcgtcatggaattagttgagatagttccattaaatttattcaaatattgcacttattgcctgtcagattcaagctaaattttttcaatttaaataatttatttttaatagattgtcaatctgtttttgttattgatctaagcactatacagtgattatatactttaagtaagtgaatgtcaagctagtgttaacagatagctattgccagcataagaatattccctgcctacccaaaaatatcggaaagaaataagaccagccacttataagagaaggtgccaatgcaatggctaatctttatgagaaagaagaaactttacagcacattttgagtaacttagtgcatgggctcagtgggccacctgctgggacaccaccttctaatggattccacaattaaggcattgctgggtcttgcctttgcacagccaaaaccagatgatgacgctgttgtcctcttcacagacacagccccctatttgcttgttggtgatggataggaccaaattaggctccttcttggttcctgaggctgcctttggggttagtatgttgtagggtccagtcccttcagtgcagccatcataacctccctctccaacccagtcacctgctcactatcactaggagcacaacctccagatgccgtggagcgcactgcggtcgcccactgggactgcgggcctgcgtagtcaatgctgcagctccggaaagtaacctcgaagtcgtcacacccacaacaagcagcagtacctccgggtaaataatttaataaacaagtgtgtgcaaggaaaagttataacaagattactcccatttttattcgtttttatatttttatagtgtttaccactttcccttgtgaacacatgcttattcttaaattatttacattgaaaggattaagcattaacttttatgttttaagttaattacagttgaatttctttcttttttatttttcattttacactccttgttaaaattcttttaaatcattgccgacttggcagtttattgccttgataacagcaaatgagtatctgattcttcctttaccccaaattgccacttttcttgttgatcagcagcatcactgagtgaaaaccagcaacagccgaagtcaatatttataactttatcattagaccttaaaatcttatgttagaaatttatggtagtgcatcaggtggagagagaaagttccatgggaagctaaacctctgcttaaaggctttgtgaaacttgactagtaagaagcatagttgctgtttcatgaaagtaactatttgctagggagccatcttgaaaggattatttctgtgacactatgtactggggaaatttttattgagactttgtattgatgttgtcacataatgtttactgtagacagttttttatttcagaactgtagataacattgagagttatagactgtctcaagcttttctgaccatatcgaatgaatcaaagagtgtctttccttgttagatttaagttggattttctgtccttcccttggaaaatggttgtatttgctggtaatttgtcttcatatttagtgtaaacttcccttacttcattgccatctagctatttgtaatttacagtatgtgccactataacatgatgtaaaattcatctattctgtaaacttcttttgggctcttaccccatttcattattagttggccaatagcattaacaagaaggacttctatgtacaagtcattatactgagaccttgaaggttttctagcccagacactccaacacatgatcttttctctagcatcccttcatcttgaattttgtccaccctaacatactgttagtaatacagaactctccaccttttgaggaaacccattccatctctcaatgaaattagctattagaaagccttcctttaatgcaaaacgcagtctcctcccaggaggattatttctgtgacagtatatactgggggaaatttccattgcacttctagcctttgggtttctatggaaatagtctaatctctcttccacaaaacagttcttcaaatatttgaatgacagatccatagttctattctgtagactctgttggttctcagataatgttggttattgatgaattttcttccattatatttccttagaattagtttcaagaagacctaaaaagaacaaatacaaaaatttagttgcgaactaaaaacttgaggcaagttgtgagaagaaatgtgggaatgattgacagctggcttggttaccttctattgagtaaatatataattatgccattttttaaaaatgttatttttttgagaagacagtaattgcactagtctattgtataattgttaaagcaatgctatttgcttatttgtctttaatcaatgggtttggactcacattgacctaatatacaaatcttgcaaactgctttttgagggcactggggaagggagaaacacataaaagatactgccaggtaaatatatatttaaccagaaagagtcagcactgtcagctcagttcactgcatattagggagcaatgaaaaggcctcattgtgcctcctgtgattgaaatgatattatctggcatgactggaagggagtgcttacttacagaataacttctttggtcttttcaaagatggtaagacttctcaagctttcttgttattttatttttagttagttatagatttttcttttagagtatttttcaaacttccttattttgatggtaactttttaaaaagtattgaaatagtcataatcagcttttatatttctccttttctaaatgcttccatgtattcaaaagatagattctctcctcactacagaaggctaagaaaacttccttttctaggtctacagtagtccagtctcttggtcaaaggtatacgatacattaaatctttatctggaaacctctcagaggaagataaagtaatcgacctttagaaattaaatgttatagcattcggataaataatcattggctattgttattacttttcttggatttaggtgaaggaaataaaagatgcaggcttttgaccaaattagagcatggctttaatttcctgttattccagcattgctactctttctaataaccacaaatcaaggatgacaaacaaacaaaaccgcacactagatcccaaaggcagctaaaacagcttcttagtgaccttctttctgacctacattgtacaaatgagatgattggaaacaggataataattgattgcaacaatatgacaatcttgttaaatgggcttaaaattacattctctacctggacagggaccttataggggagatcttagaggtaacaggatcctcatgtatggagcgttaggattaattgtttatgatggcactttactgaaatgttctaaattttcattatttctttctaacagattagtaagatggtattaatggtcctgccctatctgctgagcacagttcttaaaaaaacagctttctgatataacgaaagtcaacttggtgagctaccagctgttttagatttggcagatttcacattcgctttgggatgcctgtttggatatgtttataaagtcattaatcttctgtctctcctctcttcctgccttccttcctctattacttgctgaattctggacatacagcaaagtgtaagatgaatctctgtcctcatggagcttacaatccaaagcatattgaaagaagagttcaaaaataccaacattgaatatcaaactatttgaaattatgtgctatattggttttatttttcaattttgtatggattaacttgcaataacagataaacacaagtatggtgcactttggtaattttttggtgaatgctgtggaagacaggcctttagtaaggttaaatattctactttcctctattagatctcatttgacttcacaagattcacttgataatagttacaaagtaaatccagttcttcaaatggaagataggatttaggtattttttactttagattttacttaaaactatagattacatttaaataagcagcatatttcacagagattttcaaaaatattagatttcaccctaatttatgttttgcacaatatttcaatgaaaatttgatgtggttgttaatgttttattccttttgatcattgcaataaaataataaaatgtaacatcagatttactgttttaaccatttaagtgtatgattcagtgacattaaatacattcacattgttaaacaaccatgaacaccatctatctctaggatctcttcatctccccaaactgaaatgctacccgttaaccaataacttcttatttcccttttattgcttgctttcttttatgtgagacatgcataaatgaatatcccatatctttggcttttttttaagtaataggtactaactgaagactctccatttgttactgggatatgaaaaaaaaatagtaacttgtagaactactagacttctagaactactactgtgatcttgcaaaacagcagagaaaaaaataaagagataaataaaatagtaacatgtctagccaaataaaatactcactaatacagtggagtagcatggaatttggcatgagacctcagtttgaatcctgactctaccatttagcttaaatggttgcttctaggcaagttgctaacctctcttagttgcctcagctatagaatgggtataataaaagcttgttttttcagcctcatgttcatgttgtgaggaccagaaatttaattatatcaaagtattctgaaaattagaactcacatttcaaaaaaaaatttaaacaaatcagactatgggaatataaattagttcaaccattatggaagacagtgtgacgactcctcaaagacctagaacaagaaataccatttgacccagcaattccattatgagttatatacccaaaggaacgtaaatcattctgttataaagatgcatgcatacgtatgttcactgaagcactattcacaatagcaaagacatggaatcaaccctaatgcccatcagtgatagactggacaaagacaatgtggtacatatacaccatggaatactgtgcagtcataaaaaggaacaagatcctgtcctttgcagggacatggatagagctggaagccattatcctcagcaaactaacacaggaacagaaaaccaaacaccacattttcacttacaagtgggagttaatgagaacacatgaacccagagaaaggaacaacacacactggggcctgtcaggggtatggagggagggagagcatcaggataaatagctaagcatgcggggcttaatacctaggtgatgggttataggtgcagcaaactgatgggttgataggtgcagcaaaccaccatggcacacatttacctatgtaaccaacctgcacattctccacatgaatcccagaacttaaaattaaacagcaacagaaaaaaggctgaattttaaacagattcctgaactagtggttcacacccatcagctcattcaacttcagcacctgtcttgtctctagtagcttttccagaaccactaccttcaccatgaagccccatgccctttcccaattcaaacttgggcttagcatttttacttttctaaccaagacatcatggaaaggataaatagattagcaagctgttttaatatattttgcaatgctgtccgaagtcaatttactggccacttctttcaagtcatctgtcttgcagtttttgggtcatggtttttatcattatctcctggatttggcagacctgttggtgctgagcataagaagtcttttgtatctgattgttgtactttttagtaaaaccaacacagaacagatgaagcaaataaccatcagtagtcttgacatcaacatgaacttcagtaatggtctgccatttttttgaccatggaacatattttgtcactggtaggatccatgccatgaaagttaggcagtttttaccttgttcgtcttcagtaatcagcctgaattttctaaatgcaacttgactgcagatcagcaaggctcacttcaaacacgcaaacccttgaggccatctgatgcaattttggttccttgagtcctggtgactagtgtctttccaatacttcttatattgaatgtagctgctttcacatcacactagtcggtcttagaaaatgtatctaccggctgggcatggtggcttttgtctgtaatcccaacacttcgggaagccgaggcaggcagatcacaaggtcaggagatcaagaccatcctggccaacatggtgaaaccccgtctctactaaaaatacaaaattaactgggcatggtggtgcatgcctgtaatcccagctactcaggaggctgaggcaggagaatcgcttgaacccaggaggcagaggctgcagtgagccaggatcacgctgctgtactccagcctgggcgacagagagagactctgtctcaaagaaagaaaaaaataaagataaaaaaaggaaaatggatcaacaactttcttggcttcctttttgccactttttgtaaggcacttgttcttggcaactgccgtgctgctactgaaagagccaaaaggaaagaaagtgcctcaaatgttaatgtatatggcatttggcatatacagatatatggcataaatgttttcctcttattgcctttccttgccaattcttaactactagttttgtcattacacttgacacgtctaggtgtcactctttaattttcattctccctgaactttaatttttacaagtctatggtaactttctcttcagtgtttgtaactaccacatttctatagaaatcttagggtgatctattgagattcttcacccttcatttctaattcctcatgatactatgcaagtgacaaaaaggtggcttgtgacagagaaatatgatatttaaataaaatccttagaatcaaaaaagtgcctaagttaacaactttttaaaagggctattttaccaactccataattgacattctgtcactgctcagactttatttcattcctgctcaactcaatatatggatttttatacaaaccatttaccaaccactagacaatagcgcctctggcagatcaaatttgtacaggtaagttgtttgttatccacaggagagcttcattgtatccttgggacagcttccgttagcagcccagagtgagagttggtgacactcaaaaactcaaattattgatgagaacatcccaagtactaggaagaatttaaaattaaaccttttaagcctgtgcagtcattatcacattaagcagggagatggtgatgggtcataaattggttttccattttacttaaacaggacctggcagaatgtaaatggaacctttgaagttcacttatctcatgataattcttcactttttttttttttcgagatggttatgaggttgaaactttagatctctaattgtttctgttagattccatttattggaaaaattatatttcgaggatttttcccccggtttctgtatgccttccagaaacccagggacttcttgaaattctagttttcctgtacaggttgaatctccctgattttgaattagaaaattcaaaatctgaaatgctccaagtttgacactttttgagcactgacatgacattcaaaggaaatgctcatttggagtattttggatcttggatttctggattagatatgctgaactggtaagaatatgtgatacaaatattttaaaacctgaaaaaaatccaaaatccaaaacacttctgatcccaagcgttttggataagagatactcaacctgtatcggtttcatgcaactttttgaaatattagagatttaacaagtcatgactcacttcattgtctgtatatcgtaaatgttaaaggccaggcacggtggctcacgcctgtaatcccagcactttgggaggctgaggcgggtggatcatagggtcaggagtttgagacaagcctgtccaacatggtgaaaccccgtctctgctaaaaaaaaaaaaaaaaaaaaaatacaaaaattagccgggcatgatggtgtgtgcctgtaatcccagctactcgggaggctgaggcaggagaattgcttgaaccttggaggtggaggttgcagtgagccaagccactgcacaccagcctgggtgacagaggaagactctgtctcaaaaaaaaaaaaaaaaaaaaaaaaaaaaaaaaagttaaagtacggtttggtgtttgtctttctttagacttaatgtacatgttgaaacatcagtttaagcagtgctttttcttttttataaagcagctgggatctgacttttaatcttagcatattgtttataaacctctactagatgacttacaagtttatctgagtcatctccatgcacaccactcatcttcctgatcttttcttataaggaaatctgattagttgcattagaagattatgtacctgcctcagttaaatgggatcttagattctctatttttggagatatgatagtcctccactttttgccatttgagaccctctgaagagtcttcttctagcatgactctattctactcaaaaatctctttttatctttctcttctcttcttttttcactttttctgaggaacgagttgtcttctgctatatcaagcgaagctccccatttgtgtttttgattataaattctccaaattttctagaatcttgctccatgatcccccacctaacccaatccagccctctattaccataagatacttatttacttccccggcatggtggattatccctgtaatctcagcaccttgggaggccgaggcaggcagatcacttgaggttagttcgaaaccagcctgggcaacagggcgaaattccatctctacaaataataataatataaaaattagcctggtgtggtggtgcatgcctatagtctcagctacttgagaggctgaggtggaggattgctggagccagggtggcggagattgcagtgagcctgcatcgcacgactacactccagcctgggtgacagagggagaccctgtctcaaaaaaaaaaagatatttattttctctatgtccactgatttctttctttctacttacaagcatgctcattctctccttatcctaaagaaaccttccccttacctgagatcctctcaagatactcttctaccccaagtttatccaaacagtaggctgtgttccttttctctactttaaccacccactgactctactctttctcttttgaatattttttgcctcatcattctgtgtagaacagtgttttcagccctggttggaatataatcatctgggttgcttttagaaacttctaatcctttgtttccatcctgaaaaattctgatttaattggtcagtgataagtcttcccactgataacttaaaaaattaccccagaagactctaatatgctttgggttgaggaccattgctctaactcatcagtataatacctcctaaaggttacatcaacagatttccttcccaatatttacccttctaggtttattctttcaaagtaggagaaaacattccctatgcccataaatattcacggttgaaatagtgcaccatatttatcctcccacctttctgactgctcattgtctttgtcctcttttgactggtcttcccctttcctgttccaaaaatactacttctgccccaattattaacctgggtagttgttctaatctatgtagtctagagtaatgatcttatttccttgcttttccattatgtttgtgtaatatcaccctactctttccccaaacccagaatcctcaaaacaaactgccttctggacacctttttacatatatcattggcattcttgtccaaagaagaacctattgtcttgctgaaattgtttttgttttttctttctagctcctgtttcttcagccacctatgccataaacatcatatttaaattttatctttctttttgtcactaacagttattatctaaaacctatagattccgtcctatacactgcttcttaatttgctattcttttagtattcctctagtcattaatcatattctggctgcacatgtacaattataataacctagtagctggtctttactatgtaccacacactgctgtcatattttcaggcacagccccaatcttttcactgtcttttaatgtgttctatggctccttattgactgtaattgaatccaaacaattaggatgaaattctaggcacttggtaatagttctctgccagcattttcaatccatctccatcactcttctgcagagactctatgctgcagctaaactgggctgcttgctgttccctagcctttaaacttttttttttttggacatttcttttctagtataaatgttcttttttcttatgaagcttattaattttttttctgacccccttaggcaggaaaatttttgccttgttctaggctatatagatctacctcatgttattagacttccaaattcagtatagaactggtagcttaccgtttctagttgtttgtatctcatttaaccaggatgtgtttgtacattagaagatggcttgtggctgattgtgatgtatgtgacatcctgcgacctttgtgtagcagattgttttttccttcaaactatacatgacacagaagaggtttttcaggtttgttttgttttttaattaccatgtttttgtaggccagaggctatcttcacagcctccatgatttatggaatatgccattcagactttcagttaaatgacaaaataaattccctagaaagttggacccatatacttttagattcttttaactttgcccacttttttgtgcctcttgatttttctttcttttttttttttttttttttgagacggggtcttgctctgttgcttaggttggagtgcagtggtgcaatctcatttcactgcagcctctgcctcctgggttcaagcaattctgctgcctcagcctcccgagtagctgggattgtaggtgcaccccatcatgccaggctagtttttgtgtttttagtagagacaggatttcaccacgtgggtcagactggtctcggacccctgacctcaagtgatcctcctgcttcggcctcccaaagtgctgggattacaggcgtgagccaccagtgccgagccctgcttgattattaaatccaaattgtcctcctgctatcttaaaagaaatgaaatttctcagtagtagcaaacaatgtcaatctatttgagaccattaatgactcatttataatgtcaacagtcacatgaaggctagaaaaattaaatgtgtagcctcattacctttgtggttagcatttcttggaaatagcatggtgcttacttagtgcaacattgtaaaagacaagaagaattcctttggagaagagctttatagttgagaatgtggataatggaataacaaaatgataacttcttactctttgagctgcattctacgagacattctttgtgattagctatcagactctgcatgtatgaagaagctcagttgttccagtcattgtgacctgtttttcatagataattttgacatgtatttttggagttttgaaaacatcatttttagggaatatgatttaaaatatttttaaagtagtaattattagaaattatctaaactattagcttcttctaatttgaagataatgttacatctccaaggatactgcagaaaggagcttgggtaccatgtgaaccagcatgcctgtaagtttcctatcaactccaagttgtgttggtacttccgttctgttcaaatggttatcagcacctgaaatgaatatgctctagattagtcttcctttttatatatagaatacacttataaaatagatggattactttaacagtttgtagctgtgaagagagcgaaaccaacctgcacaatggagactgaaacataacttgagacccaaagtgtactcttagctataaaatgtaatataaatgtaaattatttgttgtggttcaagaccttatactcttacttctggtgccttttatgaattcccaccatggtataggactatactttttctaatagaacaacaaaagacattttatgaaaggatggcattgaagtttatcgtgacatctacctaccttacagaagcacatgtagaggggtttgtgtgtgtgtgtgtgtgtgtgtgtgtgtgtgtgtgtgtgtataaaaagagatttgtttcaggaacttgacctcgtttaattgtgggatctggctaaacagtctctgtaagatttttgtcttctcaactcatgctggagcttgaagttcacaaggcaggccatcagaagacagagggatcataaagtcagggagagcagtgacaagctggaactgctagaatgggctggaattcatgtcagttctccctgtctccagtcctaatgatgtggatgtcctgtaggagaagcatcatggagctagagaaacacttggcttacacatcagtgaagcagaagggggatccaggaaagttggagcagctgcctcatgaaaagttgctaagcagcaacattaaggctgcagctgctgagtgtctaaaacagactggctactgctttacttccacccttcactgctctagcaaaaatgtctcttttagcccaccctagccctaaacacacagggaagagaattctgggaaatgcagttcagcctggccaagttgcacattagaaagccaccaaagcaaataagccttctgcataacttctctaatatttcaaaagggtagtattctgcaaccagggctttttccaaccttctcataatacctggatgatgaaatttgaggcataaccagtgtatttccttgcatcattattgttactgtggggctgagagtcctatagcatggctcattgtttttaagggtaaaggattctaatgtagcaaaattaagagtaaagaaatgaagatattagaggaaatttctttgaaaatttcatcatcaatttatggcatccagttttgtaatatttcatattataatgtagtttgattcgatgagttaactttagcaagcagaaagatactacaagcatgataatagtaatacttgctaccctcatagaactatatgaaataaaattctactgagtgtaaaaaaataatgttagaacttgacaggaagacttgatatgcattagcttgtgcactggaagcaacaagtaagcatatgaccctttgaaaactgtaggaccataaaattcccaatttttcacacattttatatatgagtctgcatgaatgttagcatgtacattaatactaagacctgtcccttaaacttcaggttcttgatcttttattacctgctgggatggcagaattgcttcataaatgtagtccatcttcatttacatagtgacactgctcaggagagtctctgttaaaaaaattatctggaaacactccaacactgttgggcagtttcatagtttgctggttgtctttcattagatgtaatctaaccttctttcccacgatgacaatataaaatgcttcagaaacacacatctcagcaaattgcttttcctcatgacaattatttgtccttctaattaacactattcagaatgagatattttctgagaaacaaagtcccctttctcactcccccttataataataattgcatctacttgtatacagagagtttacatatgtcatttaatgtgatcctctaggaatgatggccccattagatagtaggcataggttctcatgggaatgatgaccctgttcgatgagtaggcagatattaacatcctcacattagaattcaggaaaggaagacactgagatttggaggtataatagctagagtggtttctgtctgttacagtgagaccctatttgccacttttagtcagtttcctgttacttgcagctcaattaacactggtggaaacagtcacatacagggtaaatactggagctagaacttaaatccagcccatctaacaataaattcaaagctctttcaattatcgcatgtgtagaaagttggtaagaactagagttcagtttctggaagatgactgtctacttttttatttcatctttctttactcttcactttgtctcctaaagtagctccccagcaggtatcttcatctctcttcccgttcttgcctctaaacacaggtctgttcttattcataccagcttgtctctccccaccaggcctgagctgacctgagcatgccagggcctctttctacccactgttccagccctgctgctctcctgctgattatttgaattatgtttcaagatatagcttaaatgtaacctaaaaaatatgaaacctcccattttctttctttagttaacataacacctcgctcctgtcataattattgttcctatcacatggtatcataattattagagtgtttctctccactaggcaaagacctttctagagagaaagcctaggtcgtatctggccctgtattctaccatctgggacatagttggcactcagaaaatgtttcctgaacttctgaaacattgagtgctctaattgaactatgtgcacagtacggtattacttttcagaattaggtcattcaaaatcctaaagatatttttcagctttcatttctgagccttaaatttaaggtacctgaactaacatttcactaaggcatgtttgaaacccatattatggatgagtatctatgactttatctgatgctttttatactgttgtatagattgtagtatgactttgtttctcagtaccttccagtgatttgtttgccatttgctgatctggattggtgatgtagttattccagagactagctgattacagtgccctcagggactgataaagttattttaatagaaatccatttgcccttttatgaaatgaatgcccccaaagtctatagaattgtcacgttgtagtgaatgtgctgttgttgttattataatacactttgtaggtactaaactacttctgcggctgcttctactgctcatcgcaccatctgtgttgaataccagtcattagccctctttttcagtctgatgattttttaaattcatttttcctttgaatccattggattccttctcctgtcactttccccatgcttcttggattagacaacactaacaccatttttagggctgttgctagctagcccttgagaaagtcccgtttttagagatttctggttacctttagcattgagaactgctcctgcttcatttatttcttcttagagttttgctttaaaagatacagtaaaacaatgcaacatgataccctggtttaccaaggtcttcttggctcctagagaaaggatttgcgacaactttactgaattatgtttgcttaaagtgaactacaccttgatagcaatttaagattctcaacatgtaagatgttattagtattccataaaacttggatttatgagaaaccaaaaagtttaaagtattttagaagtatttttaaagctagtttcatatcctgcagcaagaaaaccataaatttctctctgacaaaggaatcagaatctgttaaaagcatttgtcagtgatacattaatattcacgatagctcatgcaatattgcttagtttttggtttgtttttccccccaagttgagactttgaatacagcagcatttaaaagggaacacatgtagctcgaaaggatgtcaccttcattcctgggttgtgcatccccctggagttgttgacctggaagttctaatagaatatgtgttaaaaatacgggaaacatattattttaacatcaaaagaggaacaaagaaaaagattgtttttgcttttcccaactgccctctggtggcaaaggcacaacagacagcaaagacgtttaacaaagattcttgctgtgtaggtgctgctggtggttcttaagaggctcttaaaccaaagtctgtactgtacatgtgtgcttctgaaaaagaagaacagaatattgggtctcataattatattttacttcccagcggcatctgttcttatcatagtagcaccaggctctactagctcagtcaatacttgtatattaacaagagacaatcgatagaaaaattaaaaggaaaagtcaaggtaattaggctaaagctgctgcttatgggttttcaataattactttagcttcctcttgttttcccatctccagaaaaatagggcctgattgaaggccctgattgaagggcctgggtcgtgtttgactgaggacatgtcaaaattatacaaagccaagcaggaaataaaattaagctgtatttgttttagagcagtaaaaggggctttgcatgatggcatgggaagaatagatgttgatttaaatgtaccccttagcagctgtgccattgttggtacctgtttcatgtcatcagtttctgtactactggcagtagcccactcaaaagcactatgacatgtcatgtattaaattaaagctccagaggaagatagcgaatggatttctccccaaaacatcaggatatgtttggaaactagatgccatcctttatgaaaccatgaaattagtcaaaacccccccatggttgccattgtgggccatacttgggccattgttctttatggacataattgctagagatcactgtccatttagtgaggcttaatcaacaagccacacacattgtgtgaaggagtctaatctttggttttgagctacttgggtgttttcgtgccctgatgctgtgaaatcttctaaatacatcagagccaccctgcttctcactgctgcttagtaggttggtgtgtctgcctcctaggggaaggagaaaaccagaggatttcctagttttggagagagaactctgaggaggaaggataggctactgagagagagatttcattttttatgttcatttacagtcttcatttgcactatttctgtcagctcaaagtactttataaactttacaaccaaattatgtaccaacatcatttcattcattgctgatatatagctgttaaacatctgccaggtacacatttcctggaggcaaaaaaaaaaaatgtggaagagaattagatcttgttaaatgttcagagaaaatgtagatatggggcatattatatgaagatatttattgagcacctatgtacaaggcattatagaagacatcttaggtacaggaaatatagcaaactcttaactctgcccctcatcaccgctgcccccttgaacctcccctccttccctcctaagtttgttaatcaaaagtgagtaatagagccaggatttgaatccaggagagtctgatttaaaagcacaaacctttcattacgatttttacttgatgtttaaaagaaagcctctctaggggaagaagaaatgtacgaagctggtattaactcagtgaacccaaaatctaactgatgatagagttgttggtttgggagagtgagatagaagagtattgaattaaatgtacatgcccaaaggcattgaaaagttaagatgaggaagcacagatagtactagagctttgatgagaactgttgttaattatttttaatgccacaaatggctttatattattccaccactggttaagcttgcatgtgtgaatccctgctgtctgtaaaacctccagcaagtaaaacctttgctgattggtgacttggctctgtcatttttataagactgtaccgaggctcgcagaaaatgcttgattctatacaccctttagctaaggccaatgaattgcacatgcagccaaacctggacaaagctgatcgctacatttttgctgctttttgctcatgatcccaagcgtatagaaggttctagctgatgatttcatggtgaaactagtacataataagcatttgtgttttttacttaaaaaaaagttattccaaatgcataatcacttctggatcagcaatgtctagaaatttgccaaggagataatttttgaaagttcactttttctcccctttcttgatcctttttatttaatcattcccaggaaaggttctttctactgctctgccttttttcttttatttttgttgcttccattgtcactccatattttttgtctttaccgttttgattttcaccctatagaaagtttgtgtgccaaataccaaataagaatgatgggatattatgcaagcactaaggcagtagagtgtagttatgtaataagagcttacactcgagtacagctgcctggtttgaatctcaactgttcttttaattaattatataatctttagtaagttctttaaacttactgtctaattttatctataaaatgagaattatagaagtatctatcttctagcattgttatcaatattaaatgactaacatataggaagtattttgtacacagtgttctataaataaatgttaacctatttaataacaaaaacttattaaattatgtctgtaaggtatgtgtaatgatacagaaaatgttcatgagagaactttaagaaacaggatataaagtgacgtgatcacagctattaaaacaagcatttaaacatttttgaaaagactggaataaaataggacaaaatattaattatggtttattttagaactattgcctcctgttactctttttttttttttttttttcctgtttgggttacttatcacaatccacagttatagtattggtctatttagttggttttgatggtctctccttctagcatgtatgttttaaatgagaaaggactcaagtcaatctttttctaccattatatattgtgtctaatgccaagtgtctggcacaagacttctcttcaataagtacgtgttaagtgaatatgtttacctcttacttttctgtgtttttcagtcatattaacagaaaatccctgttacaacattttttaaaaaggctatttttaaaacattagctcagctttgttaaaggcttaaaataggtaaccttaaaagtattaccctatagttcatggtaaagtatcaaagaagaagaaaaaatttctcatattacatgttcacttgttttgttttgtttttagaagtggccattccaactcacagcctttatttattttaactttttgatgtttttcttgttagcttttaatcagtctgagaaaatcctaggtatatttaattttcccctattctgttttacacaaactaaagctcttcctttttgattaggatagttagtttcaagtgacataaagaactttcgttactttgctagttaaatgttaccttaaagccttattgtaggtgaggaaatatccctttttttaattccaaaaattgtagcatgattaatgaactcacagattcctttagtggtttactctgtgttaattatcccagtgccagagtttctacctagtatgctttgactcactgggccacagtgcatttctgcctaaggctgggttacatgtaacttacctgcagatatgccagtgagaggaatacgtgtttctttgccagagactttgctttccagtaaaacttggccttggcattcgttgttgaggttcataaggttttctgttagctctgtaattcagtgctcatttttaaagatgaaacttcagtgaaataggattgtaacgatacacacaggttcatacagagaaaattcaaacagaatgcagaaaccttctcatctgttactaaaaaatttcaaagccagagatgcagcccatctttctcgtgattcctcattcaactgccagactgacagcaggaaattctaccatgatccttatgagtcagggcagcgttttctcttttctaaagagggtctcactgaaggactttagagaaagcaaaaacaggagatgagagaaagagagaaggaaataacttgaggaaagtcagaggttcagactggtgtttattgactgggtaatactagtagtacaactacacctggggaatgttaggaattaggtccagacaaaaggtatgttgtttgaagcagcacttagaaaaacatccacttctctgaatctttggttgaagtgacgtaattagatgtgcataatgaatcttccagtagcattttgttactctgaaggtctgagacttttctgagcccttaactccaagttggtagtatcttcagttttctgaaataccatgctattattgctctatattaagatctgttgtttaatataatattggaaagtattgcagcgaacacacctaaaagtaattactattgaaagtaatgtagtccagaataaagacaactgtacgctgagtagaaggaataaatggtacaggttgaatttttcttatggcagtggtagtactgttggggatggtggtcactatcactgttattttatttttcttacagggaataaacttggcatgtttaacttgtggttagaacgccaagaagactaatattatagtatatagtaacatttatttaaaatcacactagaaatagtcatagaaattgatatgctgtatcaaatgaaataatttgtgaattgattttgaaatgcgtgtacattgaagtgtatgttggtaaaatgatgatggtgatgtacctttctgaccttggtgtattcatttacccttgtcaaaaaataaaggtgatttgagctgttttgctcctcagaggatccaactgaccatataacctgacttcctagccactctgttgctccccgctccttcatccccacgccaacataactgctcctattctgagacagtgttttaaatctgtattattcagcaagaaaaacacaacagtcagggagaatatcaattattttcttgcctatccgtaccatcacataattgcaacatctacatcctgatcgaagatttggtctttcagattcagaatgtctcattagctttttgctccctgtctcatactgaaaaaggagaatctaaacagtcacaaagactagcagaccagtagattttctcttcccgggggcatatacctaaatctttgtgctagaccagccctatttgcagatctaagagctgctggtgtattatgaccagagacactgcaaagcctgtattgcccccagatttttgttttcactgatcaattattgacctgtcatctttctacctggcctaagatttctaccatgatagttaatactttggcttagacaatgaacctgaggattttttttcaagaatgatacagttttgaagaaagaccttagatcttagaactctacagtgacccttcttcactaacacactgtatcagtaatctaggagagtatgagctaggcaggtttcaacatggggaaagtgaagcctatcaatcaatgagccccagggatgagaggaaccacatgaaggcccagattgcctaggcattgcagagttgcactggggtccccaaaattactcccaggtttggagattcactagaaggacttatggaaccttagcatgtaattttatttatggctatgatttattacagtgaggtagtaaggttactcaactggataacaaggggaaaaagcacaggtgttgaggtctagagaaatccatgtacaggcttcctgtgctctctcccttccctgagagggtcatatagagcacagtcttccccaacagacaaaaatgcagcatttgcgagagattcagtgcctaagataagggacttgtcacctggtcacgtcagcaactctctcactagcataaaccaaaatttcagacttccagaaggaaatcaggtatttggcataaaccatgttatttgcacagtctagcataggaaactacccttatcagtcagggaaaggtaagctcacttccaaaaccctagttcccaaatgctactccaaggccaaccttgcagacaggcccttcttaagatagcagcctcagactgcacaaagataagtacttggcttcaaggatttcagtggataggcaacatgtaaaaataggctcaggagcctggacagttgctgcctgttttcatacatgagagataaatacttttgtgcttgcattcgtacatataactcactattagtaatctaagggaacttcattacttggaaattaaattcaggagatttaggtgccctgctcttttgtttgagaatcactgccctctgtgataggcttttcactggagcctgaagggatgatggaaaggagagatattcccccagatggcctactttacaattttatccatatctctgggtcctgatggatggtggcccatatttaaaagctttccgcataatcagaatgaagaactctaaaaatgtgacttaattgttttgagtctttttttttgagccagagtctcactctgtctctcattgtggagtgcagcagcatgatctcggctcattgcaacctctacctcccaggttcaagtgattctcatatctcagcctccggagtagctgagactacaggggcgcaccaccacactcagataattttttgtatttttaatagagatggggtttcgccatgttggccaggctggtcttcaactcctgacctcaggtgatccacccactttggcctcctaaagtgctgggattacaggcatgagccaccaggcctggcctgttttgagcttgttcaatctatgtcataagtaaacctaatcttgttaaacttcaaaggaataatattgtgtctaaaatttcaattcaagcactgagcatgatatgaactagtatcttaacatcaaaccaatggtcaattatttttctaagctaaattgcttctccttttacagtaccttgaggttcagtagaagacgaaccctaacacttgtttaagatattctgctctcccttattgggcttcctaaaggtggttggcagttttttttttttttttttttttttttttttaaccagtggattttggtgccatgaactctaagcagataagccactgagaccaaaatgggattgctttaaatttagcagaagtgaaggaatggtacaaggcctaatgtgtttttcttgggtcataagcagagaagggaggttgtatattagaattatctgaggactcagattacatgggcttctgtttctccactacatccacttcccattgtctcctttccctgaagactctggattctgtgtgtccttaacagtgagccattgtcatgatcatggatggaaatgtgcttgatatttcaagcatatttagatctcgatgtgtttaaggatcattgacctgaaacacttttcagggtatccattgaactccatttccttaataggtcttacactcttttggttttatatggtgttccctaatcggagattcagagcaccattggtagctcactttcttctgtaatgaatatatatgtaaagcagaatgcctgtggtgcttcatgctgtgaggaatccagctttaaaactatggtgtaggtagtgtgctgctagagaacgtgagtaactgttgtgtgaggggattatggacttgtttttaaccttttttttttttgaaatagggcctcattctgtctcccaggctggagcacagtggcacagtcatggctcactgcaacccaaatctcctggttcaagtgaccctcccacctcagcctcccaagtagctgggaccataggctcacaccaccatgcccaaataatacagtttattttctgtagataggggatctccctatgttgcccaagctggtctcaaactcttgggctcaagctgtcttcttaccttgtcctcccaaagtgttggggcttacaggtatgagccactgtgcccagccttgaacttttttgatgggaaaacttacaaagacccatttttggagaagataaagtttcctgaaatacaagaatcacaccacttggacagacgttgtttgtatttcacgcccacacaagtgtgttagtgtggagaaggaccattttggaagaaagtactttttcctctgaactggtttcctgaatccttttgagtttcatgttttatggaagaccatcaaaatatttggaaggccagcttatttcatggtcacaaaggcagctttaattgcttgcataaagttggagcttgtctttctccttttccaacaaagtgacatttattagcaattctctggtagttatttgtaattgcactagtattcaccattcccaaatgttacaattaaatcatttgagagtctagtcacatttctaagcagatgtaccaaattacagctcaagacttctgcttgaaatctacaaatccaattagtaaaattttggggctgggaagggttagccagggaaagacctgagaaaacacatagcccaaaatagtttgaaatttccttgctgctttgcctccacccaaagttgatttgtcagcatgtaagggggtgttacatcttttcagaaactgcttggttttcttttcattcaagtttaattggttttcatggactgaattgaagcaggaaggcataagttaggtagatgatgtaagtgagcaaatctccatgtatagcagcatcttgatttgggtgtttgttctttgttgttcttttatttctgtcaaaaccacagcttcatatatagctctttttgtcacatgagtttttacgttgtcttaaaactgtgaaacagttacatctagttttcctttttatcttgattcaagagcccttgaaactatccttttacatactattttttttcacttggaacggctactctattatattctctgaattttctaatttattttcttcaagaccagcattagccaggtgttgtgacccatacttataatttcagaactttgggaggccaaggtgggagaatcgctagaggccaggagtttgagaccagcctgcacaacatagtgagactatctctctaccaaataaataaataaataaataaataaataaattatctgggcactgtggtatgcctatagtcctagctacttgggagaaaaaggcaggaggatctcaggagcccaggagtttgcaggtacagtgagctatgatcgtgccactgcactccagcctggacaacagagtgagaccctttctcttaaacaaacaaacaaaaagaccattatctaaaatttcttcctctagtaagtattccttttctggaggactcatttatgtttctcagcacttaagaatttaattttacttgttttaaaaggcggactctgtgatgaagaggaaaaagcgaaaaaagcatgggtgcagagtcctaagtttttggacttgcaactgcctttgctgctttctgtctctgtgaatttggtcagatcagttaatttcccagtccacaatattctcatcataaaatgggactaatggtacccacctttctgggatgatgttttctcgtttgcttatttgttctttcattgattcaggatatgcattgagcatttaccctgtgtgaagccctgtgccaacaccagaatgtcaggaaggacatagtctatgctctcataaaacccaccatctattagggaaaatgaacattaaaaaagtggttataagtgtgatcactgtttaaaaacaaaaaacaaaaaagagtgagtacaggatgccatgggagcattaaacagaagcagcaagtagaaaccatcagtctttcttttttgatggggtatggagagaaggcacaagtaacttgactcaacgtgtaaatgttaacttaatgaatgtcttcacgaaggatgaggaaaaataggccttgttttgctgcccttagcaaagcttgcaggtgtttcaccagtctcagtttcccagttcttctcaacctttgaccgctccactggctctgtcagacatcatcccacacagatgcccacctctgatgccatgttttgctaatgccatcctgcttaggcaaagctggttcatttgtcttcctttctctgttatttgatcacttccacttctgcaacaccattctttttatccttatcctgaggaatattcttgatatttttcttcgtcatattgaccaactcttttaaagatcaaagaactcaatcttttaaaaatgtgctttatgtgtaaattatgttctgtgccttttcagcttaaatgtataaatatagaaaacttgatccattaggaataggaatgggaagaagctgaggtaactgttctttccaaagaccaactttgtagtcctcattgtaactgtttattttctgaatctgctaccttactgtggtctcagtgaggcaggatgagaatttattcacctttgtgttactagcattgacatccaaggatgacagacacttgataaaatgttgtctaagtaagggactatattaacaaacatttagggctgagcttagatgatatctaaacaacaacccaaaactctagaaatcagctatgtaaatatctaataggcactgcaagatataattactactacagagatatactgaagacattaaatcgccctaccaggggaggtgcagaagagctcgatgaatgttatactatttatgttaaaggctgacaagaatttctccaggtgaacaaggaaggaagcacattcctgcctgaggagtcaacctgcagaaagcatagaattggaaagaatctcacatttttgcacagctacaagtttctcactgtacctagcatgctgagtgtatttagtggcgtgaacttgaggctggaagggtggggcgaggctggagcctaacggcctgttttacagaggactcagaactttagactttatgggttgtggaatgttgaaggagtgtaagtcaaaatgatttgatcagatttgaacttttagcaggtggaaaaaagggaagagaaggtgattataattcttctaatgtgccaaaaattcacattctttatatatactaactcatttaatcttcacatctttgatgcccacaataatgtgtcagtcacgtagaggatgttttgaatgggggcaaaaccaaaggcaacgaaagtagtttattataataccctggttgagaaatgatgggtccttgaaatcagattgtttcagtaaggctgagatgaggggttttgtcacaagaattgacaggtcttagcctgttggaggtaaaggggagggagaaggccacggtgatcccccaattctgccctgggcagctggcgatggcagtgcctttctctgagctagagactgagagcagaagcagctttctggagaaagatgttaagtttaggttcgaatttgtggcatttgaggtcccaaacaaaaactgagaaggaatacgcttgttagttaggaatgcctctcaagagctcaaagggctatcagtaaaaggtttatggaagggagttgttggtacttgggtgctagctggaaccatgtcagtagtggaactatggaggttgttaaataagaagagaactgggtgacactttagggaacataaccatttaaggaatggtcagaggatggggactaaagggaagattctactactatatactgttaacatttttactgtgataaaatcattagccatcataaatgtacagtattgattgattatatgagatgctctgatgtactatgagctatgcatatgtactgttttaaagtccaacttgattttactttaatgctaacaaataagacaaacatcacatatttagttaataataattttctttctgtcttagaatttagaagggctaagaagtattacttctaagatgtggtctaaagctcttcaaagggactaaattgatgctttctttttctctacatatttgcccttgctctttatgaggagggattgtttgcattttcccacagatctgtaaacatagttttatagttgctggtcagtgaatgcgtattgatgatgttcttttccctacttaaaacaaaaatcttgccagaaatgttgaccctacattttttccaacatacctttctctatcaacttagtctatttaaaatataatgaaaagctgagaaacaggctaaagaccaacagaaaataagtgctaacaaatccttcatttaccagttttatttctgcaagacttacttgaagttatataaattcttcacactatgaaacagttagtaaaccatttgtttatatatgtgtgtgtgtgtatatatatataatatatataatatatatattatatatatattatatatattatatatattatatacatattatatatattatatatatattatatatatataatatatatatacacatctcttttttttttttggcggggggacagagtctcaccctgtcaccaggctggagtgcagtggcgccatctcagcccactgcaacctccgcctcctgggttcaagcgattctcctgcctcagcctcccaagtagttgggactacaggtgcacgccagcacgctcagttaatttttgtatttttagtacagatggggtttcaccatgttggccaggatgttctcgatatcctgacctcgtgatccacccgcctcagcatcccaaagtgctgggattacaggcatgagccacttcgcctggcatcgtttataatttttaaaaggtctgtagaataataacagtaacacctaattccatctgctgaatgcctagcacactaggttctgtgcgcataggtatagtacatgtctcctctcatccacagaactatgtgctcaaccaccctgagcctcttaaaccatttccaagatattcctgtttttaatttcttcgtgtctagtgtcaaggtgtaatctttgatctaaatagcttgcttttccttctctctgttaacctcttcatcctccatgacttagcttatattaccagagtctgcatggtggctgtattctcagtaagatcattgggaaaatagtctgatactaatgaaatatttgaatgaagaaaaaacatcatgttctatcccaacataacttcttttagttccataccctccagctcttttcctcatgcatgtgtattcttataaaaccacttgtactattttgtattctgcttttctcttacacagcatattttttcatatttccatataattttcataattatcattttcatcataaaagcaatgttaacccattacagaaaataaatcaaccataattactatcttgatgacacttaactgctttttttcccctaagtactcatgttacaatttaaggtaaagggtgggggtatttagctgaggaagcctagactgtcacttttaattttgataatgttactttttcacaagagttccttcagattcacttaccctctctgatctttcattatctcacctgtagaaaagtgttgagcttgatcatctgtaagattatctcaaaagtcctgttaagctgtaactagtctgtgactctatgatactctgaatgttataatcctctctaatgttggtaattcttcacctttttgtgtcatataccccactgagaatgcggtgaaagttttgaatcctcctccatttaaaattgccactctgcacaaacacatataatgtttcatgcaataccatctggggatcaagaatcttttgccctaagcacaggaaagaaaaatttatggaaatgacatagaattcagaaagtattccccacctaacaggtgggagactttatgtggcttattttactctaatattatgcaaccaagaaagtagaaaattggaagatattctgaaaagcatgtataaaacacattgcaaggttacataaaatagtgacaaaaatgagttcaatatatctggatctgatctgattatttagtttaggagaatcgctgttgtcaaagatggtgactctggaaatgctaaactcaggcttctagaatgagaaggggaaaatgggcaaggtcacgatggtctagctgctttttaaaaatatgtattaagggattgaatatgtttcctagcttcactgtatattattagaaaatctatctgtgaaattggttgttcgagatttcgttttctgtgcgtaagtggctgttcagatgcttacatgctgtcttaataccgaagatgccatccttttttccagggccctcttcttacatgggaagatagtggatcctactttaaaatgcgattatagtggggaaataatataatgttgaatgtgagccattgaacacaaattgcattttatggctatagttaaatggctcaggattgttctgctgagttaagggaggtgggaggaagtagttttaggaaaaaaatatgaagcatcttacttttaaaaaaatgcagattgtgtttgctttgtgattttgatgtttaaaggagtgtcatgagtatgcttcagctttggaagtgtccaggttgagatgagagagaggaatgttagacagcccttttcctgagggattctgaagtcaaaactacttggtggattcttctgagagaggcctatgccgtggaatcccaagttggattaaattatggtgaaaaaaggacaataatcccacagtgggatatcttccattgtccgtgcaaaacccttctatattaacattcttgcaatactgcaggactggataaagacaaggtattcgtatatctggattcacctaaatatgtgtttgttcagtgaccccattggctcctcgtcagccctgagtgctattcatatgacaaatactgtgtgggtgcttctgtgtttataaactcatttaatccccttaacacgcctatgagatagttaccttactattattatccctcatttttaaacagataaggagactatcttaaaatttttaacacaatttgcttaagttgacacaagtaaatgggaaaacagagctttgaactcaggatgtcgagctgcagaacctgctttcttatccagaggggttgaagaaggatcacattaatggttgcttttattttttgttcagttgggggaattttgaattgctagactatttaggaaaacatctttattgggattattagtaagtgtgatccaggcagaaagtcatgaagctaatatgaaataatgaaatcagtgcatagtttatttattttatttttgtttttgagatggagtctcgctctgttgcccaggctggagtgcagtggcgtgtctcggctcactgcaacatctgcctcccgagttcaagcgattctcctgcctcagcttcctgagtagttagaggcacgtgccaccatgcccggctaatttttgtatttttaatagagatggggtttcaccatgttggccagagtggtgtcgaattccagaccgcaagtgattctcccacctctgcttcccaaagtgctgggattacaggcatgagccaccgtgcccggcccatagtttattccttgaattgaatggttacttattgaatgcttatgatatcccaggccctagggacagaaagatgattaaaggctaggtctcaatccctgaggagctctctgtctgggagaagcagatatacaaatcaacaggtacacagagtcacatatacagatgccatgagggcactggggatgaacacgtgttctttgtttcacttatatttcgagaatgcatatatatttttgataagtaaaatagacacatgctatatagttatacactgaaagtgtgtatgtgtacatcatagtttcattaatttttcttgccagacaaccagatgattctttattaatctttgaagtttaataaccttactaagatatagctcttccccctgccccccagagatacagcatgcctttttagtctgtagactacagaggacaaagatcatgttattcataaggggaaatcaagaattcaagtgctttggcagtttcaagtgcttaaggaaaaaaatgctgaaattttgaggtgtctctagagggtaaagaggaataaggagagggaccactatcatgtggacagagtagacagttttaaatgtgatgaatttttttggatttagggattgctccccatgccaaaaaacccctacgggcacacctcctagcccagctaatttaaaacaaacaaacaaaccaacaaaagaattttttttttttttttttgttagagatggtatctcactttgttgcccagactggtcttgaactactggcttcaagcagtcctcctgcttttatctcccgaagttttgggattacaaggatgagccactgcacctgtccagaatcctttttctcatggaatattaaactaagatattatttctctgagcagtcatcttttaaaactcaagtggatctgggagaggctactaaatgatgatgagatgatgatggtaacattatgatgttttaaaatagtacatagctgcactgtgtctcaggcacagatctacagtggctttccaagtacaagtattatctcacttaaaaacagctgtcctatgagtgtcctcattttgcagatgaagagattttggcttaatagatttacataactttttcatggttacatgactagtaaatggcagagccaggattcaaaccctgatagtatgactcttacccccactgcatataaagttgtcattagatacttgccacctggaatcatgaattgactcctttcctgtatcctctatgacagcaaactgagagaaggtccctgcttagttggaattctgatggaggttgagggaaaagaagaaggagaaaggttatcagtccttggatgttgggggcgtgggggtggtcagagtttaggaaggagtacagtagaagaaaagtaagatgggaaggcattggcctactcacctgctttccagtttgggctagaagcagtctcaggtatgagaaaagaacatgaaagggctacagaaaagaactgagaaggaacagtgtgcaggtgagaattcagttttgactctccacgtcagcacgagtttggccaatgatgaaatggcgtaatgagtgaaaatcccttactggcaaaatcaccagaaagtaaattctgtttttaggggtgctgttgtgctgcttagttccgtgtaatcaggctactctcttgggacagccattgtaaacactgccttcctgataaggatatagcaagttgtatagagtcaaagccaatttgtttaacagagccattcagaagaccctgtccattttttgttcttttaatgaagaaagtaacgttttgaatgtagtgtttatgtatagtgactatattggaatataatgtgtaatgctttcaataaacccagaaacttttccaaaatattgtcttggttcataggatgtgatatggaaggatagacaccgtcttaatattttcccccaacagaatgtcaattcttagagtaggggtggggcaggaaagtgggctataaaatcactggctataaaatcaacttttcccctttgaatctcagaattcagtgtcttctagggcagatctctactcatcatctctacctgatatgaccgcacacgtgagtgcctggcacctgctctttctcttgctctgatgaccacttcctttctgcccatctgttttgacctcgcaccattctggagcttttaggaaaggcatttgtaacaaaggcaggacccaggtctcctggttttcatctccgtattgttttcactatattataaaaccttctttacttaaaaaaaaaaaaaagtttaaatgtagcctagcatgcttaatgtcctatcaggttgatttaaaaggggccttttatctggacaacagaaagttctgtgtaacaaaagtatttccaaggcttaggaaatgctcttatttcaagcaatatttgatacaacaacattctaagcaaataaacagatacatatcaccttttgtatttctgtttatcattatttgacccataacacccagttttacagcttgatggcaaaaaaacaagatggcaaattcacaaccctgcagcaaaattatcatgtgttcagcctattgatgataagtgagagggcaaacaaaccgataaattaagaatttagtattaacaataaatctactggggcttcagccttccctaattaagaagtcttagagggagattagcattctctgttgatgtttacctttgaaattttgaacaaagcattgtaagcagaagatgccctaaggagcatttttggaaaaatcccaacaagtgcatagagcgacacagatgagatgattcaattagcttggataacactatttcttctaaagtatctgaaacagactcatgaaactcataaaaagccttgtattttctaccatatgtgagagtttaagggtgcttaagagcctgctttgaaaggtttgctgaatctctcggtaaaaattattgccggattatatggaaaagagtcaatctatagtattctccaattgtcagtgtcatcatggaatttagaactggaaagagactttagaactcttcatatctgactctttacaaaacagtgaactgatgcgttggctgttgactcagtgaagttcccacggctggctttggcaacagacctagggctagactatgttgcctggaagataaagaagcattcactgctcttcccatcccactgtattgcctggctagtgtttgatcagcttttcaatgtgcggtcaagttgttgattgagctagtaacttataagtgaattatctttatgattgtgttcatttctaaccatgtccctgtgcagtttacgaacaatactaatcataagcaaatactttcacctgggcccaatgatttttacctgtactgaccaagtgaacaacttaggctggcttatgccagtgaagtggtgcttctccctcctgacatgagacttcactgaagtgacttgccaagaagaaatgagaagatggcacgtggagagtcatgtggatgctcttctctgcctcaagctcagctctcacgtgcttgatctgttctgtctgtgtcctttaatataaatgtttaaatgtttaaatgtcattgggtacttggttataggaggaggcagagctctgagtggaatccatgatggtcctgagaccagagatatgtatttttttcttttcatgtatgtatgtcttatatccccaattgagaattctatcactgtgagtgatacagcttcagaatcctgaaggctaagctattaggtttgaacaatatgaaattgctggtttgcaactatattatatctacaaaagggcaagttcatatagcttaacctaaaaagtaaaaatcaaatgacatcaggtatgtgcaaaaatgtcataaatggctggtgaatatataagaagttcaacattactaagagccaaaaattgaaaattaaaataagaaaccttttttttacttcatcaaatagtaaaccaacaattagtcctatactttcctggtttgagcattgattaatacaaccagtaagtatgcaaatatttaaactcagtgtttttcactgatagatatttatatcaaggtgctagattgatatgcatataaatatttttgcacaaatatgttcacaatttgtttataacagcagaaaatggaaaacaaactaaatagcaatagggaacgtaagttaatcatgctgtatccatattacgtagtgttatataattaaaattacataatttattaaaatgatatttaccaagtgtttttaatgacactggaaaacatgtagaatataagaagtgaataatttccgaatagtatgtacaatatgataattgtgtaaaaagctgtaaacatagaaaagaacaagaaaatacaccaagacattgataatgttttgacttttaagaaatattttttctttgctgttttaattttgttatgcaattaacatctatttttatatcatgtatatattaataattacatatttacaagtgttgtataccgatttataaagtcaatatgctccctggccaaaaggttagcatgttcacatgaaaacatgcacataatgcgtttctaacaagttcccaaatagtgttgatgctataagtctggggaccacactttgagaattactaatgtagagaatcaccatatggggatatatatcccagtgagtaaaacaagttcctggtgtcaacatgtatccattgctactcccccctgccacagcctctgcttccagggtcagaaactcttaccaatggtcgttggatttctttaaaacagggctgagtaccaagtataaatgctgtctcgaagtcaccaggctgtaacaaattaaaattcctgtctgtatccctttcacctagcacagtccatgacttaggaaaaaaatgttcagttgtgttggttggtttatggaatggattaagtggtaaagagtacagttttgaaatcataaaaaatgaattggaatcttggctccataaacttaccctgatgtgatgttggccagattatgtaacctcttgctccccgagtttgctcatctgtaaaataacttcatgaggttgttggaagaagtaaatgagttaatacacaagtttttgaatagcacttagtaaatgttagcagctgttgttactgtcatataggattgcttgcatttttaatctttttcaaaaaagaagagttatttgaacacctagccaaaaaggaaaaaaaaaaaagattgcaacagcaaacactttcaagagggggaaattatagtttttgttttgttttgtttttgtttttttaatttactagggaaacttgcggaaaggactacaaagaaaatagaattctctgaaagtaatatggcaggttttactggacatttctgcttttagtggctctaacagtcccaggatttaccaactaggagacctctcaaaagcatatgaaagtgtcttagtcttgttttgatttttgtagccataaaaaataaaccacaaagaagcatgaaagttttctctttggcctcagtagaattctttaaccttgtgactttgtccttgtctctttgtgaatggtgacaatactcactcccttataggttagttgtgaagatgaggtgaggaattagcaaggtgccaggcacacagctgattcagtttcaatgttaattcattttatttttcctccccactttgccttctgctcatcctgcagcccacattcccgtcattttcaaacgtacagaagtgaaaactgtgttgtcactaggattggcaaactttttcaagaagtgctgtaaaagttcacagtctaataatttttctgatactcccaccattaaaaaaacctatgctctaagagttaatccaaatcgtcaaaatatgaagtcctcctttctcttccaggacgagaaggcttcatgaatattttatgatggcgtctctgttgagggatgaatccattcccctcctaggagagttccagcatgctgtgggctgccaggacttagcccaggagtgtggtgttttactgaggcaaaggtgacactggaaattgtttggtttgaggcgttcagttcaaaaactttctaatcccagaagagtgaattaatttcctgtgaggattaggaaacaaactttatatctcatatatgcacagttgccatttaattttctttttaggtaatatttgaaatactgagaaagtttgtagttttaagtatattgggtaacatttctagataagttgttttgccatcagctaacccagctgggaggtgcttaagattgatcaagcttttgctcatctggagaatgatgatgtctgttatacatatgtacagatctttgttctctttgacatctggaaggtggtgggaaggagcaaattcaaaatacaaagactggttttaagccccagttgtgccacttattagttaggtgatcccaaacaagttacttaacctctgcaatctcaattaccacatcattaaatacagatatgaatcgctaggtaactacagttgtgaccatcagctaagttaaaatgtgagaaaatttctacaaccaatgaagtcctacatagaggtagataggacctctagtcctctatagaggtaggctgttgctgctatctttatgttatactgtttatgaaaataagttttcttttctgtaaagtaagcatacctttattccttagggagggtttacactttcattgaactggatattgcatctaatgaggattgctgtttttttctccttgatttcaggatttaacatttaaatgaaagtgatccctgcctgcctttggattgaatttatcactggtttagaataacatgtatgacacaaaatttaaaaagctgaatagctgattctttttgaatgcagagtagatcatattttcaaatggcttgttctcatttaaaaaacccaaggcgaatagaatacctataaggatggtaggcttgggaattgaaagctctatgtgtgtctccagatgtgccctgttaacatggacaaatcgtttatttcttgatcactaaaaccatcatagtttttgtatgtttaggataaaaataaaaagggagtgtggtattttaagatctttgtgtagcatagcattgtgatgttaaagtttatacttgggctcattttagaaatgacctaattaagtcttccttttttctgcattaatcgccttcctttgtattatgatctttcctataaggaagctagcagactgacccatcatttttctttcctcagtgttaaataagaatacatattttaaactttacctgtgaatcatattcctgtctctttggtaatttatttccctactctctctttttgtactcaaagtagtatatgacttctagatgacttgctttcctttcgaaggacagattacttactactaggagctcatgtaaaatcagtcttttaaaaatatgactttgtccctcctagcttagagatagagctccataaaacgaaagtgaggatgatatctggtaaagttcagatggagctaaagaatcaaaatcaactgaacttttaccaggagtccttagtgaagtaattgattgcattctccaacgcccctccttcaataagatttctgttatttgttttcttttacttgaatatggcttttaggaggcttgtatttagagtttctgtgcttatgaaaaaagagatagctttataattactatgtaagaactatgaagtgggaaagaatacattggcaagacatattacaattactttgtcatgcatctggttatgttggcatatttgtttaattaaattccctgctaattataactgtatgtgcttgtgttaattattatttacctaacactggtaacagtgtaattctttaaaggaaagcaactcgctttctatttaaattaaacttcaatttaatatgcttcctaaaataataatagtgacatttcattagaatggtagttgaaaaatctttatctacctcagtggaatttggactggctaaaatttaacagagttgttttaatatcagattgtaattagggatcttaaagttagagtaaaatggttaacatggccaaaccaccagctgatgctgcacatggttcatctgctgaaggaaacattttcatcctttaaggaaaaccttgcctgcccttccaaacttcctgatcacctactatagaagagagagggaggaaattatacttgacaatgattctcaaagacctaattagaagtgggtctaatatattctctgaagcatttgtttaaaagtcaaattgcccaggtcacttggttatgatcactcacccagatacttagtatatgtgtaagctttttcagggttgcaaacctattcgagttaaaattgaactcccagtggagttgagtctttcccatttcattcacttcatcctctctgtttcaaaattcttctacctctacagatatcttcttcctctcaccctttgtcagacgctagatatttttaaatttcccttacttatcctagtgataagcggggaactctgatttccatagctgctccttctttttgcatgcatacttgcatcttttcagagagtttgactcttacctggtttttttttccttcaatttaaaactacttcctctctctgaaatgccaatctaagaaaatttgcaatttcttctacctagtcactctccctaatttacatcaaaaactttcttttctatcacaagagctggatctttggctccagacagaaacgagtttaaaacatgcctcttcaggtaagttgctaattttctgagcctcagagtccttatttataaaatggggtgctcaatgatgacagccatctagggctagacagaaggtgaaatgacgtaacatatgtaaagcatctaattcatagtaggctccaattaaacagtggccttttatatacacacacacacatacacacacaccccttatatatgtgatgttttatatgtaccatgtacacaccactgagttccttttgtcatattctcacactcttatttcaagagacaaaatataccaacaaatgagacagaagctactaaaagtgcttttcaagctttcttagcagtgaaaagtcttttcaactgcaatcttacatgaaaacatatgaaacttatgtgaaacagagaaaggggtaactgctgtccatgaaatacaaggtccttttgtgttctaagtcagaccctgcaaaatcagatagttctgaggtatataatttaaaagctactgaaccattattttgaattcactcacattaatgagtgcccactacatggtaggaactgtgctaggactagacacaaagacaaggcatagtccttcccgtgaaggagttcatagtctggtagacaacctctttgaactcttagattcagcaattctagattcggttaaagtagttttagggcaatatgcatggcataaatggaatgtgtaagtacctaggggatagaaagttgtgcttatccatgaactcatctgagaaggctttctttggtgatgatttgaacagtttgagccttgattgtcaggagcggaaatgaatcctcgtgtaaacaaaaacctctgcaagactatcaaggactaagacagaagactaagaaaccctggtaggaaacaacaaacatattgcttatcacatttatcctcttaaatgggaaagacggaactaggaagctggaaatgaggtagaaggaaagagaaaggaccagttgtttgatgatttgaaataaacattttttattatgaggaatatagatttttttaattaagaaaaagtgcaattcagaaagaatgctattgtccatcttgaagtctttattgtctcccccacaactcttccccagtgtcaactgcgaatgggcaatcaggctgctgtccaggagagagaggccctagggtatgtaaaatactgcagagaaatctactgtgtctacaacagcaactggttctctaggaacctaaaaatagtcaaaacttcttttcaagttcaaactgtcaccaagattagttaatgaaccttaattggcaaaatgaaaatgctgcgttattttttgagaaggattcttagttatcatatgaaatttgtatctggttcatagtaaagtgttatttattagccacactttaatgaattccctaaaatttgttgctgaatttaggagagatgttcagttcaattcaacactctttgagattgactatcatgtatcaggcactgtattaagtgcaagagtaaaaaggcatggcccttcttctcagagagcccatggtctagtgaaggagtcagatgagtaagtagataattatgaaatattgtggtaagtgctatggaagaaatctaaagaacaggttatagaaaagaggatgtcacatcagaggccacgacacttaaactgagtctttcagaatgaatgagaaattaggcagatgaagacagagggaaggatgtcctatgtgccgttaacgtgcaaatcacatacgcttggatgtctgatacttgggccggttaacttctctgaacatgactttccatatcttcattgagtgtttatcacaaaacattgtgagaattgcacgtgcaaatgcaggtaaagaggctactcaatcctggtgcatagtcatttacaaataagttggtttccaccatggcacacgtatgcctgtgtaacaaacccacacattctgtacttgtatccggaacttaaagtaaaataaaaaataaaaatacatagattgttttttttttaagtgttgaaagctgggctttcattgccaaagaaggcaaatgttggtgtttcatagcagctgaatttgccaaccacctacccagtggttaggctactaaagtggaaagtttcattcccaattaatgcaccatttttctcagagactttgaacagacatgtttttgatccatcaaatctttctgtcctggggttgtgtttggtttttattccaattctaaggtctgtctgaacacgctgtgccttgagccatgtagcacacagaaggacaaatgatttcttcttattattctttttattaacaattgaagggaatagttaacatttaagaaaaaaaaagactgacttgagagaaacttttggttattttctagtgagggaaaaaaagctctaaatgcagtatgtcaatcttgtttcctagataacaaagcaaatctaaaacagttttgaacttttttccttattccctttatcatgaatgtttaatatccaaaggagccaatttttgttgagaattagcttccaggtttggaggctattagcaatcaccacagggagcctcacactccagttctatttcccatcctttttcctgaatcagaatcattttctgtgtagttatagcaagtgcctcggttttgctagcctcatctgctgtttttaaatgtcagcctctgccaagctgaaacatcatgaaagtaatcaaattatgtattaggaaagagtagatcattgcttcaataaacttgccaaaatcaacatgtgtagccatctatacatgtggaatgtcactttgatcccccatagctatttcagtaatgtcataaatgttctcataatcattttataatcataatattagttaactattacattttatcacttaactcgtgctaagcatttagcttgtattacccactttacctgtacaatagttctctcaggtagatgctagagtgttatccaggttattgtgaggaagctaaggcacaagaaattaagcaacttgcccattagcctacagctaacagtcctggattcatacccaggcctgtgtgattccagagcccatgctcttaaatgctaggctacacctccttctttttatccttctgtgatcgttaaaaaagacatgacagttgttgctgtaaaccataatttgatgtcttatgataacacttaactagcttattggtggttttgtttgtaaacattgaaagtaagctttagccaatgcacacttaatcagatttgtattcagcaagtgtgcttttgctaatagtaagccagacattgtatcaggcatcagggtaaacatacatatacatatgtatatgtcccgaccttgaggaggtcatatctagctggggaaacttacaaattgtacataatccattatccacaattccaaattccaaaatgctctgagaaatgaaatttttaaaatatgtagactcatttagcctaattcctgaattcatatgaggccacattatatatagcctttgtttgtacctcttaatataatttttcatacatgtgtttgattatgaggtgctaccctaagctctcctggcattgttgcataatacatagtaaatgccctgaaaacctttctaaaatctgaactttttgaattctgaaatatatctggtcctaagagtttagcagaagggattgtggccatacatgaatggacatgttgtagcccagcaaaaggaatgatttacttcccatgattgagttaaagattcacagaagaggctgcaggcagtgaaactggaatttaccaaagttgttttggcagcctaggcagaactgaagttacagccaaagatatagacttatagagaatctggggagggtatacatggaagacaggactggaaaggcaagttggcaccagattatggaaggcctcccatgtcacaggagaatgcattctttttctatcaactgacaggctcttttctgatttccttcagcctcatttgctgttgtaccttgctttgttgcagtgtgtcatggatccatttggagaagctgatgagtcatcttgtgaaagaaaaaatgaattgaaggacattgcttactttctgtgttgattcaggcctcatttcatcttaaccccctagttagaggacatcagtaatgattcagtctctgcaactcattcctaaataaaattaattggaaagtagatagctctctaataaccatgcttgtttttgcataatagaaggagaaaaggattaaattctttgttctaattaataggaatgaaaatagaattgcaatccgtggtatggcaaaatgagagaaaataaggcttgtaagtaattttcatggttgtttaggaataattgtttcattattgagttaatagtttttacaaacagcttccatttccatatcatattgctacagtcgctctttattgagattgcctcggcagaagatgacaagaagttgttttaaatccatcacttgtctaaaatatgagttccaaagtagttaggggagggtatgcagcaggaaagaatgaggtatgggagggaaacagggggtcagattgaaatcagttgattaataagacaacaaaattcattcaccagcttgtttcaaaggagactcttattattctggaaagaaattagacatcagatccctcataggccccaggctctgacatgtgttttataatgacagttaattagatactgtctgcagcaatcataggctgtcatttctaatacatttctgggaagttgaaggacaggagaagtcaccccctcctcatattcccccttcccgtaactgaaatcggttgccaaaattaactgtgaatatatgaggcacgagttcaacaattatacagccgttctgcacatttatgtttcctacttagtatgtactctgcattccaggctggtctgggcatgcattttgcagacagagatgttactgcagccctggtaatatttaggaacatctcacacagcagtctaacacctggtcttaagtggaagatgccacttgtcattgcaacttatgcattagaacacaaagaatctttcacaccattaaattcaaactagcaggcttccctcttttctaaaatagaacttgcaatgcattaactaaagtcatctattctcacatgtgcaccagcacggcacatgtatacatatgtaactaacctgcacaatgtgcacatgtaccctaaaacttaaagtataaaaaaaaaaaaaaccttaaatttgaataattcctgcagtagtacttaacctaaatttttcatgcttccttttatcaaacatcattataacatgaccataaagtataatatttcttaaaaactaagccatgaggtagaaaccatgttgaaatcatagatgttaacattttaagcattctcagaaattctctagtccaatcattttggtctgcaaacaaggacatttgagtctcagaatgctaaagtaatttgccaagattgtgcagtttctgggcaagcctgacttgcaattccattctcctgagttctacgctgttactctttccccttaagagcactacctagtgacattacctgagtaactttgggctaagccctggatgtttctgagcttgagagtcctagtctgtaaaatggacataggaataatatgtacctcatagaattacagtgagcgtcagtggggaagccactccaaagccttcagtaagactccaagcaaccttacgttgccttctgattgcttttatccttaggtgtccctaggtcattgctttcatcccagagcatgcctggagcttgtaagtgcctcctaagggacataagaaggctctcagtgcctttgtgattgaaaaccatactattttatgggccacccagtacatttgtttcttattttagagacatgcccactcaagccatgtgctgaaattcaagctttttcaacccaagttatcataactggtgtctctaggacagtgcttcccaaacatgcttcccaaacatgccagaggaagaattacctggagaatgttttaaaagtacagattctcgctccctgacccacttaatgcccttctgtcaattccccttgaaagaaaacctttagtacaagaagtgtggagaagagtctgttaatctgtgtatttactaggtttttattattattattattattattattatttttctttttgagctccctggacaattgtgaaaaacagccaggttttagagtgcctggctctatcagagcagatcataccatacccaaaatatgctagctttaacagctgctaaaatatctgggtactttttgtgggttctaattaactttcacatgttgggggttgaaatatcatcagtgaactgataatataaatttttggatgcactggcacttctttccttgcacttatgtactcattcatgcacaaagctatccagcacccactgtcaccacccgggctacaacccttctaatctaaatggattatatagtagatagctgctattgtctgtgaagataagcctgctgtctgctaccagtagaagacatgtttgagatttgtttcgttttattttatggtggtagtggttttaatcccctcatacccaccatccaaataatatggctggttttgtattaggccgttctttcttacatctggtttcctcataatcaaagatacagattttcaaaacacgtagctgggattaaggatatggtgtgtggtactggttattctctgtgcaaaataaactgggatcagaaagcatattaagccataaaacaaggcctgaccttgtatgattctctacccaatgagctaaccagccagggcagagttgggaaggctacaggattgtaggccattaacatccccgaagagccaggctgatctcttgtattattctcaggcatgagcagagagtgtatgcaatagccagttccatatgttactataatggttcacttgctttctaaatgaatgcagcctccttaccagctgtggactcttagtgtttgtaaaggtttaaagatgccccagtaggaagtagaatgacattgaataaagatgttgaaaaaaagaatgcaaccaaagatgacgagatagtatatattaaagttagtttagccagagcccagcacataataagctttcaataaatgttaactccagttgaggttattactattattcttgtgccatcgtcgtttaactcaaattattactgatcatcagtggcatattgactatggatgtgaagcatagaaagttcaagacatttaacttgattttctagaaaacagcagtttaaacaatctacttttttcaagcctaacttcttaccctatttgtgcatattatagtatatggtccttaacttatggacattagttctgaattcatatttccattgggtttagtgcattggatgttttaggtgaactaaatgggctgtatgaagctcatctctggagtaatttcaagaatcactgaggcttatggataattcacattgtcaattcaaagtttatgattatttttccctaaagactcttaatcctccacccagcttgctcccccgcccctcccccaccactttattagttgaataaataaggatgaaaacatggctaacctgacgaaagtctattctctctagcagtggcccagatgtagggcagtggaatagagcactgtctttacccctgggactccaggtctgcagattttaaaaagagttaactctatggagctataattatggcagtttttcaaaaaggtagacagcattttacatgatttttttgttcttagtttgtcttgtcagaagtgaggaattgcatttccctcctaaactctttactaggttgtgccatgtgccaggatttcttaatgtctttaatctgtaatgtgcctaatctttgggggaaaaggagtagaaatcaacatgcatgaaatgcacagccttcatgtgttaggctttgtctcagttagacgagtgtacatggatcatttgtagcttgtagcatggagaaatgacgtcaagccacctgtgaagccattcatttaagcagtcagtttgacaatctcacagggtgatctgcgaacacgtgaccttcttaatctgggtacacaatgtagctctgtttatatattcttgtcttttagtttattgtctttaataaagttagcaagaggataaattagttttatctgccaaatatataacaggtgcatcagcaggcatgtctataactatactaaggctatctgggatgtattctccctatagtttttctttgtattaagtacagagggagaactgttgcacagttaaagcatcaaaatgtctaagaaaatgtacaggattttttccctatccatgtctcctgtggggcatccgtaagcctttcattcacttttctattgcacatcctaagagacagttggactgatttcgcactttcagtgaagaaagtcatggcttatagaccatgtgggatgttcttctgtctacattagaagaattgaactttgatgttctctacttttcttcacttcaggaaaggatttctaggagatataagattaggctcgatgctagaaggaaaccacatcatcagttatctagaaggaattgcatctatcttctttttacttatagtcttaatagacttaagatttattgggcattattgggcattctgtagataaaaagcactcttaaagaaataaagcaaaataagttggatatctatttctagctgggctagaaagctaaagcaagtagggacttcaagttgcaagcatgattttaaagaataggttagcaacttaaagatactgagtttttcagtttctttttccaccatctctttattgtcacgagtctattttctaattccacccgtcggttctatgaatacaaatggtgttgtctttatgttgttgcaaaataaagcaacaatgcagcatcctccttaaagtctactctctctccttttctgatcctgccaactgagatgacatggtttgtatgttagtttcggttccatattaatttattcagtcatttttcaggagttaattgaacatcttgtctcttgttccagacatttggcacgtgttgccccaagcccaattcctttatgtggaaaaagggtctgccaaagaaggctaatttaccttcttgtgaatgaaggactccagaatgtgaatgatgggttgggatccattgtcagtgtggacacgagtcatttactcttctgtctaattttttagatcatgggtaatttatgaaaaattcaattcatgtttgatttgtaccctcttaaatcatcaacatattattttttaagagttatcaagtgttcaagagctaacatttggcttagagtaagcctattcatatgccaaataatttggaagaagtacagaaacctattgctttgggtcttcaaatggatgatcttaacaaagtatgattctctgtgtttctttattgcatgttatgggccatgaatttgttccctgctttactgatgtcctcctaattgcttgatatctaagaatacttatctgtaattcactgccatattaaaaatacgaaacaaagctgtcctgtaacaagaaggtccatttagccttctgaaaagtaacaaaaatgaaaacaaaaaggagcaggagctttaaatttgttctaaatacaggaccatttgagagccaagagaattaatttatatttttaaacattattttataaatatattttgttgttgattttttatatttagtctgctaagattatagatttaaaatggtgagttttaccaggatctttaatgattcttgttgcctatcaagcagaattctttgagcacagtatttatcagaacttctcctgagattgaagatcatgtatactttcttctaggcctgtgcttagtctaagagagagagaaagagagagagagagagagagagagagagagagagagagagagaatatatatatatatcaattaaatgtgattgtactagacattttcagaagaaattatcaggaaacgttgttactgaattctatatccaggtctgattcagacaatctgaggatcaccttttggaccacaatgtatagaaaaatacttcctgcagagggttatgtgagaagttgctactctagagctgaaaagggctttcacattcttagggcatttattctaagaaacaggacagtgttatgattattggtggaatgaggatgcactgatttggaattgtagtagaaagtggatgagtaacatagatgcgagatggcagcacatagttgggaatgcagactatctgggttcaaattctgacccagtcactaattagctttgtgaccttgagcaagtcgctaaacctctctgtactttggtttcctcatgtgatatatggggatgataatgatcagtaccaccttttataaggttgttgtaaggattaagcttgttaatacatgtaaagttattagaaaatcctctggcgtatagctagtatatatgaatgactattatcatgagtcgttatgaagtttgtcttggtgcatactttacccaggtaatagtctgtgctttctggaattacatcatctctgcatctctgtgctaattaaagcctacatgtctagtaacattcattctccgtcttccattttttaaaaaaatgtctctgaaaggtttataaaaatatacttgattgagaattacaggcattctcccaagaatatttacattttaaccaggactgtgccatgattaagacaaaggaaaggtccaaagtattacgagttttgacccaagttgccatccatcctactccatctcttgatgcttatcttagggggggtaattagtgagaaaagaaaaatgtaaagcaagttcctcatgaatcccttattaactttgaacaggactcagtctgagatattatctcatttaagacttctcgggtcaggcatggtgggtcacacctataatcgaagaccagaagagagacaggaggatcacttgagcccaggagttcgagaccagcctaggcaacatacggagactctctctacagataataaaaaattagctgggcttggcgtgtgcctgcagtctcagctactgggaaggttgaggcgggaggatggcttgggcccaggaggtggaggttgcagtgagccgtgatcacaccactgcactccagcctgggcaagagagtgagactctgtctcaaaaaacaaagacttctctactattctaagatgcagataggtcagaaggttgtgaccactgactgtatcccacgattactcattcagaaagttagcatcgtctaaccaaagtttcagaggtgcatcctcttcattctatcatacagaagaaacaatgctcaagcaataattgctttatcgaatcccttattagtctataatgtggtctctgttatgtcattttttttcttttaatttagttctactaaaatgctaacattgttttccttctgatttagcctcacatgggctgcatcagagatttttaaataaattgttacagtgttaattaggatttcatggtcaggctccattcctttaatagatacgatatgatttggccttctctgtatcttcaaataagcagtcctcaaacatccttatgatctctcctgctgccttagaagatttgagataatggagggatgatgaagcaatcatacaaaatctattgattcaccttggtgagtatcatttatacatcagtgagtaccttggttgcaaaattacctttggagtttaaatgtcattgcaaagttgtattggaaaggtaattttgttttggtaggccacagggttttgctttctgatactgtaaaatttatatctacttgccattttcatcatataagtgagaggtttaaatgctatgtatttaatgcccctgtctataaaaatgaggatttttttttaatggctttctcaatactactaactcttatttttgccgcagtgttgagaagtacggatttatgatactataaaatgcaaagaatagggtggaaagaaggaacacttcaaatatcacagaagctctgttccttgaaacttttcttacttcaagtaggcctttggatcattttggacatttcaattattgagttcttgatatttaggtcagaggacttatccttgagaggtgggacttgctgggtcagtgaggacttggagaaattttctgtagctagctagaggtttgtaaaatgcaccaatcagtgctctgtaaaaatgctccaatcggtgctctgtggctatctaggggtttgtaaaatgcaccaatcagtgctctgtaaaaacgcaccaatcagcgctctgtagctagctagagatttgtaaaatagaccaatcagcagcctgtaaaatggaccaatcagcacactgtaaaatggaccaatcagctctctgtaaaatggaccaatcagcaggacatgggcggggacaaataagggaataaacctggccaccccagccagcagcagcaacatttattgtgaagagggaatgctgcttctcactctttgggtccctgctgtctttaagagctgtaacactcaccacgaaggttggcagctccattctttaagtcagcgagactgtgtacccaccggaaggaacaaactcgggacacaccctgatggtgtgctggcgataaaagcagtgtgttctggggagttggaagagcaggggttagatgctggagggattttgcttgacaagtcatattatcaaaaaactagtggtcactaatagttttttacaactagctatgtttttatttctagtcatgaagcagtgccctaaatgctttagtaagcatagttaatatgcttcccaaaaaaaaaaccttccttttctttgtatttgaaataattttcttcctgtaattgcttttgaagaatctaaaaaaaaaaaaagccatacttttagcgttttttgaaagtattaccaagttaatatgaggctttttgttttgtttttgtaaatccagaaaattaatgatattagcagcttcagagatgtgttagatttgggagctcaaaaactgtgttaagagcttgtcattaaacagcctgattcttgcactattttttttaactgcctttttatattgatagagacgggatcttgtttggacttaataactttcccaaattcactaggagtctacaggaattattgtttgtacaaatgattcctgggagagatgtgtttttttcattctagagcattacagtgtcataaagaatcccacattgggcaggagtgggccagttcaggttggcctgtcatgcttaatcactggctaggagcaacctgggggaagggcaggaactccatgagaatccaaacaggtggcgcctgtagaccaaccaacagctgtgctccccaaagcggattctcttgaagggagatctaaagggggcacttccatggctgccacacccctgttagcatgttggtatttttcaaatgaagaactgtgaatttttatctcctgaaatgctaagtgagtatttgaccatctaaggatcccttttgtgatatgttgcgcttcatggtgactccactatgacatcacaaaactgggtagataaccttttattagcctttggaagcaagaggcactggccactgagtcagcaaccccaacaggagtagaatatgctgtctgtgttcctgccaacactttggttctgaaagaaaatgctgactcttggatattatgtctttctatataatggagataaaaagtatcaagaagcaaaattcccttctaagtgttgaattcaaaaccatttgtgaagaaggcttttggaagcagaaaacttttgaaggccattctgggttttctcgtccatttcttcacaccctagggtggccatgaaactcaagatcagaccagatctcttggggttcctggagtcaccataaaaaataaattggctttctgtaggctataaaatctaaagctggtttgtccacactgaggtgccattaaaagaacagtgggcctggattttgtagacctgagtttggaatctggctccgccacttactagttgtgtttccttgaagatatcagttagtctctgggtttgtttctttgtttgcagagtgcaagaattggaatggcagtgaatgcacagaccctgtacaatcctaaaacttagtaattctgtcagtgtcagggctaagtaattctagatgattgcagtcctcgaagcccagctgcccacgtacttaaagctcgtgggagagattgatatgtccccagagagtctgccttgcactgggccttcttcacctcttcgagtctcccatgcgaggctcagcagtgactcatcatgatcactggagtggtagggggctcagaccctcaactcccaattgtgttctggacttacaactcttaatgcctttggccaagttgtctaacttatctttagtttcaccagctgtgaaacacaaataatgtgtacttccagacctgccgcataatcagtgataacacaaaaaagtttttattgtgtcagaaccaatctcttctaattttaattattactttgtggcttctaattttaataatcatttctttgtaatcctagcctatgtgaatcgttttgtgagatgaatacaaccaagtggggtcagtgtcaaaaggctgccaagtgtcactgctgcttgggttgcagtattgtctgcaactagtatctttgaagcttttgttaagaccatattggcttccttagctcagaggaagtaaaaaatccagacattggtagttatttatcaaagtgctacattaggaaatgttgtatttatccatatccataggtttactaaaataaatgtaacctctgagggcatgcagtcattcagggatccaaagtagctagatacttgggtctctaggcttacaaataagcaagtatccctccttggttttataaagttcttggattatttcacatcacacaaatgtacccatccttggggacttgagggcattaacattaatcaaagtgaggcaaaattcaattagaaattatcgatgctccctgcatgttgattttactaggcaaggagtctcttttgcaataatctgcttgaacagatgaaactcagatcaggcaggctgaaagctgtcaaaggataagtttcaaataagggcagaaaaatgaacccgacatgggagccttcttcacattcattcatagtaggagtggagcctggagcaaatcacactcttaacaggtcccctgaaacacatccttttgtagataaaatctggttaaatgaatgccaggaatgactgtcaccttagattaaatgttcctcggacccgggtacttaactacaattatgctgtgcacgtggagagaggggcacaatagcaaaggcgaatggtattgtgaggcatgtatggaaagacaaaattagtctccatagaccttccctctggcttcaacaccacccactggtggattctgtatggtcactcgcccaggccattggaaagcagggtgtcagagtgggaagacccaaatgtcaagacagactagggtctgaatctcagctatgccatatatttgcgtagtgattttggacaagttacttaacatcgccgtgcctcatctttaaaatggggaaaatgggagtattttgaagattggtaatataatgtatatagcaattcatataatgcctgatatatggtagcattaatacgttattttttaaggaaccatttacaacttatatctgctactgtgaatataagcctttgcatcccttgaaaactttacttttttagtcccttccctgtcacaggagacctaagtatatgaagatgtcttcatagcatccttaagtttcattgttgcccgtgttgccaaggccagctgtagttggacatgtcctgggatcaggggttggttgttgaaagagtagatcatcatctcataacccatatggactttgatgcttacatatgaagcactgctatgtgtgacatcatgatatcaagtcatggcccagccatcatcctatttgtggttcccttaggacataactgcttttatggacaatgaatttaatatgattcctagtggcagagggccagaatgttcatatcccttgccatgcagaattactcatccatctatattttcttgaactctgttacatttaggtagtgtaagaaagtgtgtattcggtgaactgtgtggagagttagtgtatgggatcattgcttgttggtagttttaaaaactgtagatgatttggaaaggaagaaggtttagactttgacagactcacaaagatagatcagttctttcttactttatgtacaatattccagagatacatgttctcagtaacaggaggtagtacagatttggggctgtgatgctttcaaactttgccagactctttcatacaatttaattgcacaggcccttagttgatggcatgaagaaaaagttttatacagtagatgaaatgcatgtttatttttgatgtggtttggtttcctttcttgggacaacttatgcatgtaatatattatattcctcatacccccatccttctgctcttaaagaataggaatcattagtttaaaaacgtctgttttaactatctttccattttcaatgataatattactaattatgttaataattctaatcaattaaaaatgccgcttaattttttaaaagagctttatcatttgattaacatataggcttctctttgctcatatttttttttctttatcatcatctcttactaggcaatggcgaagtagaaatgcttgtaatagtgcataacagttattgaactcttgtgattaagacttcaagagttcattaagaggacagaaaaatgcacctttgatatcttaatctgatcactctaattgagaaaatacaccttaataattattcagtaggtatattgacctgatcattcatttgccttctaatttggacccttggtcttggcccttctatctccatttagctaggtgatatatggagcaccctggacatcagtattcaggggatagagcacaggcctttcttcctctctggggtccgttcttcttgtgtgtggcgttgctggtgagctccatcagggagctgacagtccaggctagtcataatgatgctttcagatttctaaagagtctgtaattaaatgacatcactgagtcttaaatgcatctgctgtgaaagtcagaaggctaaattatcccattaaagagagaaaagtgttacttggtattacagaatcccaagtttattatgctgaggagttgcttcgggaaggctattgaaagccagttgagcatggaacatagtgggaagattgggaggctggaaggccatgtggttcagaacaggctgttcaagaatcacagctgcactcaggctaaagtttaaaaaaagaagccattaaaaaatttcttttgctttcccaaatgcaattaactgcttggctgctggtttttattcctaacagctgtgctgtttcgggccctccagaagatatctgcagctacatgaccacagaatagtgtattgtagttaattagagcatggtttgcatgagaccaaggccatgagtttagtttccatagggctaacttctctaagttaaatcaccagttaatatatccccagccttacttacccgtcttccagattactgcctcatagcaaaaggcgtctggagaaaggaacttctatttatcagcccaagtgcccctgccattggaataatacctgacaattatgttcttcgggtctgtttgcctacatgggtaatttctagaattaaagcactattaatttttcagttgccagttgtgatgcccccttttaaatattaaaaaaaaaatcggtatttgatcaaatctgagtattttcaatactcattttctttgacacttccatagaattcagaaatgtttttaattgattttttcttcccatgtgtgtctcatttactgtactgtatcataacttaggagttttatcttttgatgactttgtaatatagggatagagtgaaaagacaaggaggaagtgaggtgacttggacaaaaactaccacatattccctcctttttcactaagcacatacttactttctctaaattgcctggcttctttcatcatcagcccccaagaatgccattatttccagtcaccaaactgaggccagaggaagagatggaagacagaaatgggcacatgttttgtttttgtttttgttttttttgagacggagtctcgttcttttgcccaggctggagtgcagtggtgctatctcagctcactgcaagctctgtctcccgggttcatgccattctcctgcctcagcctcccaagtagctgggactacaggtgcccgccaccatgcccggctaattttttgtatttttaatagagatggggtttcaccataaccaggatggtcttgatctcctgacctcatgatccacctgccttggcctcccaaagtgctgggatcacaggcgtgagccactgtgtctggccagaaatggacacatgttttatttccttggtttcactttagaaactttgaaaaatattcttacttcatacttcaacttctttccagtataccaactatatcaataaagggttctatttggtaaataaaataaaccaatacaaaaaagcagaacttttaagcaaaagaggtacatttttggaggacactagaatgtctcgtagaatctaaccctttggaaggacaaaaaccagggcagcactgggggcctcagcaggagtcgtctgcaaatcttctctctgggtcattacggagacccagtcattacaagacccagttatcgctaactcccaagccccaggtctctcactttggccaggggtctgctgatactgtgcacatcacctagagcaaaggcaaggccatgagacagaaaacatggtttcagagtccaccctgctggatgctgtggatccttctctgagaaaggagactggatatgccacccaaaaactatccatgttggtggatccagggttaaagcacggcccagaacgtaacttagaatattacgaaacaggtgtcaaagagttttccagaccagcatctgttccagaaatgtgaggaaagctctcaaagcatgttcagtacctgagaagtttggaactccagatcaagagaagcatttttcctcaggcttaaggccacatagaaggtctgcactttgtgtcactttacattttactgacctttattcaactgtttgcctcttctcctccatctaactgaaggccatgtaagatccaacagtgatgatttcaccatcctggctattagaagacttatggtttaagtatctcatattaaatgtttcctcctaatcatccaggcaaacaaagtcagaatgtattagtccactaatgtatgttcagcatctgctatgctcagagtattgtgctagaattgtagaaaacataaggaagttgaaccagtttctgaattcaaatcacttatacttcagttatcaatataagatataaacagagaagtagttgcaactattcttaaaggttttaagtaaattccacatgatcagtctgtagatgcaaagtgctttaggcgtaaaagattcatgaataacaacaataatgataagcaatatttattgagcattttctgtaaggtactttttttttcttgttttttcttttcttttttttttcttttctttttttttttgagtcagtgtcttgccctgttgccaaggatggagtgcagtggcaggatcatagctcactgcagcctctaactcctgggctgaagtgatcctcccacctcagcctcccaagtagctggcaccacaagcgtgcaccaccacaataggctaatttgtgtgtgtgtgtgtgtgtgtgtgtgtgtgtgtgtgtgtgtgtgtgtgtgtgtgagatgaggtctccctatattgcccaggctgtgtcaagtgtcaaagcactttttatgggttaaatcatttaatccctcaacatataggtggtagtgctttatagttaaagagacaggcttactgtcttagtcactttgaccttctataataaaatactgtagattgggtggcttaaacaacagacagttctggaggctggacattcaagatcaggatgtcagtgtggtcaagttctggcagaggctcttggtggcttacagacggcctcctccttgctgtgtcttcacatagggtgcagggagagagcaagagcaagttccctgctgtttgttctcataagggcactcatcctgttatgagggctccatcctcataatcttatataaacctaattaactcccagataccccacctccgtatactctcacactgggggtttgagtttcaacatacgaatttgtgaggatggggagacccagttcaatccatagcacttgtaaaggttaaataacttattcaaggtcacacaggtagcaacctagatacttcttccctgtgcatatatttatatatttatatatatatatatatatatatatatatatatatatatatatatatatggaattttctagaggaaagggagcttgaataaggttcatatagcttctaaacactgcacttgctgggttcttggttggttcttctgctttacatgctgttgcttttcctttgctggcccctactcatcttctctacctcttaattggagtatctcagggctcagttttagacctctcctttcctctattccatcagatccactccctagtcttacagctttaaataacagctgtacaagaatagcatctaaacttttattgcagtgccaatctctcctctcaactctcagttcatatatctactgcccatttcatgtctccacttagatgtctaatcagtatcttaaactccactttccaaaacaaaactcatgaattttttttttcccaaaactactcctcctattgtcttggtcatctcagtaaatgcttcaccctcctgtttgctctgacaaaagctctttatgtcatgctcaaaacttctctctttttttttgagacagagtattggtctgtcacccaggctggagagtacagtggtgtgatcttggctcattgcaacctccacctcccgggttcaagcaattctcctgcctcagcctccctagtagctgggattacaggtgcccgccaccacgcctggctaatttttatgtttttagtagaaacgggttttcaccaagttggccaggctggtctcgaactcctgacctcaggtgatccacctgcctcggcctcccaaagtgctgggattatgggcgtgagccaccacacccagaaacacttctctttcttttataccctacatgcaataggccctcaacaaaccttgtgtgctctaccttcaggctgtatggagaatctgactttttctagatggcaagatcttcagctcgttcaccatataatacatgaaatacatgtattctcataaaacaagcttgataccctacactgtctctactgctgcccctctgaatcaggccaccataatgtctcatctccattattttgcaatgtctcctatcggacactttttactaattttcttgccatatagtctggttttcacatggcagccagagtgatcctgttaaaacacagggtagattatggcacttcgtcagggtaaagttccaattcttcaccatgccctataaagcaagaaaggaaggaggaaaggaaaactaggggccagagcattttctggaccagcatctattccggaaatgtgatgaaagccttagtttattctttatctaaaaagttctctccagaaaatacttgaggaaaagattacagccacacagaagctctccatttagtgcgactttgcattttgctgatgtttcttgagttctatgccactactctctctcctcccccaggaccaaagggcatatattttgctttcgatgacttgtgcagttgttgatttccagcaagcttctgactgtagtttcacactgatgatataggattaccatttgatggtagaataaaagcagtatgatgtattggaaagaagactgggtgaggatttgaaagctgtggattctaggcccgttgctgatcctaggtatatttttggtctacttcgatgactgtatgtctacctcagtgactgtatttggttataaggttgtgttactgttataataattgcaggtttactaatcaacctgtctatccatttcaaagggaaattgttattttggtgtcaattgcagggtatgatggggaaagactttctctgttcaatttcagtttctaagaatacactgttgctaaaagtagtgataaactttatatacaaggtgtgcattttaaccatcacagccatattatactgacttactttctaactctccatcttagatgtagtcaacatattgatcataggttttaaagtatccaaggacttgcccctctttctggatagggagatcttcaacctgttgaccacataattagatgaaatatatattctcatgtaacaaacctgacgccagtagtgttaggcagctcctaagggagtcagaagctgcttccagcctcgtaaataatgagcacataactaacagaacctgatcttcccagcagaaataagtcagcctccttcacagtatgcaatatggtcaatgaatcagtggttgctgagtgaactgcacttcccccagctggaggagaaacaagcttttttaggagcgatagagcatgcaataggatgtagatgggaaaggaatctgatgaattgattttcactggaaaagtctcagagattcttcacctgagattgcttaatagtcctaaagctttaagctgctaatgagtctctgtccaacccactgggggcacttacatgttgctaagcactgagtaggctgaaacaaatcatggaaaatcatgcttccatttcctggagctgtgggggtgatgaccataacacctcaagttgcatcaaagtgatagaacttagacaactggctggaaatatgtggaagtaatttgctgctatcacaagttcacatgttaacattatttcacccaatttgtattttgtgggtgaccacatgcatttcatttgaaataattaggcaaattcgtcatataattcatttcctgttactagagctaggttgtccttctatttaagatttacaactagccagtacctgaaggcaacatgtgactgaaatattcttaagttccatgaaacaaacctttccagattgagatttgcaggtagagtttcatgctgcacgcagctgggggctctctggaacctgcttgtcaaataaacagagaacattcattctcaggcatgtggtcccaatagctttcacaagcattaaactcacttagaaaataactagtaatcaaaaaaaggcatttaaactcaactctctgaagcatggaaggagatgtacattacatcgattgaattgtcattacaaatatctactttagttgtagacgtaattaggttttagtgaaagaagacatttatgtagattggggggatgtggaaggttttaatcactggaataccatttttattacagctggatattagggactgatattgaacaatggatccactcttttccactgagaatggtggaatcttcacattttagaactaacaggaagcgggcaactgatctcattcagcagctgcctgtttaggctacccaacccctagaagtctgagaaattggtgatagggtttacgagttatttttagtgtatttatgaatatgaatgcatgcatgatatggccacaaaactatgaatcaatttatttatacttaggttggagttatatcaactcaaagtgtagcatgtattgtatgctccatagaaataggggctggatctgcctaatttagttctgtgtccatagcgctcatgaataggacttcacacatgataggaactttaatatttgttggttggatggttgaacaaatgagtggaagaagaactattcagaagttcttttggcagttatagaaacttggattaattttcttaaagaagaaatccattactgtttaataagcatagtttggttagtaaaaatatttcaaaacaaaatgtccatgagagcaaattagtaatataagttcttggtgtgaaaacgactttgcacacttgtaaactaggttcccgaaaacttaagtgtcttgctccaagttgagcagggggcggtgatggcaaaaccaggattagaatccagagctattggcccatggtcttcccaccacaaactatgttattgaaaatagatcaggttcctttagatgtttaataacctttatgagtgaaaatgctgcctaatatttggaaatcaaacatttatagctctaaataaaacttacctctacagttacttctcacttttattcttacgtctaaagggtgtggaaacatcattgaacattgtttttcacacgcagatgagactctgttgaagggagttttgtggtttaggggtttagggggttacaggtacctttgagaatctgatgacagctgtggaccatggacaaacacgtgtatgcccagacccagcagttttactcgtggcatcgggcagttcacagaccccatcatgaggatcctgatttggaggctctgccaccattctgtttggccctcttttggtttggatgttcctttcagaattgatgagctttcacatttgcttctactccgattaaacagctcatattgtttcatcatttaaaaatgccttaaaatgagatggctcacacctgtaatctcagcacttcgggaggccaaggtgagaggatcacttgagtccaggagttcgagatcagcctgagcaatgtagtgagacctcgtctctaccaaaaattgaaaaattagtcgagtggtgtggcacgcacctgtagacccagctactcagaaagctgaagtgggaggattgcttgagcccggaaggttgaggctgcagtgagctgagatcacaccactgcactccagcctgggtaacagagtgagaccctgtctccaaaaaaaaaaaaaaaaaaaacctaaaaggtactttttacattgtccgtagaaggtgactacaactaaggcattttcatttttgaaaaatatggaataaaaaacctgttgtagaagaaaattgttcacaatgaacaaaaatctaaatcactatgctatgttgaagccttaagtggagctattgtaaaatatgcatttttatcccaaaatggaaatggcactgtaaaaatggagacaattttaatgttctgaaaaagtgtataaaaatagcatgcatttatcgttcttcaagaaaaggtaccaaataatagaatagtcaatggcaggttgtctattctaggtggatttggaggctcattagtatagagagaaccaaatggtgagtcatcctcccaggctgctctccttaccttcagaacatcagcaagaccctagtgaggaaaggaagatgcacgtggacaatcaccttggcttttttttgccattctcctggtaaccccgcccattttcgttacctgtgaaaataagccaattactagaaaagcaagctcaatgtatccaattagcaaattaagacatttagtaaaaatgaagcctcagaatcttgaaagggcagagtgaacagggagcactttcaactccttttatcttcatcaatacttttaattctggtgatttgaagagatattaatagaggcaatagtactctgttaatcttgactatattaatacgagattagggaagtttggggggctacagctacatttgagaatctgatgacagctgtggactgtggactaacacttgtgtgcccagacccaggcagtttactcatggcgtcgggcagttcacagaccccacggtgaggatcttgatttgggggatctgccaccattctgtttggctcttttggtttgtatgttcctttcagacttgatgagctttcacatttgtttcaactcagattaaacagctcacactgtttcatcattttaaatgctgtaaaacaaggccaggtgcggtggctcacacctgtaaccctaacactttgggaggccaaggtggacggatcacctgaggtcaggaattctagaccagcctggccaacatggtgaaaccccatctctactaaaaatacaaaaattagtggggtgtggtggcacacgcctgtaatcccagctacccaggaggctgaggcaggagagtctctggtaccaggaagcagaggctgcagtgagccaaaatcgcgcctctgcactacaacctggggacagagggagactctgtcacacacacaaaaaataaataaaaataaataaaatgccctaaaacagctggataaagtttatcttgactgtatttatcaggtacctcacataacttttgaactgtgggtctcaaatatacaactccaagaggactttcagccttacattacccttctaagaacaataaaaatgtcccccttacatttgctaggtctttccctccatatgcagtcctgatacagtgagaactgattgaagaggtaggttcaaggaccttgagcttctcctcatatgtctagttcatttttttgctactaagtggtttgggcttttttggtaccctttccagttactataatcagctttgaatcctctgtgatgcttctcgtgttctttatccctagttggagaaataactctttgaagatactttttcatgtacattcgggagacatcagtaatttaggtgatattttcatctttacggtctagatgagtcatagagtaagtgtctctctcctggtttaagtggtgaattccttcagaaagccactggccgactagccccttggtgactgtcccagtaacatggaggctacctggcctccttagtgagcccaggagaagaaccttattcttctatttggagttcttactttattttcagcatttgcgaaatctcaaaattaagttacctgttttcctgattttgaactttagttactaggctattccatcttttctcttagcacctaagaggcactaccctcagttcaatttattcaggtttcaatttcttcagcccagatgttccttctgtcattacgttagttcccttggaagctatccaggctgctgaaaatagcttgagtgtgtcacaacccactggcacttaccactttctcttcagtagcagaactcttgccctattgagtgagcatctcccaatcaaatcacaatggatagttgtcttttttttttttaattatactttaagttttagggtacatgtgcacaaagtgcaggtttgttacatatgtatgcatgtgccatattggtgtgctgcacccattaactcttcattaaacattaggtatatctcctaatgctatccctcccccttccccccaccccacaacaggccccggtgtgtgatgttccccttcctgtgtccacacaatggatagttttcaaagcaactacccattatgcatgtgttcttaaatggtacgttgaagagactatacaaagaactttttttaaaaaatcaagtattacgcagccagctcatatataaccattgttgaatagaactattaccctcaataaataagaaatgatgacacttggaaaagagagaacaatagttaatgggtctgcttttccctctaaccacaaccatgaaaatataatcctcattaaagggctataaagttgtctgctttcaaggttcagcacactaatgtctccttgcttttagtgctgttttagtatgttgaccctctgttccctgcagctgggagtttattagtctttgtggcctttgggaatgaatattcataatgagatagcagtgatgtttcagatcctttttaaggccccaagagtattactctgagcaactaggaaaactgagaaaaaggcaaatcatgccagcatcccatactgaatcatggaacacggggctgtatgcaaaggacctggtgaggaaactgaagcctagggctacccagttatgaatagcacagccaggccagaatccaggtctttcaattcacagtccagattctttctgtgacatcatattatctctatatgaatttgccttttccattcctgaggttctaacccatgaaaaagataaaacaccaagtatctaaaattagaatttgaccatgatggtggaacttatgtgacaaagttattcagggagggcagaggagtagaaaagcatctctatcaaccgtgtagtttcttagaagtaaactctagttatatttgggggtattaatttcaccaactatatcacatttttctttttaaaaattaccattattattcacgttttaaaaacatccttaagcttattcagagagtctatgaaacacctgctaaatcatatttactcttcttagaacaataaaaattgatcactatggtagatacagttgagaataaggaagatgtatgatgatgcttccttttatttcttttttcctaattgtattataaacatcttatgaaatcaaggtaatttcattaaaattcttatgattgggtcttaatttcctatagacattcaagccttaaaagttttcagttaaattctacataactttctccataggcaacttcttttagtcagtgtggtacttctttaaattcttaataagctcagatcagatgaaagaactgtttttctatcccaaggtgacatcatttggatcccagactgaggttgcctttttccttgagtgaataccaatctgatatacaggttgtgggggaaaggctctggtggaaatagggccagagaaccactcctcctgatcaaggctgcccagaaagattcctcagttcagaaggatgaactggatagctttgcctattacaggcatggcattgatgtaatattgagttaacaatattattttggccgggcgcggtggtggctcacccctgtaatcccagcactttgggaggccgaggtgggcggatcacaaggtcaagagatcgagaccatcctggccaacatggtgaaaccccatctctacaaaaaatataaaaattagctgggcgtggtggcatgcacctgtagtcccagatactctggaggctgaggcaggagaatcgcttgaacctgagaggcggaggttgcagtgagccgagatcgcgccactgcattccagcctagtgacagagcaagactccatttcaaaataaaaaagattattcatagtaatctatgtctttgggtttatttagaagacacctgacttcatcgaaggctccttccccagttacgtgcctgggaagctaattattcagtcggagggtaatgaaagacgctgccatctgtctgccgacttaatggagtgtcagcatatcccaaataggaagtaattggattgacagacacaaagccagttattagactgttattatctgattggaaaaaagcagccagagaagcatacagctatagcaaaaactaatctgatgatgtctgttgttctgggaatgcagaaaccaccacacagaatgcatgggctttgaaatccctgaccggcttaggaacgtttggagttccttctcagaattcatctctgtattcttattacaaatcattataatgcaatagaataaaacacagtttgcataaagatggggcccatttataaaactgtcaccacagccactctattaatagagccattttaaagatttattgtgagcatatgttactttttacagggggccagattgagagctgcaggatttgaacgtggaagagtgtgctactgatgataattcaaaaaaaaattaaagcgattctgcccaagtagtatcattagactggtactcttcccttttcaggtgtgattatcaaagatcaatcttaatgaggcattaaggacaggtgacaaggtctagagcagtgctacataactacttttttaaattcacagattctagttttatttcctgggaccgctagaggtcagggaacacaatgcatgggctaaatataagggtttggaagcagaactgggttatgagctttattgtcctttggaaaacggtggctgcatgtgtctggtggggaagaagtagtaaagacatcatctctattcattcactgttgattcagtgagagtcacagccctcctccataggattcctgaagtctctagtccctggagtttatgcaaagagctagacagttccacaagcttacatttattcagcaagttcctaaatagcacttgcaatgtgctaggcactttcctaggttctaggtatacagctatgaagccgtctaagaccctgccctcgtggggcctgctttccagtaaggcaaatgaaaagtaaacaaagtcaatgcttgtggtatcagattataagtgctgtaaagaaaaaaagaggcagtgaagggagatggagaatgatcttaagaaggtgatgtatgtgctggcaccctactgaagtcagcaagtgagttgtgtaactgtctggaggaagagcagcccaggcagagggaccaggactttcagaggcccaagcaaattatgagtatttttgccagtcctaccaccaagaaaccagctgctttcagattcctttgcctgataatattagagttagtcctcaacatttcttatttgtaagttagggaatactgaaaatatgcatgcaaaggtactgtaatctataaagaatacataaacataggatattgtgagtaagctccaaataagctttagagatctccatcattataatctgagtcatttaaaagctttgagggaattcccacttaaagagaccaagtctgtggtgatatcacttttatcacacaaacctttatcagtaattttcttggcatatttacaaagaaataaacaaaggaattacttgttagtaatattacctgccacataatgagtgctaccatatttcagacactgtttatagacacgaggtgaatttaagatactactgcaatacatacatcactgccaaccttataataaccctgcaaggcagatattatttcctcattttacagattaggagcctgagtggtcagaaaagtgccacagttaaatatctgggaaagctgaaattccaacccaggcctgtctgacctcagaccctgtggcctctcctgtatattatgttgctcaaaagatcataccattgagttcttaatatgagtggcacactgtgttaggaaccatgagaaagacaaaaaaaaataaaataaaataaaagcacaatccctctactcagagacatgaaaatatagttggggagagataattttatgagaaataacagaggacagtaaaagatgaggtataaacacatcattgtgttccttggactatgaaagctaaggaacagagagagattaatgtagactacagacaataaggctgaagctgcgattttgagagacaggtaaaattcaggtgatctctgtcatagagttccagtcatatattgatgttagaatctactcctgtacctagggtgaaaatcagatatcatcatgattacctatgaaaattgcttagcaagttagagatgaactactgtctctcaacatggtaaatataacccagctacattttcctccaattttatacccctttggttaaactccaaaagaggtatcccccctgtgaataattatgtcacataaaaagtacacattttaagtactagatcacacagtcacactcagaatgactagagtctgataccatgaaagacatccaggagctgagtctgactgaggggcctggattggtgcctccctgtcctgcatactgtgggacacattctcatcgagtggaatggcaggccaaataccttgatgtgtttgcattgcccctgtccctctcagcccatacaccgctgatttcatgtatattaaatatgggtattctaaaacctcactgaagtggagtatgttctaaataagcagaaaaacataagcaaaaggacaaggacagaaataattttggattctcatgaaatcatcaaatggccattatgcagagatatgggaatgtaacgcagcctgatcctaagaggaccatgcaaaccagagggaaaattaaagattcatgagatggaagtaaaagccattgaaagtttttgagaaatgaaatatactgtgaaagtttgatgcagattagtctagtggtgaaatatagggtgggtagtgaagtaggaatggaaaagaccagaccagagacagttataatccagaagaaggtatggactagagttagatcatttctagagatgggacttgtttggagattacttttcaccttacttaatctcattaatgtgatttaaaggaaataatgcacactcaaaggagcaggttaaataccaagaacttagtgagtcaggtagctgtagctttatagaaggcactttttcatccatcctttcatccatccatccatccatccatccatccacccacccacccacccatcatattttctttcctccctctctacatttatacttacagtcaaacatatcacttccccagatgagagtctcagcttagcactctaaaatgctggtggcattaagttaggtaatgaatgtgaaagtgactaaaaaattctgaaaacaaatttgaaatgttattatccagttgtcattcctttggattctcttaaagtcacatttaaagtaggtagatttatatattacttgtacttttgaaaataaatatatccttcaatcattctaatagtttttaactattctgattccttctgtgtttttatgatatcgtcttcttctagagaattagttgaccaaaaataaagggagtcgttctatttcttaagacctaaaataatcattttggttcatttatgatgctctgaatgaaaaattcacaactttaggaataaaagttttccagttttgttttaataacattcctttttttgtcctcataaagtagtattaagtaatatcacattattaagtaatatttctgcactgaattttcagtcctctgatgataggattttctttcttttgtttcaaaagttgaagcaatcttaggaacaatagtcaaaaagaattcatttagggaaacatttcacaaagatcccctggtcattgctttcaaagtttagatgacccaagtaacagacagtgttgacgtctagtcataacttcagtgtgggtaggcaggcatcttctgttctccaataacgatactataaagtgtcaagcatacataaattctcaaatctgagcatgagatacaaaatttttaagataatctcatgcttttgttccattccaatgttttaacttacataaattatcttagggaatacagtggctcaagcttgtggttgaagttgatcaagcccttcttttgatgagtaaatgaataaagggatacccatgtctgctcagaaccatctttggtccgaccttatgaatagcacagatacgtcctctataatcgtggcctaaagaaataagaaaaaaattgttagtatctcattctgtcacctccactgaggtgcctattacaggataatgaattatatattatcgggaaacgagccatgtagtctaagggtaggcaaaacatctacaaccctcaacttttaattcattttctctcactaatggtctctttttattcagcatgctattgaggattttcctgataccatgacagaaggaatgaaatctaccttcaattatttatggtttaaatgaatgcaaataagactttctggcttgctgtgctgatactcattaataaatatttcactgggtattaggaagattcagattgactaaatgaggctcttcttcaatataaacgaaagcccttgtgtttttcgctactgtgcaggcctaattctcgtgtctggccttcattaaggcaaatgaatgttagatgggtgcatcaacacagggatggatcctgtgggaacctgagttggcggggggctctgcagtgaaataatcctctagttaaaccaaatttaatctcattagcagggtaattgtgctgttaggggaaatggccaaccaggttacagagaaacccacatagtctaattattcttcgacttctgtcactgaagaactcagaggcaaaagatgctcagcctactatcgtggttaagtcttagaaaaatctcagacctttcacagttgccagaacctgtgtatggcattgatcatgtcctacccattctgggatcctttcctgtataaattaacacaccaataatacaagctcctgtcatgttgctcctttttatatgtgcattttgcccacccacttttccaacaaggttggactttgctagtgttttaaaactgttcaggatatagtattgcatcagaaagttctaaaactaccaaaatatataaaacttagttataaaaaataagcctttccatatttctgctccttgggaaattttctagaatctttgaacctgtggaccatgtattttacattcctctggatttacaggcattgtgggctttgccatttttaggatgtggtatagaagaaagcatggtggactaattaggaaccagatctggcttcaagatacagtctgaaagcttgagaatagtgtgaccttcagcaaattacttaccttttctgaactgtaatttcctcacatgtaaaatggaaataattatcactgtcaaaacagcccccaaagcagaatgaggttcaagtatgtgaaagtcttttgtaagtgctaacatgcactatagatatgaacaataatcatgcatccacttgacttataagacttggcattcctagcttctagggcacagcttacatatggtcagtaaatgttaattgaattaattgcttagatatttggtaggcttactgtcatgtttcaggttgttgctggaatcttacatgaataactattgctgagaatttgtcaaaaccaaacagtgaaatggatgctgctccatattttttaataggccgggcgcagtggctcacacctgtaatttcagcactttgggaggctgaggcaggcggatcacccaagttcaggagttcaagagcagcctgcccaacatggctactaaaaatacaaaaaattagccagatgtggtggtggaagcctgtaatcccagctacttgggaggctgaggcaggagtattgcttggacccgggaggcggagagttgcagtgagccaagatcatgccactgcactccagcctgggcgacgagcgaaactctgtctccacaaaaaaaaaaaaaaaaaaaggagagagagagaaaatacagtgaatacctcctgtccaagaagaacttattatattgcttccaaaacaagatatgcatgtgggaaatgacagaaaaaaaaacacttctaaagacattaataagtgtgaatgcattgaagtaatgaactgaatacataaatggtaaatgcaaaactaacttttgtgcttgtggttatcatgcctgttgccataattttttattgtcagccttatgacaatgagcaattttatgaatactatcatatttaaaataaactgtgttagaactggctgccaacatgatggctggaaattttttcgcaagttttatctgagccagagtagttttctgaaataattttttccattaagatgtattttgtatttgtgttatgataaagcatgtatttcttgaatttttccattactttgaaaacaggaaacatttctcagatgaaaccagggcttatactggagttttgttgttttatttttttaaatgtacaaaccatttctacaggctttttctgtctcttgcttgcatattcagctgagtataacatactgggcagagtcacctgattgcagacattgactcttgcttggacagctgttttatcttctgtgagttttaggaatttgtcatcaacataatccaaaagaatatcagttctgcaggaactgataatattgtaatcgaaattcttctacagagtctagtttttcttagaaaatgatgcatattgtatcattttaatgtctatacaactgatagatattcacttgcaagtaatcagttagacaggaagacaccttttctttattatcctgtgtacaaatgtaataatctatacttttctatatctcagatttgtgagcagaatttttaactctgatttagccttacaggggatatgaaaacataaataaaatagaaaggtggaaatactaaaagtctttaattcctatgtaataagtggacctatttatgaaattaactataaagaatttaacacagatgcctcttgaaggaacaaagaactgtaggaatggaatggtagctcagatggcttaaaatatttagtttggtttactgttagttcacttttgatgtgaatttgatgttactccaacccattttgttatgtcgaaatcctgataatgtgatatatcaatagatgacccaaagtgagactctaaaaggcaatactgtcttccaagtaggaaagggctccagaggaggtaactttgagaactttgaaccactgtagaaaaataactttgtgaataccgttgcaagataattgtagatactgttcaggcaaagtgtagatgtgtgaacagagaaagataccaacagtgatatgagattatcctggcttacctgaattaatgatcaagtgtgtgaatacaggaaaacaaaaatagaaaagtttaagggacaagactaatatcataactgtctttgcctgtctgtgactcatatcattagtggctacttttttcttagggcactgtgcattcagaacactttgccagttaatcaagtgatagtaaacttaagagtgtgataagaaataatcataaactaagttcagcaataagggtggttgccagataggcccattagagatcattcaaactgagttttccaaagtattcatatattaaatgtaatgaaatccatcctgttgaaaaagagtggaataaccatggagccagtttgtttcttccagacaatatatactataattttatttcagcaggtacataagccagtcacatttttgacatatgaaatacttccagtctttgacttctgttattcatacctgagtaatgttcagcttaggccagcttcactaaatttcacgtttgagaaaaggactaggttttgatttgctgatagtttgccttaaaaattcctcattgatatgtttaacatagtacatgcatccttaacttcacaactttctttttttcctttcaccatctttcttccttatcttgcttagccagccgtatttctttcctaaaacatagccttaaaataatctgtatattgtatccgctttaagaaggactagcctttaaagaccagcctaaacaagctgtaaaaataacttaatattatttattaaaacatttattaactgtgtccactgtacttgatgtagtgttaggtgtttcaggtataaatcaaagatgtacaaaacgcagttgctgctcagaaggaacttaattctaaaagagaaaaacaggtagaaaaaaagactaatgctatgaagttaaatagttcaaatacataaagcggttttaaaggcatctgggaaaactttgtgagtgacttagttttgaagtggtccttgaagaaaggctattgtgaaaatgataaattttcaaaactcctctttagctgatttgccacaatttagaaaatgcaagggaacagtagaaatagaccacatgatcattataagaaaaggcatgaacttaaaaaaatacagagagtacatggaactcaaagtttgctaatgagtagaagtagaaataatgttagacttatttcttgagtttcttacctactggataccaaacaatgtctacatgaaaaagacatgttccctcttttcaagatattttaaaactagtagggaagacagatacctccatagcagaattctgtggactcagggtggtgtggtgacatagtaaaagggcattcaccatacacgtaagggagaagggcctctggaggaagtgacatctaagctagtggccacaggacaagtgacagtcaggaaggagatagggggacagtgttctaaataaacgaaccagcttgtacagagactatgctggaggcaagagagagcaaggcatgttttatgaaactgcaaggagttctagattctttgctttaatgagattaaccaaatagtcatatattttataagttgaaggaagaagggatggaagaaggaaaaatcagttaggagattattttagggaggcctgggaaaaagttttgccctattttaattctgtctattcacctgcgtcatctcattttgtaagaacctgaattagtatgtgagtgttacaaatggaggcacaggaatgtctgtctgagttcaagcattaaactacttgaacactattcatagcatgtgctaagtgggtgatagctcctggggcataattctttcactgggggtgccttagacctggaacactaacatagtgcctacctttcagcataaggagtaataaatagtgaaggggtaaacaagtagataaatgtatgaacttaagatttaatataaagagaatgtctatacatctagaagcttcttgcatgagtagcaaggctgaagaaaaagtgaaagatgatttttaagcttgagcttaggtaactggaatgatgatgacacaaaaatagagaacacaggaggagagaattgaaatgataatgggagtgcagcagcgaagagctccatgttggacatagtttgagttatcaggaggacatcatttgaaagtatctatcaagtgattggaaatgcaggtcaggagcaagaagtcagggctggagataatatttgttgtatttttagagaaataattcagtctttgatatattcaaatgcttatatttagtaatattatggtcctctccatccacacaatgtcccagtacctcagcacacactttagggttttcagcatggacttaagtctattgattgtcatccccttgcctgcccacctctggagttctaaccttacgggtgaacctttgagaggctttgatattaaagtatgttggatagcgtgatgaagtctggcatggtctctggagacaaactgtccaaggtcaaattttggccccatcccttgctagctgtatgaccttgggaaagtaactttgcctttctgtgccttcgtgtctgcttccaaatggcaattataaaagtacctaacttcatagtgttataaggaatatgtgaagcaaagcatggtgattacttaaaacaatgctggcctatacagttggccctcagaaaacactggtttgaactgtgcaggtccacttctatgctgattttcttaaataaatacggtcggccctcatatcgcagggctctgcatccacaaccaaatgcagatcgaaaatacagcattcacagcatgtgaaatcggaagatatggtgggccgacttttcatatacgcaggttctgcagggctgactgccggactggagtgtgcacagacccagatggtcttggaaccagtcccccagggatactgaaagatgactacaataagaacaataagaactgtcagctgttaatgttactgccattttttcagctgcccagttttatcacatgtaaaatggagatagtaaaagcacagtcctcatagagtgtctgtgaaagtcacataaaaaagaatccatataaagctctttgatcaggacgtggtaagcgctccatgggtttaagcaattattaatacagctcctactggaatagcaacaggtagaaaatttgccagattctcctgtgtcttgcattagagtctctgaaggtcaaactgatatggggcacctaaaacagagtatatttaatacgtgacacataagtttccaggtgtatgatggatattttgaataaattgcagtttttcttggaaatttttctgacagctttatcttctgaaaaaaaaataaagaaagaaagaagagggtatttaccgtaagataaattgaaaggataaaaccagaattccagacctcttggaaaagcaggattattattttgttctctgagttttatgtcagcatcccttatttatttatgcaatctttggtttaaaaagattgtttgatatgaagggttagagtttaagtcacttcaatttccaaattatatgcttaaaaaatttaacagctgtcgtttttagagaggcttacttcattttacctaaagtgcttttcagtctagagggaacacttaactgtagtcacaaatcacttgcaatatactcatggtaagatttttttaagttaaatttgtttataagcctgcagcgtccaaattttgtagataatattctttctccctttatttaatgatttttacctcttttctcctctacttccagacatgaattgcacacattacaaataagagcacccaaatccctttttatttgattagttcagcaaattgtctcctacgggtatgggctgaggacatgattgggctctgcagtgatgagcttattttgtacttttacacagaaaatctttatatacaaaaggcacagatagtagttacactcagcatgaacaattacagcttgttgggagagaacctcttcctgatgtgccaatggcttactcccatgaattaagaggcaaacgtgctccaaagtgcattaacctttatggattttttttcggttttcatgttccactgatttatggtcttaaatatgcctgttgctgctgtttctgaatgagtcccttgtaaatcatttctaaatgatctttttcgactcagataatactagtgagttgaatatatctcaaatcaattcctctgaggcttctttccttctttgcctaagttgttttccagtttgctctgtgtcttaaaagtcatacctgagagcagttgagaaagtaagaaatatatcttaaaggagccctgtttgctgggggcgccttctttctgcagactgagttgtttccagccttttgcatggcctcacttgggtttgattcccaaagcccaattgtcatctgagtatagctaacgggtcatagttctttgtacaaggatgggcccatgtctgggggtggattttattatgagttgtaggttgatttttttttttacatataaatctaccatggtagggattttgaatatactgtgttctcataaatagtccatgatttcccttagagtggtgtgcagaaagtgtcatcagaatgcaggactctgttattagtgctgtttgccatctttgtacatgggcccatatctctcctgaaaagttctgcatttgacagttagtgtttcattctcattctgggtccaaagattatttcagtttgctggatttagggtgtttcattctcattctgggtccaaagattatttcagtttgctggatttagggggaatgtgcattttattttctctttgtaactcatgtatcattcatgctacaggcttgtttttactgttgtttgcattctttacataaaaccaaaactcaaaatcaaaggtacagaattctgatgcagatctgtggcttttgtagcacacgtaattcattcatgatggtgtcacaaacagtatgtcaccgtttattgccaattaaaattttaatgcatgcttttatacacaatctgtgtcatataacaatattaaatgtgacagtagaggattggcacaatgaggatgggaccgtgtggacttacttttgatcatgcaaagcttccgcagacctgtaaatgtcatgcaacttttcacatagaaatcttggactaaaatggagatgaaagagttcagattcatttttttagtctttattaataggagagattcagagcttctcagtaaggatggtacatctctgcagagtcaagactagattagaaaacatgtaagaggaaatgatatgttgagagatcctgcaaaatgcagaagtcataaaggataaatcacgcgtttctattggttgtgatacatggaatcagcaggaaaattccaagacctcccaaatatctatattaatgtgtacgttattcatcctaaactaccaaattatatgtaatgatatacagcaaagtcaggagatagcaaagtgaaaagtttatgttgtatgatacagagcatatataaatgtacacattaaaagacataattagcaataaacagtgattcactgtttgtgaaagagtcatgcatgaattacttgtgctctaaaaccagaatcctgaatttgaatattctgaaatttgtacctttgattttgtattttggtttcatgaaaaatgaatgatgtgctctcatgattagactcaagttgcgcatttttagcaagagtaacagaaaacaatactgtgttcttctttatatcatatcagaaggcacatgatgtccattttgtcccattattagtgatgctggccgtcgaattttaaaagctttttaggatatgaatgtaaggaatacttatttaataagcaattatttttattcaaataaataaaacatcactgctgtcattgcagcttctacaatacgatataggacctctctgttaaaggatatttccagctggtagcagccacaattcttggctgagatgaaatggaagaaatggagctgtacagtgaaacagaatttgtgataaggctgggctaagtgagggatgcttgagtgaaattttaattagtttataatttcccttgatagcaatcaaatcaagattaaaattttgaaaatattgggtgaaatgttcatagtgtgtcctcatgtgtgcattccaaaggacacataacttgctgcaagaaagtaaattcaacaacacaggtattgcatatgtacatacatttagagggcctttagttgagaatctgaaaaggaaagcttcaattaaatatttataaatgttagaatttagacgataagatccatgctttgctttattttattttattttattttattttattttattttattttattttattttttagatggagtcttgctgtgttgcccaggctggagtgcagtggcacaatcttggctcactgcaacctccgcctcccaggttcaagcaattctcctgcttgtttcccgagtagctgggtctacaggcacccgccaccatgccctggggctaattttttgtgtttttagtggagacagggttttaccatgttagccaggatggtctcgatctcctgacctcgtgatctgcctgccttggcctctcaaagtgctgggattacaggtatgagctaccgcgcccggccagatccatgctttaaacatttgaaagcaatgagagtcagttgcgtactcgcattttttgtttttttgtttctcctactttacaaccttaagtttaggaggctgatctgaataagggtcctcaaaatcctgtgatgagacgctccccatacagcattatgtatacccttttctttactctcatagtctctttttccatatacacagatatacctgtatgttgtgtttccctgctcatcatttacaggggataggaaacccctggtataaaagtacttcacgagattaaataatactcttttgacagggctccatctgtgttctaacttaactttgaagtgaagtattttcttttctaatgagattcttttcactgttaaaaattcaatgttttcatacttccatagagctaatgaggagcattgttgggaaaattgggctttttgattattctcttctatacccttgactctcactcctgtctcccattcaacagatcatttttaaatgcttactaggtgaaaggatccatccagtacactgtggtaaattggggaaaataaaataaagactcaccaaaaatgttgaagagctgcttgcaatattttaatttgtggaaataattcaacagaagcaaaatgaagatgttccctagtagctgtttggttaataaaactgttcattagcttggtagaatgaatctgtaatattctgtcaaagaacagaatacaaagtagtgtgaacagccatattgcacaaaatataaaacagtgtgggatgtggataagaatgagaggatcctctgtcaataagaattactggtttacattcgaatggtggagatatgggatgattttttaaaaattttgtattgaaatctgtagtccaaactcttaggagaagggcattacatgccagatagattatgtcctagtttcaggaactatggattatgatcaaaggaccttttaattattttatccaatattttattcaataaatatttcctacaagtctactgtgtgccagtcatagagtagcactactaggcatgaaggattcagcagttagcaatttacactttgcgcctggccacgtggggttttttgctcattcctacatccatttattagtgaaatattccaagtattaacctaatgttcagaattgtcaactagggatgattagatatgaaaataagggagcaaagtgaaaagtgaaaaaaaaaatcatacaatatttcacactttcctctaatctccagcctcatcagagtttatgtaagatagtaattctaaaaaccgcagcagcaccatttactaagcagttactgtgtgccggtctctgttttgagtgcttaattttcatttcctcattaaaccatcaaaacaatcttgtgaggtaggtagtgttattgtagccattttacagaagacacaagtaaagccaagagaggctaagtaacctgctcgagactgtgcattccaggtccaaactctggaagccctactgtaagtgttcctctcttgaccactctccttctctaagtccctcccctctgcagagtgacactgagtgaggttcatctcctggatggctaggaaggctcattttctgtgtccttcctgcccatgaagggtaggttgcccatttaatgtaactactttttttcatttttcatttttatttatttttaattgaaaaatagaaattatattcatttatgatatacatgttttgaaatacatatacgttgtgggatggctacattgagctaagtaacatgtattacttcacatatttattttttgtgatgagaacacataaactctgctctcttagtgatttctagtatccacacattgttactaactatagtcaccatgccgtgtattagatctcttgatctcttgaatttacccctcccggaaattttgtaacctttgaccaacatctcctcccctcccccatcccttagcccccgttctatccatttttcactgaggtaaagaaacactaagggactggcgaaacagccttaatatttctctttcattctcacccacatgttttgtgcttctgtacagggaggtcccttgccgctctgaaagcagatttggaaacatgttgaatgagtcccctccagttagggctgacaacgtcaacctgtatgtgtcatgtgagatggatgtgtatgctttaaggaaaaaatgatttgaatttgaaagaaatcactcagccaaaagcgatgggggcccctttgtctgtgctgctcagcacagttcatattttaggtacacgaaaggcaaatatgggactagaaagaaagaaaatgaggctaatttagagtcttctgcccatctgtttatgagcagattgactagtaaaagttttgttctgataaatgttaaatattttgaaaatgtcagaagtatactcagaaaactcttttccaaagtccctttgaagaaaatagagattctgatgattaattctcataatattaaaaaataataaaaagagtttcggtgtatttactcattagcaaattaataacagtggttttcttttggaaggcaaccaagtagactaggatgcacctgggtagagtatctttttgggagttagatgagaacagaaggggtcatcgcagcaggatgtggtatttggagatcttcaaattgtggccatgcttaaccatctacttttatttcatttttccctgccttctttcactcaccctctctttaaagatccattatattttggttttggtcctattttatttttctttcacattgataacatcagttaagaagcctcaatgctctttcttgtgccttctcaatttcatctttctttgaaggaaagctacttttttcattgtgataatcctatatatacaccatcttcatccccccaccacacatacaccccaggggttaatagagcgtttaactggtaatatgtaaggttaactgcaatgtattggtttagtaagtaaagaaaactctttactaggttaaacagctaaacttaaggaactattatacagcaatttattaaatatagtctttgatatgtgtaggcaattttaaaattttctaatttaatgttatttgagtagctaatacattaacagtttttaacaatcaaatgattattaaaagttataattcaaaagtctaatttctactcctctcccagacctgacccccacccctgcctcctatgggtacttagtcgtttttttgagacttcccaggatgtctttatgctaaaataaacaaatgggtatataattgttatatagaggttagtgtagtaaatactgctaaccgtagattgatctgagcttgctttttttccttgtaacaatatatcctggaggtcttttcacattagtacatcaaaagtttccacatttgggggtagagggagctgtacagtattccaaaatgtaaatatcccacagtttatttattccctaattgatgaacttttaggttattcccagtcttttgcctaaaaacaatgctgtaatgatctatatactctgtatgtagatgatcacatccatatttagatatagctctcagaagaatttcccaggagtgagatttctgggcgataaagaaattcatctggctttttgaataatagtgccaacctgccttccataagggttgtactatttttcactcatgtcagtaatatatgagaatgcctctttcttcacacttatagcaacagagtgtgttttcaaacttttggaacttggccaattgcattgttgtaaaaattggtatcttagtatagtttactttgcatttttcttatgaatgaaaaatttcttctaatgtttaatggtcattgtattgactacaaatagtcttttcatgtgttttgataaatttttttactaagtcatttggttttttttcttgttgagttctagccatcatctgtgatataaattgtaaatatatcttcccagttggttattcattttatgttttcattgatattcttctcctcttttttgagaagaaattgaagtacaatacagctcttcctttccatagcattgtggaactgtaaaaatgaccatgcaagctgaaaccatgcaaagcaatcttaatcaatgaggatagtcacaattatttcatgactttaaaattttttatcaaaacgttaaaaacttttgggaggccgaagcgggcagatcacatgaggccagcagttcaagaccagcctggccaacatggcaaaactccatccctactaaaaatagaaaaaaattagctgggcgtggtggtgcacacctgtaatcccagatactagggaggctgaggcaggagaatcacttgaacccaggaggtggaggtgagccgagatcgtaccactgtactccatcctgggtgacggagtaagactgcttcaaaaaaaaaaaaaaaaagacaaaaacaaaaaactctattcctggcatttataaatatatacagaaatgaaaaataagaaaactgatatgtatttagtacactgtaacattagaaacattgacaaagtgttttattttttgttaaaatcttatcaagagtagtatagcagtgcttgccgctgtcttatatgctttgcaatatacagcaagcatcttttctgggtgaactatcatacttctgagtttggctcggttgccagcattttatcctttattttttctgtgttgtgaaatatctccaagagtttttttaagtgtgaaatttgttgccaacatcacttcctctggcttctcatctctcttcatcctctgcatccctttggtcacaaccaccttcctcatttgtgctggccttcagtctggctatgcctctccaatggcagcagtgtcaacattcccagggtcagctctttctcctgtaactccgtttacattcagttcaaatttcacttccagtgttatcactttgcggtacttttatctttgttggccaattccctctttcattgatccatttttataaaatgccacatggatttatcagtgggggacagggaggcaccacagctgcttgctttgctccctgtccatgaagtgaataacaaatgcacagtgaccagttgctaatagacattggaagaagggatgtgattggtcactaatcatgatgaacacacatcagttatttacacagggatttcagaggagctaccaacaaagtttatactttagttacttaagtttaatgtactgtggtgactacactgtggtattgaggtatttaaactatgtaattgatggactgatgttatttaactaaaaaacagtagtaacttcaatttgttcatattaaaccacacaaatcagggctgcctgtatagaaaattaaaaagaatttaataataaatttattttgttattaaaataagaattttaataaatctatactcatctctgagacttgacaatcattaacattctgttatgtattctttaagggtttttaatagaggaagtagatcattgcaagtaaggttgaagttctcctttgtcctccaactcccatcccattccctttcttaacctctgaactcacatatcatcatgaattttagagtatccttcattctctctctgtttctctctttttgacatttatatatatacatgtaaagcagcaatccccaaccttttttggcacaagcactggcttcatggaagacaatgtttccacggacaagggttgggggaaagatggtttcggaatgaaatttccaccacaggtcagatattagactctcataaggaacatgcaacctagatccctcacatgcacagctcacggtagggttcatgcttctatgacaatctaatgtgattgctgatctgacaggaggcggagctcaggtggtaatgctcgcccagctggctgctcaccacctgctgtgcggtctggttcctaacaggccacagacccgtactggttcatcgcccggtgtgggggtagggggacccctgatgtaaaggtttcggtgggaaatatgtactcttcggggatgtgctttttaatttcacaataatttgtgttttttgtttttcacattttcccattgtttcttgtagtcttatctccttctggaattaaaaataatttttgtcttctccttttccccccatttttagaagtcatgttttctgtttcatcctatttctattcaattagtggagtaatttagatttttacaagattaaaaattatatagagatgagtattattgatgacctgccctcttcacagaaatagccaacactagatatactcatgtcctcatgtcgtatttatataacattttcctcataaatttaataaccttcttactgtttgtcctccagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacaggtaataatacactttgaacttactatttttatcagcaattttcattgacttggcaagtgtcataaatttaaaaaagaagaattaccatctgtttccatattcatcagggacaaaacaaaagaaaataaataggcactagggaaatttagatttaatgtagttggataatggaagttccttaagatctttaaggaaaattaaaaaaaaaaacggttagctttggatatgagagatggtgaatctcattaacatgcaggcagttcctcattattatgcctggaattggtccttgaaaggaactatttttccattggtgaatgcatccctgagtatgaaggattaacaggaaggaagctatgatgcccaacttcaattaccagcaggaaaccctctataccttttaggggcagacttacctttcaatgacttggctacctcacagggaatttgaaccagtaaactgacctttaaaagtcaaatcactgaattcacatgatgatcttgttagtactgaaaattttactttatataaaaaaatggtttcttagcatcagaaaaaataaaataatctgtcagtagattttttgattaataggcttgaggcatatattttatatacattttagctggtgacttggaggtatatataaaactaaaacaaaattagtaggagtttaaattataggtatacattaactattattacgttggaattgaatccttattgtgtttcttcatttaagagtaggatgggcacagtctcacacttttacctaaattgtacaatatgagactattcaacatgtggaaggcttgagcttttcaaagagaagttgtatatatggaagggagttttacttgttccagttgcctgcccttacctgcctttacatatgtttcccttgatttttctttgtatgttagaatttacagaagtgctggacctttcttagagaagcgtcctagttatgagcattcttttttatgagcaagctcttttatgatattgataaaatagaataggaagatgttcatttggatggtctgggtctctgttagccatgtgcctggtgagggatctgtactgagtgttgggtgcagagaagggggaatgccaaaggaacgtgcttgctcttccttctgctggatatctcttccggctctttgcatggctggggtcttctcctctctgggtgtcacttaaaatgtcatgtccactggaaggcttttcctgactgtcctacctaattaggtcccctttcctggttattctccattctcccatttttccttaccaccagccccatccattgtcaatactgaggccaaaccctatggactgtgtctgtggactgtgtcatggaggcccccttgccaggtagcttctgatcaggttctgccgataggcagcacaagtagaagattggaaagtgggaggagaaagagggtgggtgatttcttctccccttcctcttcactttggatcatggccctggctgtgagtgcctccctccataacaggagatcctgccaggtgacacatcctccatagctccagctctcactggactctggcaatgtcatttcttctccttgcctcttgatttcagctttctgctgttacaacctctggatgcctcagtatcccttgttcctgctttcaaccctgcccatacctctgtaagttatttcttcattcatatttctttatttgaattatctaaatggaatactttttttttttttgtcaagatcccagatagatctccccagttaatcaggattttaacactttggttttttcttcctaacacttatcacaaccctaattattaattaattttgctaacttgtatattttctatcctttcccactagaaggtaagttccaaacacatattataatgtcaggcagcaggaaggtgctcaatgaataacttactggatgaatgcatgttgcatggatggatggatggatggatggatggatacagtgaataagtttcgagagtcataagtacccacagagtcagaataaggagatgagaaatagagagtaacaaaaatatgtttacttttatgtgttgtctgaccatatcattagcctcatttccatcagaaagcctttcagtatttatttctctgaagtgtcacgctatatgccatacagagcaacttgaacatgtttagtgcactgaatttaaaaggaaaaaaaaggcatcagtacattacagagtgagtctgtgaaccaataatactggcttattaaatgtgataatttgcagcttcagtagcaaagatgcattaaaatcataactcattgatctgggccatgtcaaggccatatgctaccaacaaaatgacatatctgggcagtctgtccatgtgcctgtcagatcactcccaacctcatcaccgccattttgtacatgttactgtgcctcttgtcctttaagtcaccgtgaggctaggtaagaactccagctttacctgttctctctttgaccttgtcaacatataattatatataagtgaataagtcttgaggctaagaccattcaagctattaacctgcaaatttttttttctagagttaacacacctgcttcatttttttttttttttttttttttggtgattatgttgctctcctttttttcattaaaaaaatttattttatgaaaatgcaaattatttaaaccatatcactaagtttgtttaatattctcagagagagttatgcagtttaaaaagcaaacaaggagatggttatttttttttcctatctttggtattttcctgcattatagtgattgtaaattgttttctaataattccccatactcaagcttcattctttttttgtcttcctctacaagcacagggtgaattttattcttgaattttttctatgtttccttaatattttattcccagctaattgtaggtggctaatctgaaaaaagaataagaaataattctcaaaaattttagctgagaatccaaaacaaatgttaagaaggagcttggagaaatatgtgtgtgcgtgaaagatgcatgtgggttaaatattcaattacaggaagtataaaaatgtcctttaaaattcttccctttgctaaactgttgtttggtcacagagtagaagagaggacatgcctttccctgtggcaacacccagtgtcacacagcatcagcccagccggattctccagggagggtgggaggacagctgtctcagtgatgcttccagttgtttgataacggacagacacggtgcctaggagccctgtgaagagaaccccaggacactttgtccttgtccctctgaagtggcatctgggcagtacagacacttggattattagaggcatttccatgggtgccaacatgtgttctcagtgatttcactttctaggcacaggttccataggagggaaggaaggaagtcagtaggaaggaagagatgacaatcagcattttatacctaaaacactgtgcaagtgttagcccaagctgatacagcagagtaacactagtggtaataatagaagaagtaaaaacagtaatgatagcagttataatagtagatagtagtaatgatagcagctaacactttagtagcatttactgtgagtcagacactattctgggtgctttgtctgtattgattgcaagtgtttaaaatgtatggcaactctgagtggtattctttttatgaggaagaaactgagaaacaatgaaattaaataacttgcccacagtcacatagctgccaagtagtagaactgtaatgcaaacccaggcgatgcaaccctggagtcagtgctcccagccagttctacccaaagtggattctgaggattatgcttgtctgcaagctgtttgtcaccagtctgctatgagacgtagagaatttaggagtgagcatttagacaattttttttagcattttgacattgtctgttgaatccagtaataaaaaattgggcctcatgttttgtatatctttgtgggttttaacatttcttttttctagcaattcatttttatgttttataaaagtatcaatgtgcaactgattggggataaaaactgggctctccatagttagagaagaactgtctaaatcccttacttttcggtactgcctcacagagaggtaaagcacagaaccatcacttttaccccagtgcctaaagcatttttcaatagatagatagaaaagtgcagatatgtgttacagttgggtctctcctaaatccccagctcctagaatagtgtctgccatagaggaaacactcaatatttaataaatggatgaatgaatgagtgaatgaaaatgaatgaatgaatgatgacttccttagtaccaggacatggctgtgttttctgcgcatggtataaaactcatggtcttgggtttaagatagttaatggtgctaaaattaaaatgtcacagttcttatgcctctaatgctcccaggatgacagcaggattggatacatctcatggtcttaccatttgagatccctctgttgccatcactttttctgcagaatggcctccacctgttgcaaggaaagcatgttgattcaaactaaggaaatacctgaagagaaattattcatttctcctgagtcagattctgaacacggagttctggaaacagtccattgaagtggataccatctcatgctttatatatctcccagagtacaaattattcattccttaaacatgaggagacagacggaactgattcagttcatttccctggtttaccattgatttggagatgccatttaatttatttcttctttggtgtctccatctgaaaaaaagagcgaggggactaatgcttaaggtttttgaccccttacccatcaaattgctgaataggcaactatctatgtgaacaaatggtacaagcaaactttcttcctctatcaccaatggaatatgccatacccttgctacttagagagtgttctgtggccaagagcatcaacctctgatgagtctgcatttgtatagaatctccagatgatttgtatatacattagagtttgagcagcattgccttataccagtgcaaaagcaagtgtggcccatggaccgggagcatcagtgtggcctgggagcttatgagaaatgcagattcctgaacctcactccactctggaaatctctgttcacaccagccctctaagtgattttggtactcgctaaagtttaagaagcatactcttaacataacgtcgtcatgatacccagcgtgaagttaggaaacgggatctaatgttgtggggttttagctttgtggtgaacaacagtagtcattttttaaaaagtattcagctttgtttcatgcaggcccaggaattgtaaaaacaatatttgctgcagcagcagaagctgcttcctagtctagcacattgattttgcaaagttgtttccaagtacaggatgagcctacattttctggctcatgcagggcaatgtgagacagaggcagcttttctaatgctcaggcttaaactcccacatcactggaggaacaaacataagctgtgcaagtacaaattctgggcaatcttgaaatgtttagagcatattttcattttcctctctgccccagtatttgtcagagtaacttttgagaagtgaaatggctagaatccgcctgcaaacaccacactgtcatctcttcctctgccagctgcactttccacttatatctgcagacttagagcagtgattctcaccaacgctacccattagaatcacccaggaacttcctaaaaataccacttcccaggtcccattggttgctcaggggtggggcgtgcttgggcatcagtgtttggtatgatgcccagatgatcccaacatgcagccagaatttgtacctctgtccttgatctttctactccatcgtatcagttattgctggcagagagagtacatcaaaaattattgttgaaggctgggcatggtggctcacacctgtaatcccatcactttgggaggccgaggcggatggatcacttgaggtcagcagttcaagagcagcctggccaacatggtgaaaccctgtctataactaaaaatacaaaaattagccaggtgtggtggtaagtacctgtagtctcagctacttgagagactgaggcaggagaatggcttgaacccgggagctggaggttgtagtgagccaagatagcgccactgcactctagcctgggcagtaaagcaagactgtctcaaaaatacatacatatatatatatatatattatatatatatatatatatatatatatattatatatatatatatatatattttatatatatatatataaatatatatataaattatatatatattatatatatagttgaggctttatttaatgcagccaggtttgtaaaagactgctgtgttggatactttgaaccaagccttgtacataagccttggaatcagacacaaatggatttaaatctcagccatttcatttgatagctttgtggctgtcaccaaattgcttaacttctctgtacctatttcttcccctataaaatgggaatcatagaatctgtgtcacagcaacactccagtgattaaatggagtaatgggtgtaaaacatgccctctccttcctaccccgggtcacctgtgagcaggtctctgcgttgactgctttgatgtgttacctgcctggcccttaacgcctgccttccttcctgaactctactgactgcgccccaacccctgccctctctgcccacattttcaacctgcgtcttcttctcatcaccagcttgctgtttacgcaccttctgttctttctactctagcacccagctggtaacttccctttcctgccttctactaccctggtgtgacagcaagagatgatattgtttcacctgctttctccttttcctggagtttgtcagctggccatttattagcagcagaagcagcgtgcagtatttttgtccattaaagctaggggattagtttcctagggctgccatgataaattaccgtaaacttagtgccttaaaacaacacaaatgtactcttgcatagttttggaggccaggagccacattccctccaaagctctggaggacgatccttccttgactctttcagcttctggtggctcccgtggatttttggctctggcagcgtaactgcaatctctgtctctatcgtaacgtggcgttctcccgtgtgtctcctatgttttcttttctggctcttgtaaggatactttcattggatttagggtttgtcttaatccaggacgatctcatctcaatccttaccttaattacatctaaaaagatttccaagttaagtcacattctgaagttccgtgtagaattttggagggagacactattcagtccactacaactcataactagaatgcaatcgattcagtttgctatgttttccttgacgactctctggcaggaagcagtgtggaagtattgccattggctagtctgggtggtacacacctgtaatctcaatactttgggaggccaaggtgggggtattgcttgaggccaggaattcgagaccagcctaggcaacatagcaagcaactgtctctaaaaaaaaaaaaagaaagaaagaaaaaaagccaggtttcatgatgtatgcctgtagtcccagctactcgggaggctgaggcaggagggttggatcacttaagctcaggagtttcaggttgcagtgagcaatgatcatgccactgcactgcagcctgaatgatagagtgagactctgtctctaaaaataaataaataaataaataggtattctgttaaggcagtaggcccaggatggtctaaattctagatgtcaacaaggttcaaagtgaaagtttttggtaggctgagtgattgctggagctcttactgaaagttggtggacacagctacttacagtataataatttgctagagataattatactgctgcccaaacctattatctccccagccaagctaaggcactgccagtaacttcttctggtttcccgaggaagtgtggccagcagcagtagcgtattgttttcatcatatcacattatgttcatatgaagaatgttgcatttgagtggcatttgcatcacagccagttgttgcccttccactctggtagagaatagattcagcttttattagtgtaaatagattagtcccatttaaggtctgctggaagtcattatgaaaatcattaggttgaaaagagaactgatcaattgattttttttccccctgtaagctctgagagatggtgctaatggtctcactgtgctaaaataagtcttagaaccaagatgccttggggtctaatctgattcttcagtatttatcgatacctaaagaaacattaacttatcactcatagttttgattttctttgcattttactcttgttattttatttattcactaacagtattattttgcctcttcatgtcaagaataatgacttgtggctacctaagactttattgaggaagatggagtggaagatgcctgtgttcttgtctttgtttagattgtccagcactcacctgttcacttccaagataccagagcaaattaaattttttattgctaatagagacttttgggatctgataacattcgtccatgttttcagatcatttttatcaagttgtgttacttatgtattgttaattctattacttatttagtacattttaattttgtagttttgttgtgattcttcatagccatctttgaaagtgcttactgctacatttcatcatggtgaggtgggaaatgcatataaaacatagatttggtctccataatcatcagctcagtgaccttagacaagtccaagctacttgtcttgtctgagcttcccctctctcatgtataaaatgagaatgacacttgcccagacttcctccaaagactaggatgagaagtactatggtatcatggattcagtagggctttatgaagtcttctacatattgatctgtttcataattattattagtggtccacatacccacatgattgctccattcagaaaaaaaatccaacagtgttaacaggagtggtgctaagaaaacacctacatgaataaaaatattttctaccaagtagaaagcctcactgatatttactggtttgtttcatatatgattagacaaccagtataagaacctggcaatattttttccccagtttatcacaaagatgttttaaatatacaaaaaatcaagaaaaaaatgtccagtgaacacccacatactcaccacccggattctaacattaacattcttctatatttgttttatagcataaccaaacctggtcattttgattcctcttcagccttcacagaaatgaattctgcgtcattccctgagtaccttaccatggtgctgttcccagtattttaatcttagaaaatctgaacatacaaagagatacattaggtaagaaagtagttgcttcaaaagagtatttattttctaaaagtactcatccacacatttccttcacatagtgtcatggaataggaaattgaccagctcattcttatgattaatctataagtagtgcctttattgatataatattacaaaggaacttgtcctcgtaactgttgatgaagaaggctgtgagttgagccactgagagatgattttttaatataccggcagaacaggcccattatatgatcaaattgaatttccataaatatcattaacttattgtcttacctttgaatgaaaaagaaacaggatctcatctgactagctggttttcttagagaagttcctagttaactagacttctgtaagtaactttctgcaaagcaatgacagaaaaaaattatttaactatatttaaactagcttctatataatatagccagctagggttttggaataataacagagggactagagataaacattattttcatttgtcttcagaaaatcatctgccaccaaccttacacattttataaggatccttaatgatctcagcattttttatttttgaggtcaaccattattctgaatgttttcttcaacaatctatcatctctcataatgtatttggaacagattttagtttagatgcaacttttaaagaattcatctactacatctgggttacgaggtcagtttaaaaagaatgaactggaggactttatctccttgggtagaggagtcatgagggactactgaatgagaaagtaattatagtcagtgacacttgtttaccagttttgcttggtgccaagaaacttgtctgagcacgaggctgtttcagaatgacatcaatatagggataacccctgggttttaaaggaagtctctgagattactttctatcatgagtaaaggagccccactgatggtcgtcttagttgtcacctagactgttctatgaaacagggcttatttggggtaagcattttgaggttttgattggctactgtccattttgatcttgtctcagcccactccttggtggataagcaggagagaaggtaatgccttatgacagatctgctgacaggaactgaaatacattaacactctgtcactcagatctttagagggctgcctttgcctgaaatatatttgactttacttgctaacaaaggcatcttcagatttatttcttttccttaaatgttagagaagaggaagagcgtcccattgaaagatactgggaagagaaaagcctggctcgacagcccaagcaaatgatagttagcattcttgggagcagcagaattgctgatcgtgcgagattactagtaggagccagatgagtgtagacagagaactgctgtacttaggaaatttttgaggttcttatcctaagcagtttttgccctatgtggatgttgcagctctggcttaggatgctccagtgagaaaatgaagagagagaaacaagactatctcagcttcaaagtttaatggccatttaagattaacatttcaagtaaagcagctgcttttcttcatgcttttcaaggatcctgccctactcaaaaacttgtgtgtacttaatcttagcatagacaatctcagatgggctggtgaaacctgatacatctcttataacaagagtgacatgacacagtgaaagaatttccaccattgaaattttaataaaatgaaatgattaatatttattcgacacctgctttgtgctattgctagacaaggtgatgtggggatacagaataaacttaaagcaagacttcttcttctcaggaatttagtagggatcaattaattaggaaaccggaattcctcacacctacaaatccaagaacagtaaaggacactttataattgagtactgaatgtgatggtttagaagattttcactataagagctgaggagagagacacagaaggctggaggattcaagagagaccttaggcaagaagtgggccctgagtcactgtaggatgtgtagaaacgaagaaggcagaggagaaaagtgacctgaacaacagtcacaatgtaagcaaagacacaaaaggtaaaactgaccatcgcgtgttcttgagacagtgagagtctaaatgagtgaaggaatgaaaggagaatgagaaataaggttaacgggggcacaaaactctaccagggaggtctcaaactgaacacaccagtttacttttgaagtgaaaatgatacagaatggtgaaagtttttagagaaggtgcatgttcaaatggatgcacttttaaggagcactgggccttggcagttcagacaggattaggaggcagagagcctggggtcccagaggcagctaaggcagggatccactagttccgctctgaaggggagacagaaagttttatgtgtttctctccagaccaaagttttgggtgatgacatcatggctgcctgagattcagtgagccacaacggtgtgctgagcttagcatttgtcatcagtcttttgaattattgtcctagttgaccacactaccccaacagtctgactttctcggataaatattgcacttctgaatctctgtgagggtgttccctgctgagccctcaaaggcatgaccaaatggggttcatcctcacctctgtgtccacaggagcagccatcttggctttagcacactcacgtttgtttaaagatgaagctgtacatttctcattcattgcttttttagacacacaggagctctgtcagttaaagtcctgctttggggaaaaggcagcatgcagccagttcattaacaggttatctatgtcattatgtcctttttggattgtgcatattggaaatacagtcttttgaggaggaaaaaaaaagccatctaggcttctagtttccctttctttttcttcttcatttttatctccttttttcccctttatagttacagctattcccctgatggatggtcatatctgtagagtccagaataccctgagtattcacttgcaaatagctacaaagtcaaatacagataactacacttaaatgagagctattctctacctctcctcactgcacacacactacttctctttgccccatttcaaccacaggagcttaattgcttcttccttttttttccacaaacatttcggaatttgttgtccccttggtcatttcaaggtcaaggctgcctatcaggcactcgcagaagtgctccggtgaccttgcttgctgtgtttgcccatggcttctgacgctttaccagagtgagcagcctgcccgagcagagagtaggctggcctgccagttaatttcttgcctcgtgaagaggaggagtacacttttcttccagcctttcaaaatgttgctttagagccaaaagaaatcttcaacacatagtaggcacttacttgctaaatgaataaaatgaaaattgccaacagctatgttaaagtgtggcctctagcttacgtgtttaggggtagggtacgtaaaagcaaacctctgttgtttgccaaggaaaggagtatcaaatatttgtgtttgtaaaaaataaactgtttatttcagagaagttatagatttatcaaaattgcaaagacagtacaaagagttcccatatacccccactttccctattatattaatatcttacacctatattactgtggtgcatttgttacaattaatgagccaatattgacacattattattaactaaaacctataccttattcatactgccttattttgcgtatatgtgtgtgtgtattttttaaacttaatgccctcttgctgttcgggataccacaatacattttgttgttatggcttcttaggctctcttaaatgtgatagttttctcactttcctttcttctgatgaccttgacagtttttttgtttgtttgtttgttttgagacagagtctcgctctatcgcccaggctggagtgtggtggcgcgatctcggctcactgcaacctccgcctcccgggttcaagcaattctcctgcctcagcctcctgagtagctgggattacaggcacccgccaccacgcctagctaatttttgtatttttagtagagacggggtttcaccatgttggtcaggctggtctcgaacccctgacttcgtgatccacctgccttggcctcccaaagtgctgggattacaggtgtgagccaccacacctggccgaccttgacagttttgaggagtgctggttaggtatgtagtagaatgtagttatgctctacttccttaacgatggagtatcagtataaatgatttagaatgcttctacatgagagagctggctgttctccttcatttttgtaattatttggttatttatttgtcagtatagacttatagatttgtattttatacttggagttataatccactttattttgctgctgaaatcgttctagctttggacatcagtaacttctttgactggcttctgttatttcctaagtctccatctttgtgatttttttttttttaagcatctccttactttctggcactacaaggtgctcctggctcatcttgtatattgcctgccccagccctagaatcagccatttttctaggaatcctagttccttttattagagactagcattggaaaacaagatctggagttttagaatgtttcttgtaacttgagtatcattatttctaggcccactcagttgacactgaaaggaaacatatatgtgtatatactaacccttgaatatattcatatccgtatatatttctatatgtaaccatttacgtctgtattaagctaaaaacgagttcatactgatgtctccaacactaatctataactacatggagcattctagcctcctctcggttaggtgtgacctacctttccctcagtgagaaacctggctcccaccatctcccattaatttacttaactgtatacatggagtctagtatacatgtgtagcaataacacagtcattcaattacagtatatacgtatagcagtgtcagaatagttaacccatacccttgtgggaaacaactttatcagctagtatacagtgcttttatagtttattttgcctttagtcttatggactatactcatttctagtgttacttaggtcagtaccttttctccctacacccttcaaagacattgttttacacatttgtaatagttagacggttttgtcacattctgcactaaatcctaggattccatgatatcccaaatgatgtttttaatttgcatacattaatgttcattctttgtgctttaaagttctgtgagttttgacaatgcaaaatgttgtgtgtctaccatgatgatatcacacagaatggtttttactaccctaaaaaattcccatgcttcacctattcaacatttctctctttttaagactctggctgtcactgattttttaactgtctctatagttttaccttttccagaatttgtatcattggaatcatacaagaagtagctttttcagactggcttcttacactcagcaatatgcttaagattcattcatggcttttcacgacttgataactcatttcttcttatcattgaataatattccattgtattgataaaccactgtttctaaaatacattcacatattgaaggacatcttggttgcttccatttagagttattatgaataaagctgttataaacacttatgtttagttttgtgaggatataagctttcaaatcagttggtttttttatgtattgaaattgtaggggtcagtgggcttgtggtggtggtaggggcagatttacaagtaaacaagtatatcacaatggtaagtgctttcataaaactataaatataacatgtaaactgttgaatctacataagaaaaaggcaaaagtaaaaatacttaaatcattcttaggctctcctatagaaaatataatatttagcagttctttccaggaaaaacactcccttaacacacacatatgcacacacatgcacacacacatacacaccccaaaccaacctaacttgctgtagacacactgttaaagctctagcaaagaccacaaggcaggtggtagactctgcaaaacttaacacaatgatttttcttcttccaactcaaataataggagagaaatttcacgtaaaggtgaataatcagtccctgagaaggaaaaaaaaaaaaggcctagggatgtttaggtatctggaaacctggaattgattaataagacaaaagaacaaatatagttattttaccaagtcatttagagatagcaacaagtcatttttttctgggatttggggttcctcccagatatttcttatagagggagctaaacccgaaggagtgtaccaaatagtaaatgaaatcttcctttgtcaagagctaactaggagttgtttttgttaagcttctgggaagagatggctttgaccaggtggccttttagaggcctcttgcttccagcttgcacacttttgtttggttggttggttggtttttgaaacagggtctcactctgtcacccaggctggagagcagtagtacagtcatggctcactgcagccttgatcttctggactcagatgatcctcccaactcagcctcccaggtagctgggaccacaggcatgtgctaccacacccacctaatttttttgtattttttgtagagacagggttttgccatgttggccatgctggtctcaaactcctgggctcaagcgatcagcttgcctcggcctcccaacatgttggatttatagatgcaagtcaccgtacctggcccttgcacaactttcaatattaggtggctgattcagctgggccagttagaacctcacttatataccagttattggtgaagaaggtagaatagagaaagagaagtatgtttaccgcctagcagatggaacacacaggaaggggtaccaagcacaccccccttgaatgcacagtgacccctgcatattagtaagatataatataatctcagaggcttgactagattaaaaagctgtccttatttgaagcagaattgtgggatatgatgaggtttctcttcaaataatctgatcaatcttttattctttaattcataatactctccaccccttttccctttttctcctttttttcctttttgcctttgttagatacccaggcatgccacagtaccagacattatcagtactggctcacattccttaccttatttggaaagaggactaattttctagctcattacagacaccccttccccttcctctccacttccttttaagtgcccaccttatcttaaaaaaatcaaatgtttagccaaccgggattagtttagattgtacaaccttaccctggccaatgaggaaagggtatggggcaggacttgcatcaggaataaagactctcgtacccctttgttcaggtgtgctctcatggcaactggccaaggaggcacccctctgcgcagaagtaaaattgtttttctaagaatcctttgttccagtgttcaatttcgttaggattttgagcgttattcctaacaagaattaatagggtggaaggagtatgagcagaggcgccaaagtataagtgcagaaagaactttctccaacagccagcatgacaagaaatttgtaaacagcaagtgatagaagtgttttgatacatagaacataaataataggaaatttaagatttctctttaagtgaatgatatagtttggccgtgtccccacccaaatctcatcttgaattgtaactcccacaattcccacctgttgtggaaggaaaccagtgggaggtgattgaattatgggttgggggggtctttcctgcactgtactcatgatagtgaatgagtctcacgagatctgatggttttagaaatgggaatctccctgcacaagctctctttttttgcctgctgccatccatgtaagatgtgacttgcacctccttgccttctgccatgattgtgaggcctccccagccatgtggaactgtaaatccattaaacctctttcctgtatgaatttcccagtcttgggtatgcctttatcagcagtgtgaaaatgaactaatacagcgaaaaataaaaaagtcagagataagttataatttatgttatagtcatgaagcccaaatatctgagacaggtctcagtaaatctaggaagtttattttgccaaatttaagaatgtgtgcccatgacgcagcctcaggagattctgacaacatgtgcccaaggtggtcggggtgcagccttgttttatacattaaggacacatgcaacgtcaatacatgtaagatgtacattggtttggtccagaaaggtgggacagttcgaagtgggacggggctttgtgttcataggtagataagagacaaagggttgcattcttttgagtttctgattagcctttccaaaggaggcagtcagatatgcatctatctcagtgagcagagggatgactttgaatagaatgggaggcaggtttgccctgagcagtttccagcttcgctttctccctttagattagtgaattgggggtcccaagatttattttcctttcacatagtttagttggtgaatgtttttaattagtccctgggtaagtatatttttaaaaatcatgctatagttcatatatttgtctaaagtgcattagttaaatatttatgtgattatatatttatattgtcggctttttatggagtcattttatagaaatcatcataaatgaatggaatggaagctatctttactctttctcaaccagctttatctagggaaaaccaagctaactggctcatgaaactattgaccagattaacttcatgattactaacccaattatagaccttgtgcctgggtagaaataattaattgccttagtgctagcttagcaaatgcaaatacctcaattagtagcaaaaattctatgcttatttcaattctgtttccttatttctttcaggttctggacatgtaggcacaggctagtttacttacatgatggaaatataatatagcagacaggcaatgttttaaccaaactcatacacatgggataattattctaagtcataaatctttttaataaaagcctgattgtgtatagttagcctacattattaattttccccagctagcattggtattctctatcatataaaggctagacttcaatagaatgttaaggctggaaggtataccttggaaattaatttcttcgctggagtcaagttcaacacattaagtgctttgtctaagatgacatatctggtaaatagcagatccaatagtagaatctaggcccttctccttctggccaattctatttttgttctacctgttaacctttcatgtgctggatggtttatttatattggattttaacagcaccgacacttgtactgtaaaataaatattttgttctgctgaagttcccgaaaagtaacatcttaaaccacctcctacttagggtgactttgcctttccttttgctcctctctctaaaggcagaacacgtttcactccaaaaccaaataacgcacatttctctcctaatttatggttttcaaaatttcagagtgtttttttttccccttgctgtccagaatgctgtctgaaaagtcacaatgatttaaataattgatggctactttatgaaatcgtcagcctggatccatcctcctgcctccctcaaccgcaagtccttgagcagctaatccttttatgttggatgctttatttttcccttcctggtttcatttagataattatattattcaccctggaatataattgccgttatactgtgggggatgtgggagtgaagtagggtgggagctgcctgctgctggcatctgcaggttgtaaaatgtctgttacactctagcctctaatttttttgccatcccaccttttaaagatttaattatacctgtgtaaaagcataatttgaaatctgacttattattcttttggaagataaaaaagattaatccattgttaaacatgaataagcatggtacaatggaaaaaactttggcctggaattcaattgaactaacaatttttgaatgcctactatgtgccagggacagtactaaaaattaggaagtgcgaaaatttaaagaaaaggactgtcctctaggagggttcatcctggtgatctcctactaacttgtgacatgtctttgcacagtacacttaatctgtctgggcctcaattttctcatctctaagcagagggtattggacctcttctgcattttctcctagctctaacatttggcagtgctccaaaaaagaccataaaatagcagccacattgcttctttgtcagatttaattggaagaatagggagtggtaaaaggtttaaattttctgtggcagaagtcattttgtcatctgtgatttcagctctttgacaaatgattcctttatcttgaatgcattttcttcctgctaagtcctccatgcccaaaacagggtgtctttggaggcagaaggtaacaatctctgagtaactgaaagttatcaaagcaacaaaactttctctttcagattattgcctgacatcttcttagctcgtgaagctgtttttccagtgaggattctaattctaacgtggttttcacaagcctaagtttcactgtttattggttagaagagagagtcacaaaaatgggttttgttcttctttgtatgttatggttttctctttggaggtgtctaagttggataaggtaaaacttcctaactcaaaaacttagaaaacttaaggatattgaatgtaaatacagtagagcaggctttgcaactttaagaggaaatgctgttcatctctgtcagacccttacagcgctggataaagtaaaccccaaatgacagcatatagcctgttacaaatggaacacaaataacacatgataaaatagagatttagagtggattttataacatgtttattttcagggagcaaatcataacccatttgccttattggaaaaacaattttcctgttacacagggagaatggagtatttaaaaaggaaatgaatatgacaaccaaatggacttgattgaaatcagcaaatttgtttcttatttactcgttgtttttgtactagagagaatgatatggggcccagaccatctctcagcggtaatggttcttttatgaaagaaagaaaacaaaatacctagccatctgagttaaagtagttttcacatgtcctgtagtctctaggggtataaattgatgctgtttaatagaaatctctccccttcatctgcaatattaatgtgttccctaatttgtaatccacttccttttctctcatctttataaaaatctttgcaagcagccctcttctctgctgcctaataataaaatattgtgagtctagtaataatctcaccccctttttggtgagtttatttctctttataccagtgcttctaaagttttaatattcactttcatcaccaggcacatcttaaaatgcacattctgatccagtcagtctggttgcagcctcatgttttgcattttgaacaagcactcaggtaatagctatgctgcaagtccatggtactactttacagtagcaaggctgtagaccaggagtcagcaaagtttttctgaatagagccagaaagttaatattttcagccttgtggtttatatcgtctctgtttgattgtgccatcgtagtataagagcaatcatagataatatgtaaatgaatgagcatggctgcatttcagtacaattttatttacaaaacaatgtggcagctggatttggcttgcaggctgtagtttgccaacccctgcttaggcaatgtatttgaagtgatttgttgttatttttaatgtaaaggttgtcatccatatgtctacatgggattgttttataatggtgttaggcatacatacaatgagtagagtttcattcatggtatacctaggtattatgcaagaaaaattttaagtcaattaacaagataccttttttcctctagagaacttagaataaggtgagaggcataatggcttagctctattgtggcataatagtgccagcgttttgaaaaatcacttctttggcaaacagtcgtttatacttgtatattgctgtgtgcctgcctttccccgaactctgactttttcctgcatatgtgcatttcttttatcccatcccttgccatatcatttggctctgatcctatttggataatgagatagtttgttgtgcctgcaatgaagaaaatgattttaaatgttttttaataagttaacaggagcaagtcttgaaattactgtaatgagataatgacagtgtagcatattgctttgaagattgtgctctggtgaaaaatgtatgctcttaataaattcattttcactgtattttcctcaacaaagttgtttagcatttgcctatttgcctaccagtaatagggaaatggtcataggagttggtagtcaataaagaatgaagaccaaagttgatactcaagtaagaattcttttgagctttaaggtatcagccatggaggacttgtaccaagaccggaatcctgtagtgacaggtgctttataggaatattaaaatccagaacctcagaccactatgttagtttcatctttttaatttgttcattactgcagatcacatgtatttcctttctttgaagttctaagtattacacttgaaagtttctaacagttcatgcacttatttagccaacatgtatcatgtgtatatattcaatccatagcacagtctcagacactggggcaacagaggtgaaggagacctgagtcctgccctcaagtttattagagaagggcagatatactaataaatcaatgttatatctgccatgatctacacatgtatatgacacattgggagttcaggagacagtggtcagttctaccttgaaggtcattttaaaaagattccataaagaagatgatgcttaagctgaatctagaaaggtagatagattccaaataaaggaaaaagtattaacaaagatatagtggcataccttattgaggggaatagatacattttcatatatacctataatcgaatctgatacagcagtgagagtgaatggatgtactgcatgttatacatagcttgcatgaatctaacagtgttgaaagaagcaagacacaaaagaatatgtaaaatttgattctattcgtaacaggcaaaattaagctatatagtatagggatgcatatctaagtggtaaaatcataaaggatagcaacaacaacaaaaatctattacaaaggttacctcagataggaagggagaagattttgattgggcaggagagcacttgggataatggaaagttttatttattattttttattgtattttatttatttatttatttatttattttgagatggagtctcgctctgtcccccaggctggagtgcagtggcgcaatctcagctcactgcacgattctcctgcctcagcctcttgagtagctgggactacaggcacgctccaccacacctggctattttttgtatttttagtagagacggagtttcaccatgttggacaggatggtctccatctcctggcctcgcgatccacctgcctcagcctcccaaagtgctgggattacaggcgtgagccactacgcctggctggaaactttcatttccttaccaagtttgtggttccattgggtgttacctttatgattattaagatgtgcattattactataaactttgtcttaaatgtgttatgttgtatttcacaataaaagagattttttaaaagacagtgagggcctgaataaggcagtaggaaatggaagaatgggtattgtcataggccattcgggctgccgtaacaaaataccacaaaatgggtagctcataaacaacagaaacttaattctcactgttctggaggtggggaagtccaagatcaaagtgctggcagatttggtgtctgatgagggcctatattctcattcatagttggctgccttttctctggaacctcacagggcggaaggggtgagggatctctctgagggcactaatcccatttcatgagggcactaatcccattcacaagggctctgcttttataacctaatcacctcccaaagtccccacctcctcatactgtcaccttgggggttaggatttcaacatatgaatttgggaagtggttcataaacattcagtacactgaagatgtgaagggtggtaagcattagaatcacctggccactgataggagctgggaagccagagtctaccatggttcccaggttttttaatttgttgactaggaagatggcatgtgctgagatggagaatatagtatccacaatgggcaaggctttttctgctgcagcttttttttccttttaggtccattcttattctacaaagaggttatttttcctgcctccttcctcagataggtacaaatcagtaccatttccaccacagtcctgccaagaaaactactcagttccccatctttatgtatttatttccagaaagttctttttaaactgttattttaggttcaggggtacatgtgcaggtttgttatataggtaaattgcatgttgcaggggtttgatatacagattatttcatcacccacataataagcatagtacccaataggtagtttctcagtcctcaccctcttcccacccaccaccctcaagtaggtcccggtgtctgtttttcccttctttgtgttcatatgtgctccatgtttagctctcacttataagtgagaacatgcagttttgattttctgtttctgaatgaggttgcttaggatgatggcctctggctccatccatgttgctgcaaagaacgtgagttcattcttttttagtattccacggtgtatatgtaccacattttctttatccagtttaccattgatggacatttaggttgattccatgtctttgctattgtgaacagtgctgcaatgcacatatgtttgcatgtgtctttatgttagaatgatttatattcctttgggtatatactcagtaacgggactgctgggtcaaatggtaattctgttttaagttctttgagaaatcctcaaactgttttccataatggaagaactattttacattttcatcagcagtgtgtaagttttcccttttctccacaacctcaccagcatctgttattgactttttagtagtagccattctgactgatgtgaaatagtatctcactgtgattttgatttgcttttctttaatgatcagttgtgcttagcattttttcatatgcttcttggccacatgtatgtgtactttcaaaaagtatctgttcatgtcctttgcccacttcttaatggggttgattattgcttgtaaatttgtttcagttcctaatagatgctagatattagacctttgttgaatgcatagtttgaaaatatttttcccataatgtaggttgtctgtttactctgttgatagtttcttttgctatgcagaagctctttagtttaattaggttccatttattgatttttgttttcattgcaattgcttcgttatgaaatcttttccaggtcctatgtccagaatggtatttcctaggttattttccagggtttttatagttttaggttttatatttaagtctttaatccatcttgagttgatttttgtgtatggtataaataacgaaggggtccagtttcaatctaatgcacatggctagccagttatcccagcaccatttatcgaatagggagtccattcaataaatgaacaaatttcttcattgctcatttttgtggattttgtcagtcagatggttgtagatgtgcagcattatttctgctctctaatagggctctctattctgttccattgatctgtgtgtctgttttggtaccagtaccatgctgttttggttaccatagtcttgtagtatagtttgaagttgggtattgtgatgcctccagcttcgttctttttgcttaggattgccttgactatttgggctcttttttggtttcatatgaatttttaaatagtttttttttctaattctgtggaaaacgtcattggtagtttgataggaatagcactgaatctgtaaattgctttgggcagtatggccctttcaacaatattgttttttcctatccatgagcatggaatgtttttctatttgttatgtcatctctgatttctttgtgcagtgttttgtgactttcatcgtagagatcctttacctccctggttagctgtattcctagtattgtattctttttgtggctattgtgaatggaattgcattcttgatttggctgtcaccttggatgttgttggtgtataggaatactactgatttttgtacattgattttgtatcctgaaactttgccaaagttgcttatcagatcaaggagcttttgggcagagactggaattttctaggaatagaatcataacatctgaaaacaggaatagtttgacttcctctcttcctatttggatgccttttctttttttttgtctgattgctgtgtccaggacttccagtaatatgttgaattggagtggtgagagaaggcgttcttttcttgctccagttttcaaggggaaggcttccagctttgctcattcagtatgatgttggctgtgggtttgtcatagatggttcatattattttgagttatgttccttcagtgcctactttcttgagggtttttaacctgaagagatgttgaattttatggacagccttttctgcatccattgagctaatcatgtggtttttgtttttagttctgtttatgtgatgaactcacatttatttatttgtgtatgttgaaccaatcttgcatcccagggataaagcctgcttgatcatggtggagtagctttttgatgtgctgctggattcagtttgctagtattttgttgaggaccttggcatctatattttattaaggatattggccttaagtttttttgttgttgtgtctctgccaggttttggtatcagaatgattctggcctcacagaatgagttagggaggagtccctccttctcaattttttggaatagagtggtaccggctcttctttatacatctggtagaattcagctctgtcaatttctgtcaattgcctgtgttgaaatccaatgactacctcaaactatttctaatctcttttacatttttacccaaccaatttaatttcttggattcccacatattccttttttttttttttttttttttttttttttgagatggagtcttgctctgtcgccagactggagtacagtggcgcgatcttggctcacagaaacctctgcttcccaggttcaagggattctcctgcctcagcctcccaagtagctgggactacaggcatgcaccaccacacccagctaatttttgtatgtttagtagagacgtggtttcaccgtgttggccaggatggtctcgatctcttgatcttgtgatctgcctgcctcggcctcacaaagctctgggattacaagccacacattctattcttaccagcttgacaaatggagtacctactgctcattgttcttctcattggccatacctccctaccatgcttctataggtagaacaacatcaaagtatcatatgcctcaaactcaactcaggtgtttgtaaccaagcttagaatccccttcactggcccatttctgactaaaaaggaggtcatttcaggcactctctgaaacatgacctaaaaaaacccatgtccacattaaaaccacactagattttctactttatagcaaatttcattgtatcaaatatgaattttatttgaaagggcctttgattaactcgagcctgaaaatccaaagttgtatcttaacattgaaatttgtatgtataagtagactctacatcctgggaactttgggttgtattgcttatgtgttttctctttgtatgaaatagagtgaataaactattgcctatttagaaagatgatatggaggcctactctgactaggtagacatgtgctttatgttgcttttctagtgcaagagctgcagtttcatgatgcatgcacatcctgttgcctgttttgttttactacaaatggcccactgggaatattcccttcagttaagatgtactgagcacccagcatgggccaactagcatgataggcaggttagtagtgtgtgtgtgtgtgtgtgtgtgtgtgtgtgtgtaaaatacaatattatatataatatacatattatactatattttatatatatcttatatatactagatatataagatatatataaaagaaatacaacgtttgcccattatactaactgaagatacttgtgagttaggctcatcccaaactgtccagtatttgcttctcttagaaagtccaaaagcttttcatgtaacttggtgggctttctccctgacagaagcatttcacatatgcctactctctagcatgtcattcctgccacatatctcagccatgggcatctcactctcagctagtgcagcctatcttgatacctgctcagaacttggtataaacaaaactctatatacttcatgttgcatgcagtgagctaaaggaagctttgcttactttcacagattacaggtttattttataatcatgccatgaacacaagtcagagtaatctgattctttgctgcagtggcattagagcactgatagcacactctcctttttcagggagaatgttgtgtgtctggttgactggataaactcttcagtcttataggatttgaaagaacataaaaggcaggcatttatttactataataaaacaatagactttgcaatgaattctgtaataactgccttttaatcctcacagtcccccacacacacacacgagaactttataccccccaaaaaaaagttaaacgtcacacttactttattttatatctctgaagttggtcttcaatcaagcaaaaaaataagggataaagtgaaaggaaatttgagaaaagatcctgcaagaagcaagctgagactagaatttcataaaatccatttctagccctgtcagctgcctgcctcattaccttagactttcatataatcttttaagtctttagttcaatctttctactcagttatttttcttcagtttcttgtaaccttcaaaaatgctaacaatagaaatcacaggccaacctgaagttaatccagtaccttgtaaccacagccttttaccacccttaactgagctgtgtgtgggtggcttgcatcccacggttggtactctgggcttagagagtccttgcatgctatgtgggtggcgttcatcctgtagtgttcctacgggtttagggagtccctttccagtacccaatcagatatacattgttctttatatgctgggctgaaagattccatacttttgtttctaggaattcaggaccattcaactaagataatacggtataatgcagggaccaacaatctttttctttttgggctatgctgtctgtgttgcagctatgcggctctgcctttgtggtggggaagtagccatagacaacatatatataagtgaatgcatgtggctgtgttccagtaaactgtatttacaaaagtgggtggcaggccacatttggccctcaggccgtactttgctgactcctggtatctggacaagattgctgggtttcgagctgaggtttcacatggggcttgagacccatataatcacagagtggtctcaaatgggtctcatacttttgtatgtatttgtaaagttcacggtaatagcacttgccatgccttccttagaaagttacatgggataatttaatttttaatttttgttaacattctatagacttaaaaaaatttttatttaacacattatacatattgatggagtgcaatttgatacttaggtacatgtgtttgctacataatgattaaggtagttagcatacccatcacctcacatatttatcacttctctgtggtgagaatattcaaaagcttctcttctggctattttgccatatataataccttactgttaaccatagtcaccctactgtgcaatagaataaagagcataatttagataaataagatgtgttcactatgatatactatgtaaacatagcctttttccctaataagtattattagcagcagcaagggcaatttttctagagggggagaggattaggattcacttcttttatttttttaattttttttttttttggagactgagtctcgctctgcccccaaactggagtgcagtggcgcggtctctgctgactgcaacttccacctcctgggttcaagcgattgtcctgcctctcaagtagctgagattacaggcctgtgccactacaccagctatttttttttttttttttttgtatttttagtaaagatggagtttcaccatgttagccaggctggtctcaaactcctgacctcaggttatcagcccacctcgggctcccaaagtgttgggattacaggtgtgagtcactgtgcccggcccggttaggattctttctttatttgtggtggggagagggtgggggacggagtctcgctcttgtcgcccaggttgaagtgcaatggcatgatctcggctcactgcaaccttctcctcccaggttcaagcaattctcctgcctcagcctcctgagtagctgggattacaggcacctgccaccatgcccagctaattttttttttttttttttttttttttgtatttttagtagagacacagtttcaccatgttggccaggctggtctcaaactcctgacctcaggtgatctacccgcctcggcctctcaaagtgctgggattacaggcatgagccaccgcgcctggcccaggagtcacttctaattcctcacagctatcccagaatgtctttgaacacaggatttagtgacagaaccacaacaagccatatgagagccccacactgggcggtacactgcacctggaaatgtgcgtgtgaatgtgattctaatctgaaaccccagcaacagatcacctagcaaagggaacaaatgtgaaaggagcctttttgcctgcgtgtacagcttcaggaagaatgcagaggagaagaggaggatgcccccagggtctgtgatatttttatatcaactccggcagtcaatgaggtgatgggtattataggtattatagctggtttccctcccatctaagtgttcccatgtgaaaatgttcaacttgccaagatttgatacactcaagggacatcatattatgactttcccagcctctgaatctttaacactaatgaagctagcaggcaaacatgtctaaaaggacaactgtggaaggtaattgtatcttagatagaatggtatattctgtataacacagaccttctcattggtctagttattgtccctgaatgcacacatggcattttcttgaccccttattattccacgactttccccctctacctgaaatatctttcatactttccttcagctgtcagatcttatccataaatacacctcatcccttctctgggatctaaaatgttctcattttctaaattttaatatcagtttgtctggaccatcatttaaaagttacagtttactcattttattattgtcttttcacatcttctcaatgagattcgaaatttgggagcatcaggacatttctagttcagttctgcagctctctcagaacctcgcatgtggtaggtcgttcagtacatatttattgagtaaaaatatgtttaagtaaaagtaaatacagttttgttataggagagcccttcttaatcaaaaataccggaatacaaaaatcttgtttgatagcttttacatgttaatggaggcctcatctgttttaacctgaagccttgagactctggaagaaatgtacagtagcacaccattatacagaattttcatcatacggatataacagatgcaaataaccccaagagcatagagaccaggtgcagtgagtcacctctgtaatcccagtgcaatgggaggtggtaggattgcttgagggcaggagtttgagaccagcctgggcagcatagcaagacctccatttctacaaagaaattcaattagctgggcatggtggcacatgcctatagtctgagctacttgggaggttgaggtgggaggattgtttgagcccaggagtttgagattacagtgagctgtgattgtgccattgtgctccagcctggtgatagatcaagatcctgtctcttaaattaaaaaataaaaaaagagcttaaggagtagtaaaatatataataagataactgggaagtgaaacattttgagtattaccattgtttttaataaattttatttaattgtacgtttacataggttttaatgatggctgtgtttaataactgactcgtgaaagtcctaaaaatttaagtccacgcttatgagccaaaagagccagctccagcacatcactattcttatcacaatttattatagtggctgatttcattttctctctctttccctaaataatgaacttcctgaaagaagcgataacgtctgtttgctcaccattgtatctctaatgcctaacacgtagtaggtactcaagtattagatgactgaatgaatcaatccaatcttctgcattcttaccaaattaatacaacttaaaacaaaggaaaaaggtctcttgtctaaaagtcacatttcattttctttcttttggtcagctttaacaatatgctataaacattcatcactaagcacttcagcatatgaaatattactgttttcaatatcatccaagtaagtgtatctgagttattcatggccataatgttcacagaaacaactctcaatgtaaatatgttcaggaactatttttcagtagaatgtcaatttctttgagctgcgtgtgttcttctaaaccaacaaaacactgccaattcctgtgatatgtagattatttgtctttataaaattgcagaaaattgaaaatttttctctgggtactgtatcttttccacatttttagcctagagctttggcactgaccagaatgtagaattaggaattctagtatttttgcattttagggcattctaaggagaaaagaattctctccctctagtataggctaccatttcccaaaatatattccttgggatccagctctgtgggatgttaataggtgctgtatgaaaactgattcatttccaagtaggtttggaaaaaattggttcagtattaaataagtttgttttttgttttttctttttttttagtggtagcacatcaccaaacaggatatagtatatagtatttcccaaatgattttttttccacgagaatgtcacagggacctaatattccatttctctttgggaaatgccgtatttatgtatgaacagtcttatagaatcatacgttcagacatgagagggcttaaaggttatctaggttacccccccacacacacacacacccatgtcaaaatccattttatatcactccaacagatggtcatccggcctctgctgaatacagaccttagcaggaaacttcccattccaaaagtcattccactccatgactggcctcctttccttttttaacaaagattttccttataattgaaccaaaaatctgtttccctgtaatttactcattccttctagttttgccatctggaatattggcaaaacaagtttgctttcttttctgcaagatgactatcatgtttcctgttcaccttctcttctttagattgactcttcctagcttattcaattcttcctcatatgaggaagtttctagaattctcaacatcctggttactttcccctggaaaatgtccagtgtccctctcaaaataagataactagaattaaacacagtcagctgtgatctgtcaagcacacatgtttaactttttattcaacaaatacttctggagccactgttctcctttgggcactattctggaggctggggatacagcagacaagaaggcaggcaaagtcggatatttcatggagcttctagtcttgtagtggaaaaatcaagtaaaccaggaaacacataaataagcaagatggtctctagtagtcaaaaatgttacaaagaaaataagatcagataatatgatagaaaatatttgcagagaggtggtatgttttttattttgtttataaatagagacagggccttgctatgttaccccagctggtctcgaactcctgagctcaacccgtcttcctgtcttggcctcccaaagtgctgggactacaggtgtgagccactggccctgccagggtggcatgttttgatcagtgatggggaaagcatctcagaaggtgccatttgagctgttcctgaataatacagaggagccagggagtgaatgaagatctgtgggcagcacattacagccagagggagtggtgcatggcaggctctatggtgaacatgagtcttgtcaaaagaaagagaggtcatgtggaaagtagagcaagagaagaggagagtcacttcagcaatatcagagaggaaggcagcagccagcgtatttaaggcatcatagctgtgttaccatggctcaggtaagtatagtttgtaagcatagtaggtggccattggaagattttaagcaggagagtgtcacaaacttcaacagttcattccagttgatttgatcttcccacgagtcatcatactacattatactgctgttagtccagcccaggatttttggttgtcgccattgtttttctaagaacctagtcaaacttctcatacaaacttatttttggcaaattaaaatacccagatcttttaaaattttcttataatcttgacaaaaccagtaatttggaatctcagtgaaaaacatttgttgctcttaaattttataattttgttctcaagccttattagaataatgttgaatcctgactttgtcgttagtaatactaaagcagtctcagcttttgggttttaagtttaataaataaattttttattcaaagttggcaataaagtcattgtatagagcatttttttttttttttgagacggagtcttgctctgtcacccaggctggaatgcagtggtgcaatctctgctcacctcaacctctgcctcccgggttcaagccattctcctgcctcagcctcccgagtagctgggattacatatataggtcatttctaaggactatagtctgttacaagtatccctttagttgaaagaatccattaagcgaccttttctcaggatagcttttcaaccacctgctaatatttgactacatgaattttcatttcctcatatttttactgcaaggatagcccatgagataattcaacacatataggtctcttagtctgctaatcctgtaggaaaagaaaagaaaattagcataatatctaggtgaatgtataatggctcttagttaacatttctttgtctaaatattcataacccaagggatgattgaagtttaatcaatagtttctaaaatcctttcccccgcttttaaaaaaataagcatagcattttcctgactcctgtccttggggtggagattggggaacaagtaaaagcttatagagtcttgtttgataaaaaacatttttttctaagggaaaggaatagcaacatttgctgccacttaaaatccatccttaaaattcacacaaagcacatttattgcttactttcacaatgatctagggaccaaagagtaacaaaaaacaaaacaataaataaatgcacaatcgggcatctctgctgtcaagtattccttgaaggcctggcagaatctgacatggagtaagttactggaagccggatttagtcaattacctgtctttttgctcctaatgttcagaatccagtaaatggctgtagcctaaggtagagaagtaccagttaagtgcattttgactgtggtttaagcaatcgaggtcgtctccagcttctttggaacaatgccattctttagcatgacatggagggtaactatgtgcttattcactagatggaatacctgcttcatgtagttggctgggctctgttaccatctgtttctttctttgtttctttctgtttgtctgtccctcgccctctctttctctctccctctctttctgtctctctctctctctctctttaacacacacacacacacacacacacacacacacacacacacacacacacacacaactttttagagtcatggagagagggtctcattatgttgcccaggctggtcttgaacttgtaggctcaagcaatcctcccacctcaacttcttgagtagctgagactacaggcatgcaccactgcacctggtttcaatattcgtattgtcagtatctcatcagtttttgactatcgccacctctatctattttatagggaaagaaaatctttctttgccctaatatctaagtagcttaggcacacctgagaactgggaaaccattcccaaccattgccagtggggagacgtcctgcttcagtgtgatacagttagccagtgtttattgagcccttccccatgctcatgtttgtattcatctctgaggaatgtctctatagtgatcctattctagagacatttcccccctcttctggacagattaaacccgagaagaacttgctggttcctgtaagccgagcagcctgtttgtgctgtgccctcattctaggtgcattctttggctggcatatttgtgggcacagagtattcacgaacaaggtttcagcagtttatagtccctagggggcggggtgagtcaaaaacattgactgtttccatttgccctctggaggcagtgtttaacctccaagtggatgtggtgcccagaggaaacaacctcaaccaggaactggcaggcacctgcctcatcagggcatcagtgtgcacagggagagagggagtgtgtcaaaaggtccagcccatttggctgtggggagaggccttataataacacatcagtagcatcactttacacatgcctctgcagacacgagctgtccagctccctgttcctcagggtgaggctggggtagagctgggaatgacggactctggggactgatggagggccataccttcgagaccaaggatggtgttctcttgcacatgcttgccacctcttattggtcctccgattcctagggaattttctttagcattcttctcaactgggctcagttgttgaaagagcacacacacacacacacacacacacacacacacacacacacatacattttaatcctgtgcttcacatgctgtgaagctaaagaagagtgcaagaggaaggcagcttacatcagatctgacagtcttactgatcgttgctgataaaaactggcaaagggaaaagtaatcggagcctcgggaattcaattcactcctttaatccactcagcagatattttatttttaaaacacaagcacagccatcagcaaaattgagaggctgtgtgggaccccaaggcactttaaacttttgagccctcctaactcccactccagccctaccttcaaatagtccctcttagccatttcatctgcttgggtgtatcctcctcaccatcccttttccttattccctagaagccaataaaaaaaaaaacttgcctgttggcattaattaaaaaaaggaagacactttatgatctagatcatcagctagagacttgtgcagtatatcatccctactttttatgattctcatattgtcttcatgtctttctcatttgcagcaagtagatgacacagtgctgccctctagctgattattggattataatggcttctctattcctaaggctatatatatatctaaatatatatatatctaaatatatctaaatatatctaaatatatctaaatatatataaatatatatataaatatatataaatatatatatataaatatatatatatataaatatatatataaatatatatattttttttatcagcaaagagaagtggacagttgtttttcatgtacggcttaccccagacaatcagtagagcacctctgctgctttatactctctcagtcctcctgaaccaaccttcctggaataatctactaatctaaaccagaaaacgaacttagttccacagcagatttcaactgtacctctatattacagcaggtaccctgtcagatttcttctatcgagaaatgaaaagatgtacacacgcccatgtctgtatgtcttccatttatcaggcagggagaattgattatctcaattctaaagatatcagcacatttggagatatgtggcttttattctaggaccctgggattcacattttagcctataaccttcaaatctccacattcatttttctccaccctaagtgcctgtgtagtgatgtaatagcactgttaaccataatagaatgatcaatgattttgaaaaacatagtgtgtacctttctctttgggaggagggtaaaagcaactactgataagaaagtaagccttagccagctccccacgatccatctgccagtcaaagcagttaatcttatataccccttcccactcaagaaagttagtgaacagttattacatggctgcaataattatctgtaagcgttatatctacagatgtagactgcatctgtctacagagaaggcgctgattttaagcctgctttggcacctagttttaagcctttggctttatcaaccatgtacgtaggttgtcacccatataaataggtcctatccctcaccatcctgagccttgattttcttacctgtcatttgagatagttacctcacagaattgccaggaaggttaaaagatctggaacacgtaaaagtactttatcaaaccctacatgcttattaattgtaagaaactgccctgtgtcattaaaagagcatgggctttggaatgagacacaggaacagattccagacctgcttctcactagctatgtggcctttcacaggaagcctaacttcctcgagccttagctataaaacggaagtaataccaatctacagcacctatatgggaattcaatcagtaatgtgtttaaaagaaggtcagtgctacatagatttaggttattggtgccattgtaagtgggaaaataatatgtgtgatgctttagtgagttgtgagagagcatccaaatgcctaagcacctggagcacactgcctgggcctgatccctgacactgccatttactaacattgtggtgtcacattttttgtaattgcctgtttacttctctcactcacaagtctgaattccttgagtatggagagattgtcttctcactgtgtgtgcagctcctagtggagtatccaacatgtagtagagagagaaaatgtgttgaatgaataaatgtgtgatttttatcatcttccatacattttatactatggtacctcttagatatcatttacatttataataataactatgaattggaatgggtagggcagtggccaattaatgtagctcataggagatccagatgcttcattctgcatctctaggcttcttgatgcctcttgggccctacttgataggttcttatctaaagccataaatgcaatagagaaacagaacactttaaaaaatattacctccactaaaggccgggtgtgttagctcagcactttgggaggccaaggcaggcggatcacgaggtcaggagatcgagaccatcctggctaacacggtgaaaccccgtctctactaaaaatacaaaaaaattaggcctggtggcacatgcctgtagtcccagctacttgggagtctgaggcaggagaatcgctcgaacccgggaggcagaggttgcagtgagccgagatcacgccactgcactccagcctgggcaacagagagagactccgtctttatatatatatatatgtgtatatatatatgtatatatatatacacatacacgtatatatatatatatatatatatatatatatatatatatatatatatatatattttacctctacttaacctccctggatgattgtcttagtgtcacatatatatatatatatatatatatatatacacgtatatatatatatatatatacacgtatatatatatatatatatacacgtatatatatatatatatatatatatatatatatatatatattttacctctacttaacctccctggatgattgtcttagtgtcacaggatccttcgggtgtcacttcaccagccagaaccctctgtggctggcggcgcctctgcttgagtttcactcatgcccgttgggcttgttctgtcccctgggctgccaggctgtgctgctcggctcatgctacagacccagacccatgcccactgagggcaagccaggcatggagcagcgaggggtgtgtgcgccactaagcatggggtccagccagtgcacacagccagacaccccagctgctgcggcagggcaggcagctccaggctccgtgcaagcctacagctggactaggcataccacaagcagcttctcttgtgggtgccagcatctggatgaggggaatgtggtgacatctgaaaactcggagatgccagcaaccacagagccccaaggggtgggtgtggaggcgctctgcagctctctcatttccaccacccacagctcggcggatcgggcgtggggggaggcatgtctttgcctcattcagtcccaccgcctcactctggcgtacagctcccaggctgccctggccccattgctgcttcccgtcacatggggtagccgcccaacaccagcggagggcaggagggctatagtgctacagctctggcttggggaatcctgaggtctgggcccacagaagcgtcaccagtgttcactgccacagtctgatgaacaggagcatgtcatcgtccgcagctcaaggagctggccaggaaagtgttacagcccttttcgcacccaccattcggtgtgttctgaattcttgtccagcatccaggaagaatgagtttccacaaacaactggagggtaagcaaggcagggaagagttttattgagccacagaacagctctcagcagagaggagacccaaagtgggtagctactacctgcagacgggcagtcgtaccatgtggttgagtctgggggtttttatggactcaaaaatggaggaagtgtgtgctgattggttcatggttgggaggaagtgtgtgctgattggtccatgggtggacctggaaaaagcaccacttgactgacccaaaggcattaaggaagttctcactgtgggtagtggattctcccggagactgacagcctggttttcaggcttcctgctgtatttggcttgaaggtcaggtatcaccagggacctgcctcttcttgcctaggaatttgcctcctgctgctatcattaataacctacgactaaacagacataattttattggaaacttcttgaggatggagacctggtatgcgcaggtgctcatcaaatgttgattcggaaatgggatggtgttctgttcagttcacaaacatcagagtcttcctgtacttttaccccatggcggttaatccaaaacctatagaattaaattattttcaaattagtcaaatcaatgttacagtcttaggtacctctatgcttcatctgttctgaacagcaagtggcatcttgttgcagcttgctatccagtcccaagatgcatttcaaattccaggcgcctgttctgtgacagccttccaccctggcaggtctctttgttgccatcttttgtagcatcctctgggtatttgactcttctcccctgcctcaaaactttgcagaaccccacccagtggcaccaatttgttcttcaaaaaccttattctacttgtctcgttgtttctcttttcggttgagttaaatctacaaccactgcttgtgcatcttcatttttccaagcagccattagaggcaaatggcaccacagctcctgctacatttcaagcttatgtcccagaggtggcaagacagaacatcaatcttcagtgccacctggctctctgataagcttttgtttcatgtgtggctatgttgtcaggagcttcacgccctctcttcccactacctcacccagagagcttttctgaatatgacaaccatctaaagacgaattatctccttgcaaagttaatttctgtttctcagcagggagccactggttcccgctgggcttgaaagtactgctgtttgttaatggatgagtgtctcttggatcctggtacccacactggaactgctgcagcgcctggctttccatttgctttaatttcctacttgcagctggtgttaggagacctaaatgggtttattcacggaatagtggtttacagtcattagcactgggaggaaatcatattgaagacaaggactagagagctgctttcatgccatccttgaacacttaggacagtttggttggttggttgattggttttggcttttttagagagcaaattcacaaaatccttctagagatagaacaaaaggcctaacataaaaggtttatttctgacttttaagagttagaaaaaaacagtatttttttaatgtcttcaatgtacagaatggtgaagataaaataagatgctggttgaaaattgctctgagcacttttaagtgtaatagtcgatgttgctattgtttggtatgcccaagctctttaaagtgcaggaaatttcgttacaaagatttgtgctgtcttctataaagcagagccagctgtagactagaaaactccaacccgtagaacatctggaatgtttgtttctattcattatgaaattgccacttttgtaggtcaaacaaggtcaaatgttggcaatttcctactattcaacctatgcagttttgtttttagatagaattctgaaggccaagagagcaccataggtatgtttcctgcctctgaaaaaaatccaaagcctgtaggccaatgcctgtttgtccttgagaggagcccaattctaagctgttaactgtgtgaatctgaaatgtgcctcagaattgctatgctaggagaacatctggtcacacagactggctaatgtcggacagctcgctctccctttctccgcctcgttttccacagcatttctacatattacactgtcaagctaacagagcatgagagaacatcaaactaaaagttctgagcaagaaagtacaagtgcaagcaattcctcatgcctaaaaagtgccactgacaatgaaaaactttactactggtgactccagagatggcagtgtgtgaaagtgaagaaaggactatggaaaagaaaaagaaatctttccccccttacagctgctttgtgactttgggcaaatattttcatatctactagtttttatttattttagagaaatgttgttgaattgaagagaatcaaatagctaaatatcccgtatagagccaacacacacaaaactgcttaatagatgttacttctttttcctctttactttgttttcaaacatgggatttaaatgctttaatttaaacctatgaactaataataatattaccctttgcaaagccctctaaaactttaaaagcaattccacatacatgcatgatgtcatgatctacctaaatccattaatatgtatgatctcaacatgtatgtgtttatttctctatgtatgactagaaataatccaagcacttaagccaaacacagctgcttcctttcccctcacattctgagagaattcttgcttttactttgttacccttcacttttctttattaagaatgcccttggacccatccaaagatatccaaatactactgactcagctgccacctccttaacaaaacaacctcatcagctgaaagtaactaagcagtcctcaagtcaaaaagggaagagaggcatgtgaagagaagattccttcaatgctgacctgtgctttcacagtcagcactaagtcatagaagagaaccccaaagggttttcaggaaatgagaagctacaataggcccagaaacaatggttcttaaatttgggtgcatgagaattgcctgtggaccttgtttaaaaatggaaaaactacctattaggtactatgctagttacctgggtggcaaaataatctgtacaccaaacccctgtgacatgcaatttatctacatgacaaacctgcacatgtgcccctgaacctagaataaacgtttaagaaataaatacaatttaaaaacagaaacaaaaacggaaactcctgggcaccaccccacagattctgattctctgcatctggagaggggatcaggaatccactgtttttttgttttgttttgttttgtttttttgtgacagagtctccctctttcatccaggctggagtgcagtggcgtgatctcggctcactgcaacctctgccttctgggttaagtgattctcctgcctcagcctcccaagtagctggggttacaggagcccgccaccatgcctggctaatttttgtatttttagtagagatggggtttcaccatgctggccaggctggtctcgaactcctgaactcaagtgattcacctgtctgggcctcccagaatgctgggattataggcgtgagccacctcgtctggcaaggaatccccaattttaacaagcacccagggtgattctgttgaaggtgtttcctggacctgctttgagaaacactggtttagaggacaggtacctttcatatcaaggtaaggcatgatacagaaggtaaagttgggaatgtcaaagggatgctttcagtttcatgtgagatcaagctgatttttctctgatgattacacataaaagtcatgagacaacctacttggtcagcagttgctgtgtacctagctttgggagcattcccataaagccgtaagatttatatcagcactggctcatatggttcatgtctttagttttctttctttttttttttttttaattttatgtgcttcattaaaaagagctttattctaggtcgggcgtggtggttcacgcctgtaattctagcactttgggaggctgaggcaggtggatcacaccaggagttcaagactagcctggccaacatggtgaaatcccatctctactaaaaatacaaaaaaattagccaaggtggtggcgcatgcctcccagctactcagaaggctgaggcaggagaatcgcttgaacccaggaggcagaggttgcagtgagctgagatcacaccgttgcactccagcctcagctacagagcaagacttcgtctcagggggcggggaaaaaaaaagagcctcattcccagaggcttcattaattaaggcatttattttggggtttgattgattgattgactgactaaagtactagttacaacagaaaggatggcctttagttaaacaaaatcattgctttcctgctatgaaactgatggctgttgctaaggtttttaggatgtctacaagaagtcaaatttgctctttaagctatagatacatatatactatatacatatacatgcatacatacatatttctttttaaaaactgaggtagttattatgtagggaaagcatttttctaaaatttttttgttatgtttacatttggcaatgtgacagatttatgtcaacagtgagaaattataccagagcaaatatatgtgagtaaaactatttgaaaattaacatctaaagtatagttatcagtgtgagaatctctgagttgtcacacagatccattaatcagaattattagggttcatatgtaagtgtactatttgttttcatgggtaaaagctataatgataactataaaataataataaacattgctgaagttataatatctttgggtaattaaatatattctttatcaatgaatattgaacatacaggtgccatcatggggagatctgcacaatttttttctttaaaaagaaatcagtggagcataatagaaaatcaaaaccagaccaacctctggctatcaacactgccattgcagggctatgggggaagggtagtccttccatactggtgctggatcacctagatatccaaatgaattttaaaaatttggaaagataaaataggagaatatctttatgacttgcaattaggcaaagatacaatggaatattataacaatgaaaaataatacactctgactaaatgccacaatgtggaaaaatctcctagatgtaataataaaccaaaaaacatcgagacacagtaaccatatactgtggtatttcattatataaagttcaaaaacaggtcaaaggaatcacagggatagaagtcagagcagggattacctttggacagggatagtgactggcagagtccagcaagagaggcttctggagtgctggcagtgttctctatcttgatttaggtggtggttatatgggtgatttcactttgtaaaagtttattgtgctctgtacttacaatttatgcactttgcacttttctgtttatatattttctttcacttaaacatattgccaagaaaatcaaggctgtattagaggatgctatctagtttggaatggctttcttgcttagaaaaacttcctgctttgcagctctgcactggtgactgacagttgtgacattcagcagttctattacaatctactgaccaaatagagctttgagcaaacagatttcacaaaaggcagtgggtggccattgagttgtttgttttctgcttgtatctgcttagggtggtattagcagcagtaataggtatatcttctgatgttgattctggaatttgttatttgttgacttattctcatcatcatcatcagttcttcttttgttgattgctgaccatgtctctgctgtaatctctgatggctaatttgcataaataaccgtgctaaaataaaatagtacagagctttgtgtgtccactgtagtttttgtctacaggttctgaaacttgatttgactaggcccacttgtttgtatgtggaaattgatgttaatgaatgtctggatagcattttacttaatgcctttgtgtgtatcatgtgtacaacaactctgtgagataggttatttcttctatttggtagagaggaaaattatatgacttagttaatatagcacagctagcaagtggtagcccaggatctaatatccagatcttgactaactctgattttgtgttcttctcactctactacacctcctcttttggatcaggaaggctttcagggagtctcattaatttacaaaaagctggtagaaattattagatgttttcactagccctcaaacttttcctatatctgttagtatttaataacttacaaattatcattccatggcatattggtaagcagtaaattgccaaatcctttccttctgacttttacgacatttacattcaaattagggaaagcagggagatttggtgactatagataattatggaacaagagttagatcttctgtcactaaaactttggattttgtgagtatatgtgccagaaagggaaacaagcattgtcatgtgcggttcatctggatttagcagtctttaatggtaagaagtgaaaaaatgcagtagtgaggccagatatcagattcctcagagcaggagtctgagggctgaaactccaggcatggacacctttgtccccatgagccctgataacacttgataaatttcatgggatagggatgttatcttaactaattttatttgcccaatcagatttaaggtggtttctaagatttttagttttactgattttcttacttactaaactacctgttaggaattgggattttatttaggaaatccttgtctgaaaaatgaaaagtgaaggattattatacatgtaatttaaaagatatttactgttttatattacttttttctttttcttatataaatttcatgggacagggatgttatctttctctaattttatcagatttaaggtggattctaagatttttattttactgattttcatttccttaaaaaaaaccactgtgtatcagtagaaatgaagaataagaaattcattggcagtgcattgaaacaaacagatgaatacataaatatagtttgtttataatgaaaacctccagggtcctctcaagtattttacctagaaatgacatataaattcagcgtatgccaacagttcttttaaatcatggtaatattctgaacatacaattatactacattattttcccatctctagaatttttgtggttatttttatttattcctccgtagaaacacttgtatcttagttgctcttttaagatatctctactaatgatcagttgtgttagtctgttctcacactgctataaaggactacctaagtctagataatttgtgaagaaatgaggtttaattgactcacagttccataggctgtacaggaagcatgtctgggaggcctcaggaaacttacaaccatgacagaaggcgaaggggaagcaggcacatcttaccattgcagagcaggagagagagagcaaagagggaagtgctaccacttttaaacaaccagatcttgtgagaactcactaactatcacgagaacatcaagggggaaatccacctgcatgatccaatcacctctcaccaagcccctcttccaacactgaagatcgtaattcaatatgaaatttgagtagggacacagagccaaatcatatcatcaatcattgtgaacttggagacatctgttttgctatgcatattttcttaataaagattatagtcatttatcaatattttctcagagaaattaccttctttcaactaatatttatgaagggggacatataataactctgggactgacagctaacatttatgatgggaaactattaataactaacaattactaatagtaggcacattactattgagtaacatgcttttcatatatatataatctcatttaatctttgcaacaatactatactacaaatactttaaatatgagattaagggaaatcgagcgacttctcaagtcacagaatgagtcactgacaggtggaggtgcatcccagctcttctgtccctactacacactgcatggctcagctacttggcttactcggtaccagacattgactagatgctcaggatgccctgggccttgtgtgtctcaaggcctagttggtatgagatgtttgggggcagggaactaaggaataggggcacaggtgtgctcttcactacagctgtggaatatgggggaggtagcaagagataatgtagctagagaggctctactggtgaggctgctgtcctgttttggataaggggtagctagtcattgtaggctgggcaatgggattggttaatttgaggcattgccactttcttcttccactaaatctcagctctaacaagtaccttttaatttatttatctactttccttcttccaaagtaaactcattttgattcatcgctggatccaagagcctatgtgctctaaagctttgagttttgaaaaaaagtgccagctttactgagataataaaaataaaaattacttatatataaggtgtacaatgtgccaacttgatctatgcatccattgtgaagtgatgctgacaatcaagctaactaacacatcccatttaaaaccttatttggagagctttataagagttgtgcagctttctctcctgaagagagaaatgcgcatgccctctctcctgaaatggattctgtccatcgtcgtctttgctgagaggatcacttgcaagtcccttcaggagatttgaaaacttttggctctgctgtgccctgtgatctctccactcatgccagtcaaactcaaccactggagcctgtatggaaactagtgctcctcagtccaggcattcccaggccaaggatctactatgagtaaatgagccagtgggctctgcagccagattgtcagggttcaagccctggccctcccattcactagctgtatggcattaggcacattatttatcttccctgtgcctcagttttctcttttgcaaaatggcagtaatagtaccttcttcacaggattgttgcaaggattaaataaattagtatgtaaatttgtaacttgcatattactatgaacacttttaaacacagtagtcagtactcagtaaatgttcaagtttgttctcattaccattatggcatcaatccttacgaagtgtataaaacctcttaccccttcccattgagggcagtctcagcttcctctctcaaacacctggctggtggatttttaggggggcatttcttggagcaaaggaagctgttaatcctttcctggggaaccattcttttcaagtgagggcagagaaggagaaaaatacctttggggtgtttctctccccacccccaaccccgtccagtttcctgcagcagttagaacagaaattagtctctcagaagattatcctgccacattgacttaaatgtgatgcatagtatgacctgtaggataacagtggaaaaccctaatcagttacttaaacctgccacagactaatttttagaagtctcagaggtgggtgtgcatattaaaagagaccaggtcctttctgtagaaccctgagcaaatgtgtattgattaacttaattaaaggaagattatgacttgtgcactgcactgtgtgttatcttactgtatggtttaagggatctttaaagcatatgtgctaatggccttctcttttaaaccagcgtgaatctgaggttatttcattaatgtggtaagcaaatgattgccaagaacacagaaggtaaaaagcattttcttctgtaaataaattataatactttaagctgttttttagtaatagttttatatggagtttggttcaaagagatcctttttatttttcaaatattaacgaaaggagttctttaccttttatttattcttctcatcttacctcttggcttgagctagggtcatagaaccatgaagatttggctgggccatttatttgcaaaacctccaatgtcagtatgtttaggtcttttgtcttagaccagactccacagagaatgattctctaatctgccttctggagattgaaggtctggctgtcaatatgcaggaaaccaaatgagaagagggtagaagagaggtgggaatttttggcatccagtatatgtgaattcacttaatatttctgttttcttccacccttgatcgttcatgcaatctgccagtccagagaccctctattttattccttccagaaaataagccttcaggtttttgctagggtgaagagacagttgtccagtgagggcctgagggatctagagatctgactacttcttaaatagactttcaagtaattcttttatgaaccactccctcccttttgcccccacgtccagatgtacctggggctgtcgggaattcaaaatagagattaggttgtttctcagccttccctcctattcacacaggattccattttcttgagtctattagaggaactgacctctctaatctgacttccagcttccaaaattacattgcttttgttttctcccttctgttctccttacccttgtaggttgatgtcttgggaaaaaataatctctttatcatcatttcaatggggtttcaagagggagggagaataaatgtgtattttgtatctgctttctttacctagaagtaaattctcccctcgataacatctctccttcctgctccctgtgccctgacttaaaagaccctgccctgcctctcccagcaggcacctggaggaatatggaacacccgcccccgcccttcttttcttcatatgcatgcactgcacgtccagcctttctagttaccctccctgaaggcccaactgagagtgtaacttgtctagaaagccattctagagcactcagggtcatgatgaacggcactcatatatacctcctgtgggcagctgaattcctgtgtatgcatcttttctgtcctcttcaagaagactcaaactagatcaaccagattgcatttgctctcatgccaatgccttgcctgataattcttgaaatacattgcaacgtggtataatagaaagagcaggccttggggtaggaccagcctgggggcagctctgggctcctccacttactagttgtgttctcttgggcaaagaacttagcctttctgtagctccctgtcttcatctgtaaaatgaggcatgtgaggactaaatgagatgaagtcttgtccctgcttagcataatccctggcatggaggaggtatttaataaaaattagtctcctgccctttctatccacacatctccatagcatagtgcattccttgtagtaggtgctcaagaaatattcactaaatgattgttctggaaaaagaatttggtagaagttcttcattagacttactctatttgtatccagctgtaccacatcaactatggcaggaaagtagaatcccttctctaaactggaatcatgtggcaggaagttcttatcacttaaggggcacgagggaacagaaacacagtgttcaataaaactgaaagggcctcagtctcagtgttggcttcaccaaagccaacctgaggctttcagctgtgccttctctttccaattataagtgagtactgtgttagctaactcccagttcaatccacagcttgccacttgggatctggaagctagctgattttttgatccaaggtgctctgctaggtagggttgccagttgtaattatatgttcaaatgtcaattagcagaacatcctattatttggcagtttggagtaatgagatggatcttgcgctaatctttcaattcagcaagtgtttgataagtactttataagtaaaattctatactgtgctatatctagtgaaggttgcaggaagagctggaggtaaaagattgttaagtgtgcatccctttatgagctcatgaattttcaaatatcttaagcaataaagaaaaaggcagcaggttttccattaaaaacatttttttctcacacacatctccctacctccatttgtactcaagtgacaaaaatttttaaaatagttacctcatggaacagatatcatggaaatccatttagtggaaaattcttcctgagtatgattttactagactccgtgcttgattctggggaaaacttgagtgagacagatggttgccctccaaagatttctagttgcctttgatatttgactttttcttctctaccagagctgtctgtgcaaatttttctcagtgctacatccagctttttgcataattggttttcattaaactcttgagttgtattttctttttacacagttgattattgtggctcatctaaagagggtcattttatgaaatgtctgtactccttcttgacctctgtttcctgtgagtacaaatctcagtagaacagagaaagaagacacaagacctcgcttagagagttgagggtaggtggcaaggttgttttgtttaccactcatggcctatagcctggtagagaacacagactcagcccttctctagacttgccttctcaaactctttcacacttgacctctttcgccattcttcaagttagagtgggtattcggtttttcataagctctgtcatttttgttttccctctttctgcatttatttcctagccatggtaaatttgggatgttgtgaagatcaagtctcagttcactctccatccacttacttgagaatagaggtactcggtagtcgtactcacattcgctgtgctccagggagctagttgtcaaattttctgaaattttgtgagctggttgttaaatacagccattattaaaaagcaaattctgtaatatgacaaaggtaataaataccaagactcatcacttcttaattattttttaacatttcaggattatctatgttcttcagggtatctgcatgcatctattgttgctgatagcagagttattataccttattactgtttgtgttgcttttcatctcttcccaactctgagttcagcaacatttttaagttcagtgacatctcggtggtagcttgaaaccagccacacaaccaaaaaaatcaccacaaaaaccaccaaacaccacaaaccaggacccctccatttccctggagagctgcttgtcaaaacatttaccagcacaccgctagtcatgctcttcttctgttcctgccagtcatgagtgattgtgagccacaccaattaccattcatcttaaagatggcaaaagtcttcctccaaggtggttacaccaaccttacacgttttccccccacagccttatgaacacccagcccagatttttactctggatccatggttactcctaggctgcctctccctccatctttctcatccccaatgattcagtcattaatttctctctttctccctctgtttccacttcccatcctcttctccttcctcctgcttcacattcttcctctaccagtggttaagagcaagggctctggagacagactgactggctttgaatctgggcttcatgatctactggttatgttaccttggggttgttactgaactttttgtgcctcagttttattatctgtaaagtggagataataacagtatccacctagcatagttatgaggaccaaatgagttaataattttaaaagcacctacaataatgggtggcttatagtaagcaatatgtacatatttacttaataaaataaacacttatatttgtcatccagcccttccttatgtgctaatgttcaaggccagaaggagaacagcaacagaacacatgagaataaaagaagaggcaaaatggcctggggttgtatcacagcaatggtgtgacagttctcgggaactaggaaaagagtcaatgaaaggaactggaggaaaggtggggatcaggaagggagacaaataagaagaaaattacatttcaaaataatctgcaaagattaaaatatatataatattagcttttagtattttatttcaaatataaaccccaggaaaataaagggatattttttataaatgcatagaaagttcccattttgatgttagcagttaattcaattttggtcttcatccaaggcagaaatgtggtagccacatatttaaggtacttaggctaaatcaactgtgtattgaacaagagccatggggacagagtgagagatgtgtgtccatatctatcaaaaacgcaagccgggagctgaagtactcatttgtctgaccatctggaaatctctagtggtctaggcacttaattttaccctcattgctagaacaaaagggaaacaataaaagaagaaaatgggcagcagggacattttacttttcatttaaaaaaaatcttagtgataaaaggagcagagagtttaaaagaaaaaaatgagaaaccattaaaatgatttgaatgctctgtctatattttgcggtgagctctattgttttcagttacatgggaactgtggtaattttatgaatcattagaatgtgtttccaaattataactgcatgttcttaaaatccctcctaagtaacccacagtaagaggctgttgaacaatttcatttaacacttttggatctcatattaattttatattttaagaaatgcatacttaatagcctaaagataaaatcatgataaccgagtctttgtatgttttctttcctctgctttttaaaacatatgaccctatctctgttctcctccgcagtctagtgacagacttgagaaaatagaaagcctggtttggtagaatgacttttcagttaaaagcaaaagctcagttgggcacagtggctcacgcctatgatcccagcattttggagggcccaggtatgaggattatttgaggcaggagtttgagatcagcctgggcaacatagtgagaccccatctctacaaaaaaatttagccagttgtggtggtgtgcacctgattgtactactgcactctggcctaggtggcagagtcagaccctgtctctaaaagtaaataaatacaaataaaagcaaaagttcctctgcctcaccccaagttgaaaacaatcacaacggtcaaacgttgtttttcggcatatgtctcatcaggcatagtcatctgtgaaatgtgtactctgttaatgatacctcacacctccctcctagaggatggttcacaaaagcctgttcacttacctggggcagccagtccagcatgtgatcctcagaaaatggggaaagtgacgtcaaagtagtgggtagtgtggatgtgtgtgaggcagggtaagtgtgaagatgttaagtttattttcttagaagaggctgtcctttttgctgatgttattttcctcctgtttttggtgttaaaacgtcgccattattttatgaaaacagtggtaatatagataatctccctttgctttgttttgttttaaacattctaacttgataaaatgaaaaattggagctatattcgtccatatttttttcctggttggtgaaatctgaaagtttgaaaactatcgtacattctaagtgttggttgtctccttcccagggtgtaggtgtttcctgtgtgaagagattgtctcaaagggaaacttagcaaagctttgatattctgatttttaaccactaactgttcttggacttgggagaaaagctgcttccctgggcagtacatgggtggtactgttactgttcctttcatataaacttgggcaggatgccactgagtttagttaatcagaatgcattctagtgatttccagtatcatattggcctatctcttgacaaattatgtgctttgataactaaaatctaggaaatatgactcatctcctaaactcagggagacagttatgttaaagcctaaggttactttatggtgggaaggctggagatatcaccatggttcataaagaatatcataacccttgcaaatgaagaaaaggagagcaacttgttcaatatctcaaagtcaatgttaaaattatgtttggagcccaggtctcctgttggctagctatttgatttttgcccagtggtgcattttgttttgctctgcatggaaaagtcatataaagcagttaaatttatttttggaatgagctagaatgctgggttcgcaacaaccagttttgttaaaaacaagaactgctttgaaagttcattagttcttctcaagtgttattgtccctcccagtaggaggcatatccaagttgaatctccactcctgaacaaattttcccttgtgtgtgtacactggcacacttgcttgcacactctctccctcaaacagttccatatgttctattttactggaagccaagctccctgccattctcccccttagagggctccagatctcacctctgaggtgcacgcgtaactgaggctgaaacaatttgtagggaaacttgtcagcaaaattgattattatgtggtgtgaaccaccaaagacaggtgagcctgcacatagcggaacaaatgtatatgtagtatgcatctcccactgcatctaaccagacttcctcctctgacatgttgattgatacatttgtatctctttcctaatgaatcatgccccattgtgggttattggagcctcctgctgaatagacctcacctttgctagcaaaaggaatagtaaaggttctcctctgtgaattttgggggctgtttattggctctaaaggagtggctgaggacatgtaatctttaaaaggacaaaataatcacataaaatgtctaaataacattgctacatcaagaggagcttctgtaactacagatgctttgcgacatgacaaactagttggtgtggaatgcgaatctgagatacatgaagaaatgaaagcatttcagaccacctctggtggcagcttgatattctggagttctttgaaaacttttttctagtgttatacttgttccttgaaatggctttaagtgtgagacttgtgataaaatagggatgataatgactgctctagtttctcacagtctgtttgggtattgattgagatatttgcaagtactctgagttctgaggaagaagggtgttaggaaatgctatggtgttgtttttagcaggcgtggaaacctatgctaaaataatttcagaaagataagtttgaagacaggttggattattggcctgtacctgtatgacaatcgtatgtccttctggtctatccttttgtcttaggtatcagttctgagtgaatttagagggcagggtttgaggaatgttgaaagagagaagagatctcgctggcctaaaactgcccacgaactgtctcttggctgctggcattggagtggcctgtgcttcccgaggctggtcacatagaatggtctactgatgatcaggagggtccagtcttcacttcctgtcctgacaccatcctatccacttgctgagttacttcacacctttttttcactgaagaatgtctccaatgacagtctttcttcctgtaccacacactaccttcacagcttcctgtaaacctagctttggcctcactagtcccaccattgaaactgtcatctgaggaaggtcacaataaccttcttccacaagcagtcttcattcatgtctaccatgatacacctggcatcatggactacctgaaaagattgaagttactgctttttgtttttactggaaacaacaaaaaatagtggttaagatacgggctctggattcagtctgcctgagtttcagtcataacagtataaactgttttgctgttgtattcgagagcatagcatagtagcagtgcctggcacatagtaggtgatcaataaatattggatggattcacagataggtaggtaggcatatctgtttgctataagctcatctatatttgtggcttttcatgtcttttaacttttatatggcttcttgctattaatatttttcctttagtaagttacatttaaaaaattaactcatattgcttaggctaaggaaaagaatgaagaggtgtgtgtgtgtgtgtgtgtgtgtgtgtgtgtgtgtagactgtagagcagggaatcatattgggccctttgagcaggaaaataatatttggaaatatacaactgggaaataaaatttcaggggacatcattacctcgagtgagtcttcccaggttgttctttcttcattggaggatgtgagtaggtggtttctttcttaaaggccaaatgtccatacatgatccaaggaactcttatgtttcttagcttagcttttatcacgcttactcatcgtcttcttcttcttccttcatttttcttcttctttctttttttgatctatgttctacttctttttttctctgttggatcttcttttttctcatggtaccacagtgcaagccaccctagactactgccagggctttagtcagatgccttactgtgaactcttacttctccaggccaccccagtgtgtctgccaagtcttcatcgagtaccattttcccagggagggggcacagtatagggtggtaaagagaaaatcaaattgggactcaaaaggcctagattcttctttttcctttcaaatctcatttctttctttcttttttgttttgttttgttttgtttttctggctgtttttaagatttttctacttatcgatgattttcagcaattcgattatttgtgactttctatagtttttgttatcttccatttgagatttattgagctgcttgaatctgtgggcttatacttcaaatcaaatttggaaaatttccagccactatatctttttatattttctctgcaccccccacccccagttgtgtgtatattaagctgcctgatattgtttcgcagttcgctgactctcctattttttttttaatcattttttctgtctgtgttttatttggaatagtttctattgctgtgtcttccattcctgtttctgccgtgtttatattttccattctgtttttagacataggaccctattcctaatagctgttttaacctccttgtctattatctgtgtcatccctgggtctgtttctcttaactgattttacttctcctcatatattttccaacttatttccatatgcctggtaatgtttttattggatgctagacatgcgaggttttttttacattgttaagtgctggatgttgttatagttctttaaatattgttgaactttgggaacacatttaagctatttagaattattttcatcatgtcaaccttgcttctaggctttatcagacaggtccagagtagcttttactctaaggctaatttggccccgctactgagacaatattgttttgaacactacctgacaccctatctattaggaggttcttccactgtagctagtgggaacatggaccattcattgccctgtgtgaactctgggattattctgcctgctccattgaggtagtcctctctggcctcagtagtgtccttcacacagaacagtacttggccgaaggttctacacggaagatctacacagatcttgtgctcacacatgctcccgtttgcacacatgtgctctctttctctccccaccctcctctctctttgcgaagctccccactcttcagtattttgccacagtagactgtagctgccttggtcttccaaaactccaaattctgtctcctcaacctaagaagactgccaggctctgtccaggtcccttcttcctgcatcatggcccagaaactcttcagctggggcactcagagggctcacgtcatttgtttttcatctctggtgtctgaaactactgtttcctatattttgtctggttttctaattgcttaaggcacgatttcaagctattttatactgaaatactttaattttacttccctgcagagcaagagcattttcttcattatcattaatgcattatcaagatagcattatcactatcacaattagaaaaagtttctaatatctccatatttctaatatgtagtcaattttgcattttcccagatgcattgtcccagaaatgtccttttcagctggtttgttcaaactaggattccatctaggaccataattgttatgtggcttaagtctctttaatccctaacagtcacatttttcatgacagtgatacagtgaacggaaccagccagccatgctgtggcatgttccatcttctgtatttgtctgattgcttcctctatttcctgttactagaagttaggtctgaaagcttgattagattgaagttaaatgtttttagtgagaatatatcatagatggtgttatattcatattctatctcatccatagacctgtaagagctggcttccttacattaattaggccaagctcgacccctggatgaggcttgtgaccttctaatccctccattgtgtagtttgatttttgttgtggggaagtaattgatgttctataacattgaccctatgtggatgttcatttctgcaatttcctggtcaactttcattttgttttttttatgtttgtttgtttgtttttgagacgaagtcttgctgtgttgcccaatctggagtgcagtggcgcgatcttggctcactgcagcctccacctcccaggttcaagtgattctcctgcgtcagtctcctgagtagctggggactacaggtgtgctccaccatgcctggctaatttttgtatttttagtagagatggggtttcatcatgttggccaggctggtctcaaactcctgacctcaggtcatccacctgccttggcctcccaaagtgctcggattacaggggtgagccactgcgcctggcctcaattttcattttgtcttagtaccaatggataacctttacttgaatcagttgttttattaggggccacaaaatggttattttttatttatttttttgagacagagtgtcgctctgtcgccaggcttgagtattggtgcaatcatagcttacctgggacacctggactcaagcgattctcccacatcagcctccagagtagcaggggttacaggtacacacaaccacatccagctaatttttctgttttttgtagagacagggtcttgccatgttgcctaggctggtctcaaactcctgggctcaagcaactctccgtgtcggcctccctaagtgctgggattatgggtatgagccaccacatcctgccttattttgtaattatgttattttttctacatttattagctggtattcttccttaaaataggactttttgaatttggtaatgctgaaatataattcctacttgaaagatagcacaaatgcataattttttatttaccaaatttcaaagacaattttgttttaatagccaccttaaatggtgacaaatgagttttgtctgactttctctcttcattgatttttcatatttttcattacgtgtaattacctgtaataatttattctttctgatgtgctaatcatcagctttggccagagggactcacagagctggattctagattttgaagtatcatagactatctatatatttaatatctttgacacgccctttaatatttgttatggttcttttttaagccagagaattagactagataataaggtttgttttcagctctagaattaggatcctgagctctgctaccaaatacactgccctgcttctgtccagctgcagaaaaccctcagcctgtctgtctttcaggccttccacaagctggcacccccatccattcaaccctttctcgattccttgacagaaattcccttctccagccacacttgtctcctaactgctacacatgaccagctcatccttcatccccagccttcacttacaccttttcccttgcctgaataccttgcctctgcctctctaagtatccaaacctccccgtcctccagatcccagttcaggctcccccacctttttattcctgttcccttaccttgtcttttatactcacttccctcttctcttggactatcactgtttcctgttctaattgatgttttcccaagtagattaccatcacccctgaaaagaaaagcccatgctttttaccaagaacattgctaggccagtatctgctaatgtcattgttatatttctatatcttctctaacatgtagcatcttctatttagctgaataacagccttaaggtgcttttgaagtgtgcatgggtatgtgttgggaaaggagggtgttggggatatttcttataaatgctaatgctttcctattcattgatctatttctacccatatgtaatgagttccattacatatcaagaggtattgacaacttagccgtagagttgcattgattcaaaatacgtaagtcaacaattactaccttattatgtaatattagctagggaaagaaagatggcccctgggatcatatggtctaattaagcacaactgttgtagactttttctccctttcctgctgttatgttttgttttgttttgttttgttgtggatatgaaatcacaaacccccaaataagcctcataaagagacagctgtgcttataagattatgttcgtcacagattttattcaacgataatttatttctacccaaaatgttaaaaatatatattattgataatttacatcatatacattttccatgtttttattggcaaataagtttaacagtagcttatgtgaattctaaaggcatatagtttttttgattgtctaaaatttgacctcatattttttctttaagcctgtttgtaaattctgcctaactctttagcctgacaaacagagcttcagagtttgtttgttatataagtatattcatcttttctgaacagtgaaactttttgaaattatcttctgtacttgaagtggatcatctagtgattagtgacatcaggttgaattaattatttatattttcttgctggaaatgagtgatattccaaatgttcaagtactctgtgtgtgtatgtatgtatgtcataaaaggacattcatgacttggcttctgactgcctcactgagccctcccacctgatcacgcatacatacccccccaaccccactcccccacatacccccttcaccccagccatgaacaaccactctcagttccctgaatcccatgctgtttcatgttcataatgctgcatctacttgaagtgctctttttccatctttgttctttctacaaattgcaattatttatcttgcaggactcaattcagttatacattcttccttctcacctctgtctctctgcctttcaccccagtccaattaactctttcttcttctgtgcctctactgtacaatatgcagatgcccatcatagcacctaggacattttattgtccttattcgtgaacttattttcttatcttgctagtatctaagattgttggagggcaagaatcttatctggctttgtatctcctgaagttagtctagtgtttggtatagagaaggtacttacttatttatatatttaatcaattagctgagttccctgctgtttccccaaacaacttcctatcctctccagaacagttttcatctggtagtcagtagtagtattgccaacaatactgctatgtcttcacattttaaaaatatatcacaagtaaaaaccattgtattagaatagcaatacatctaaggattgtattcttaaaggttttcaaagaggtgcctatttgtaacaatggttggaaataaattgtttaaaattgaggcttaacctgcattcatgtaaccaccaaccagatgcctttcccagtcaatatcctccccacactgctctaaaaaaaaaataaccactattctgatttgtctcaccgtgtattagctgtgcctgatcttgaccttcacataagtgagaccaaacagtatatatctttctgtgactggctactttcattcggcattatgtctgtgatatttttccatgtgaattcttgtgttaactgctagtttgctctttttcattgctctgtagtatctcattgtatgaatatgtcacagttttatttatctgctctactgttgatggacatttgggttatttctagacttggccttgaacataaagttttgtttgagaaccaaactacagagcatagcattagacctgctttttgtcctttctctgccttctgataggtgatgaattgatcttaatataggatgtacttaactttactcactcagttaagaaatatttattgagtacctgttatgttccaggtcctgagtaattgtccctcccttctggaatctcacagaccactggggaaggcagaccctaaacaagcaattataagtatgctaaatgttgtaacaaagaaatagaagatgttctaggtgtttataacaggaagacctaatctggtacgagggttagggagaatcttcccacagaaaggatatgctagctaagacccgaaagagaaacaaaagtactgttgggaaggaagacaaggaacaccattgcaggaaggtacaaggtcctgaaatggtaatgaagattgaaagaagccccaggtagctgaatcatagagagggaagtagaaaatggtaggagatggggctggaagggtagacagaagccatgtcattaagggccttatgagttatctgagcaatgtgagtcctcatccattaaagagttctaatcccacgaacggacataactttaaatttttttcttttgatgttaaccttacaaattctgaagtgcgtaaatcttaagcacaaagaatttttccatacatttttactaacacaacagctattccatcagtaaaattccagcacctagaatgtcctctccttcccagtcaataccctctctaagggtagccactattctgacttctatcaccagaggttacttttccctgattttgaactacaataataacaaaattatccagttgtgcacctttgggtcagactactttgactcagcctaagagctgcacagttcatccacgtgttgcatgtagcagtagcttgtcttttttattattctgcagtcttccattgtatgagtataccacaatttctttgcccactttgcccactttattgattgacatgagaattgcttttttttttttttttggctcttgtaaataaaatgattaggccaggcacagtggctcatgtctgtaataccagcattttgggaggctggggtgggaggatcatttgaggccaggagttttaagcaggctgggcaacatagcaagactccatctctaccaaaaaaaaaaaaaaaatagcctggtatggtggcctctgcctgtagtctcagctactggagagtctgaggtgggaggattgcctgagcccaggagtttgagattgcaatgagctatgatcacactactgcactccagtctgaccccatctcagggggaaaaaaaaaattaagctagagctgcaataaataaataaaactgttgtgaagatttgtgttcatgtcttttgattgacatgaacactcatttctgtgggaggtagaattttcaaaaagattactctgcgttcagggtggaggctgatttggaagagagcagaggtggcagttcctcaggcaccagctcttggatgtatagccttttgcaagtcatcttagtaaaaacaggacacattcataacagtttaaacatcacacaaatcaaagcgtagattaaaaaatggaaagcatatttccttttggcttctatcattactgtcgttttcatagttattatcattgtttacagccagctacagcttagagctgatagtaactggagagacaatatgatatgacaagttttactgacttgtcattgaatatgccccaataaacaaaaccattattgtcatgaaacatttgtgaagccccgttttcacgattgcttcttgttgtgccaaacccttgttaacctcaataggaaaggcaccaggttcaagaggtcaaagaagagacccagagccagcagataagacatgacgttttattatgggcttacatacaggggagagagtccagtgggggcgggctgggcaggaaaaccgcaaccacctacaaacatcatgcagtttatagagcatttccacttaccaccctcgcaccaacgacctccacctggcaaccttaatgtaacccaaaactcggggcctcaatcccccatatggctggtgttccatgaaatcggccaagggcctcagatgtttatcctagataaggaaggaatctccaggttagccactcccaaattacctagctcagaacacacattcaggtgcatcagccacacaggatcattctaaggagatgcttaaattattgctctcaggtgtgcttgccctatgctctgtgtgtgtgtgtgtgtgtgtgtgtgtgtgtgtgtgtgtgcgcgcgtgtgtgatggtgctggagatgtgtgtctgaagtcatagacatatttctctgaccatatagaaccttagattcttagcagcatctctgaactgtcctctcaggagctaaaacagtacagatacagagcattcggcaaactaaagttgttttgcttttggttttgtttctgaattgtgaatttatttatgtcttaaaactttaaaatcagcacattttgaattgagaatttatgtcttaaaacgttaaaatgagcatattcagttatatatacatatataatgaattgccattatagaaaataatacaatcaggtgaagttaagagtactattgtagaaatacccaagactttcagccacaataaatgttcagtccttagaaccatgggaattaagatacagcatagtggccaggcgcagtggctcacgcctataatcccagcactttgggaggccgagacaggcggatcatgaggtcaggagatcgagaccagcctgactaacatggtgaaaccccgtctctactaaaaatacaaaaattagccaggtgtggtggcacgcgcctgtagtcccagctactcgggaggctgaggcaggagaatcacttgaacccgggagacggaggttgcagtgagccaagatcgcgctgctgcactccagcctggtgacagagtgagaccccgtctcaaaaaaaaaaaaaaaagatacagtgtagtaataaggagttagtggtctgatttcaccttaccagatcaggctcttatccactactccaattatactctccctcttttcaccctattctgaatgtgctgtgcatgtgcattaaattaacaaatatttattgagcacctgcaatatgccagataccttgcaaggtgttagagataggaaggcacagtcactgatcaacaggaattagcagcctagtggaagagatagccaattgaaccagtgattaccacactccagtgagagtgtgggccaaaatgccagggtcctctggtggcacagaagggacatttaaatcagagcaggtaacccttgagctgattcttcaaagatgagagtcatgagctaggaatagtattccagacactaagatgaggaggcacaaaggcacagaggcagaaattagcctggtgcaggcaaggagtcactcgtaatttagtgtggttggagcaagagatgggcatgttcagaggaactggagagaagcatagaggaaaataacaataataataattttaatagagaaaaaaacttttaaaaagagagagagaagcctagagaggggtaggcaggaggcagaactgaagaggcttggtgctcaggaaggggctaagtaggaaggatcgagaagtaagaggcctgttcaagctcaccctgttcacagtggtactcctcatgtgtccttaagcatgtcattgggcctcgttagtataaccagagaactagggaaagttcccaaaccatgaaacactgtccagtagatgtgaaaagatgggctatgaacaatggtttcattactttgatagttaagggaagactgaatactgcattggcctctttaagactcatcaagactccagcatattaaaggtttctgaagtcctccagtaaaaacaccacttcggttttctttgattcagtattttccaaattatgtggaccgggagccaattttctgtaacagaatattagtatcatgaggcagagccccattctggcaaacagtggactagttctcaaaggtacaatcatccttattcattcactgattaaatttttttaagtgcagaaccaaacaactggttcactttatactttagattaacagcgtatccctgtaataaactttaggtatttattttccacagcaatgtttttttttattacatcaactgtcctgggatttattttttcttttctcatttttcatgtcatgcacagactttattacctggtaataagttgcaagaaatgtgaattgagttgtttctaagcaaatatcaatcatttatgatttgtttaatagaaattataatgaagaaaatcagggttttgcttattataaagtcattatagtcaacattagcaaatctcaaaattaataatgtgtcagtaaattatttgcattgctaaagagatcaaataaataaaaacaggattgaccttgttagaaatttgatattttcaacatttatctgtcagagccactgatttggaaattgttataaattcttgaaaaatggaaacttttttccctgtaaaaatacccatcatttggcaaactacagtgtcatttttcttgaagagaatgtagtgattgattatccagagtgctaccatgacaaggtaaaccaactgaatagctggaaaattgtgtgtaatcatatagcatcacagaggctctgcactgagcacaaccattagaattaaaccatggcattctaatcattccctgctggtacttcctgttcatccccaaaaccttgacctccagtgggtatgcagaggtgttcgcagtcatcccttcccctccaaatgctatcagcacaattctcgtcagctgaaagctctgcaataaatacaaaccaaacccaaaccacccaaggagatttcaaaatgcaaggtgtctgtgtctaaaatccctcatatatatgacattctgagatttattctgtgtattaacattaatctagtttcttttattaatcgtattgtcctgagaatcctgagagattataaacaactgagggaagggaaggatgggagatggacaaaaagaaaagaggaatgctgatccctcttgagaggctgataatctattcagaaagacgaaatacacctgagatgacttgagagcagttacacagtattcgcccagtgtgaaagtaccagtacacaaatttaatgcatgagtcatgggggccaacagagtaaaggagcaatccaattatccttgtttattagagaactaaattgagtcataagaaaggaaggggctacccaaacctaccccagagatagttatcaatagcatacttgggaccagaacaaggccctttctcccaataatcagaggcatctcctcatgctcatcttccctgcaatgttttagattttaaacaggctttgttaggatggctgaactccagtctcctttattaattgctgcccacatgttgtaggatatcctgtgttctgaatcaggatgaggattttaaattcttcttagcgtagggacgtgtagccaggcagaatcaattcctgtcactcacacacaaatacagaggaatgggattatggatcagggtgaagctgcagtgctttaatctcaaaatcaatacagaaaaggaagttgaacttctggggattctatagagactgtaatttggcttcctatgaggtttgccttatagaatatagctgctccttccttttcaccttctgattattttactggggtgggaaaaatgaggggaaggggaaagatgacaagaaacttctaccaccaaatcttcttgaataagcatgcaagtgtaactcgtaattcaagctaatccattgtgttgagaagagctatacacctttgtttattcttttagaaaataattagccaaaaccctgtaccccataatctgtatttaagcataataaaaatgcctttgatttattcatagttcactgtcaagactggaaaagtattttttaagcatacttttatggctaagcttaccatagcctatgtaattttatataaatacaaaatcaacaaaccagttattgaccgaaggattccaagctgctcagcctgtgattaatatttaccccagtgtatttctgcttcttttgaaagaggcatgaactaatggtttaaacaactcagtcttttcttaataaaaaatttagaatttgttgactatgcgtctttttcagatataacactgatttgctgcacagtgctgtcggcatctagctttaagatgggcttatttttcctttcagatagtttttttaattcagttttaaaatatgtctgagtgtgtttggaccctgcgcctacagtggtgacagcaatatgaaacactgtaatctcgtgagaaaatgcactgtgggcagcagaactccggtctggctctgaggcagaatggtatacttagaggagcaaagcctggagctccttctttatttatttcatctttctaagcttgtttcctcatctttaaactggggatgattataggatacacctgataggggtgttgagaggattaaacaaaataaaatatccaaagtgcttatcattgtactttgcacttgtaagaaccctttaaatgttcatgattatcatgattattatgtgagtctcaagtgagataacatatgctgtgtatgtgaaaacattctacaagctgtaaaacacaatacaaatgttagttgttattctgaatagattgatggttttgaaacttttaaaataaatcatggaaggttttttctttgtgctgcctgtcataggtccctaatctcaaaaagccttggagtgataaatcaggctccaactgaatatgcattttctgtcttaaaagccagagttatcttgtgagtgtcaagaattccatgatagcgacttgaaaatccctattctgtgtccttccagagaaaaaacttgctcaggtcttgggaagaccagcgctgtgtaagatacttatttggttgttgttttgagttcatatttcttttttttttttcagagtccacagagctattttattattattactattattattattttttttaattatactttaagttttagggtacatgtgcacattgtgcaggttagttacatatgtatacatgtgccatgctggtgcgctgcacccactaactcgtcatctagcattaggtatatctccgaatgctatccctcccccctcccccctccccaccacagtccccagagtgtgatattccccttcctgtgtccatgtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacgtgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccctcgcccactttttgatagggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggctttggttgccattgcttttggtgttttggacatgaagtccttgcccacgcctatgtcctgaatggtaatttctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattgccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaatagtgaatgggagttcactcatgatttggctctctgtttgtctgttgttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcataaatagctcttattattttgaaatacgtcccatcaatacctaatttattgagagtttttagcatgaagggttgttgaattttgtcaaaggctttttctgcatgtattgagataatcatgtggtttttgtctttggctctgtttatatgctggattacatttattgatttgcgtatattgaaccagccttgcatcccagggatgaagcccacttgatcatggtggataagctttttgatgtgctactggattcgttttgccagtattttattgaggatttttgcatcaatgttcatcaaggatattggtctaaaattctcttttttggttgtgtctctgcccggctttggtatcagaatgatgctggcctcataaaatgagttagggaggattacctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctgtttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagagtcttaatcctgagttctagtttgattgcactgtggtctgagagatagtttgttataatttgtgttcttttacatttgctgaggagagctttacttccaactatgtggtcaattttggaataggtgtggtgtggtaatgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatgtatatttaggatagttagctcctcttgttgaattgatccctttaccattatgtaatggccttctttgtctcttttgatctttgttggtttaaagtctgctttatcagagactaggattgcaacccctgcctttttttgttttccatttgcttggtagatcttcctccatccttttattttgagcctatgtgtgtctctgcacgtaagatgggtttcctgaatatagcacactgatgggtcttgactctttatcgaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtagtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgataattatgtgtcttggagttgctcttctcgaggagtatctttgtggcgttctctgtatttcctgaatctgaacgttggcctgccttgctagattggggaagttctcctggataatatatcctgcagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatggtctgaagccttcctctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttcatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgactcccagttaggctgctcgggggtcaggggtcagggacccacttgaggaggcagtctgcccgttctcagatctccagctgcgtgctgggagaaccactgctctcttcaaagctgtcagacagggacatttaagtctgcagagtttactgctgtctttttgtttgtctgtgccctgcccccagaggtggagcctacagaggcaggtaggcctccttgagctgtggtgggctccacccagtttgagcttcccggctgctttgtttacctaagcaagcctgggcaatggcgggcgcccctcccccagcctcgctgccgccttgcagtttgatctcagactgctgtgctagcaatcagcgagattccgtgggtgtaggaccctccgagccaggtgtgggatatagtctcgtggtgcgccgttttttaagccggtctgaaaagcgcaatattcgggtgggagtgacccgattttccaggtgcgtccgtcacccctttctttgactcggagagggaactccctgaccccttgagcttcccaggtgaggcaatgcctcgccctgcttcggctcgcgcacggtgcgcgcacccactggcctgcgcccactgtctggcactccctagtgagatgaacccagtacctcagatggaaatgcagaaatcacccgtcttctgcgtcgctcacgctgggagctgtagaccagagctgttcctattcggccatcttggctcctccccctgttttgagttcatatttcaaaatgtcacattcttgcaggagagctcaggtaccttaaattatgacatacttggagttgtccttccttgtccaacacattgactacagaaatctcatatcctctctttgttgttcatttccagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggtagagcttctgttaggggctaagcaaagtaacgtttgagcctgatggtggttccaattggtgaaattgcttcaatagcctaatttccaaaaggatcatctctgagtttgtcaagagatgagaacatgcatcatggaaatagcctcctagacctttgtgtagtcagaccaacagagagaatgaaagtgatgaagggacgcagccactaggactaccaatgcatggctcagattatgtgtcagccttgatgttcatgaaaacctagaatgataagatcatgttcctcaaggaaattccagatcttggttagtctatcttgtggttaaaaagatccttaaagtagagcaatttgaaactcttaataatctttaatagtgtttccttttaattaaaaatatattcttcctgatatttaatttgtagcattcctactgtcacaaaagaacagttacccctgttttcagcatcagtagcaatgaaaaaccattgttatgaacttgaaaaccattagttatccctctgatttccttccttaggttcaaaaaaatctctctgggcttgtggaaaagatcatagcaattctctaagaaagctaataatgggaacaaattataatctggttcacaagacatgaaacaattagggaagaaaagaatgtataataaaatactaaattatatgtgatatataatgaaggatagataggtaaagtgcagtacataatcaggtgctacttgtacagtatagactgtgagggcagaaggaacaaaaaacaagaaagagaaaggggttgtagtcgggaatggttttgcaggtgaggtatgtgctggactcatgaaatttacggaggtggagagaaacataaaggcaggggtggaggaagcaataagacagttgccccctattttattttatttattttatttatttatttattcatttattttttgagaaggagtctcgctctgttgccaggctggagtgcaatggcacaatcttggctcactgcaacctccgcctcccaggttcaagcgattctcctgcctcatccccctgagtagctgggactacaggtgcgcgccaccatgtctggctatttttgtatttttagtagagatggggtttcaccatgttggccaggctggtcgcgaattcctaacctcatgatccgcccacctcggtctcccaaagtgctgggattacaggcatgagccaccacacccggcccagttgcccactatttaaaggggacaatgaggagatagtttgactggaacagagttcctattagaatctagtaggagataatgttgaataggaagattaagaccaactaaaaaggggtcataaaaaaataacattctgaaaatgtagatgttggatagcagatatggaatcattataagtgagcaaggaagcagtgtttacggaagatgaatttggcagaggaatacaacatagattaatgcttatccttcctcattccagcaagaagaatgatccacagttacatggacaaattaaacaacaaccatctcattgagatgcagtcccaataaccttttatgttcaataattatttatcaaaacttatatttaggttaaaatcatacatatacttaacaattatgtcaattggttgtgtactaaataataattataatggcaattcaaacaaaagaaagttaaaatttagccttgtggtaacagaaaatttaaagtttttggattttaatttatacagatagtcttttgtaaaaagctacaatggaataataaaataatttcaagcataaaaatatatttcattaggataaattccagtgaggaaatgaaatagaaataataattcaaagagaaaaaggaaaagcaaaacatatccagctgttaaagaagagcttgttcatatgtattttaaatgtataatggagggtatcaaatccctatggcattgagattctattggatgcttttttaaaatttttaattgacaaataataattatataatgagctacaattggatgttctgatatatgaatacattatgaaatgattacattcaatctgattcacatatccattacctctcatacttctctttgtgtgtctttgtgctgcagacatttaaaatctactctcagcattttgaaatatatattacattattgttaattatagtgaccatgatgttcaatcagtctcaaaatggcattccttctaactgaaactttgtatggtttgagcaacatctccccacctcaccccacacccaccccaatcccccagcccccagcctccagcaaccgctgttctaccctctacttctataagttcaactcttttagagtccccatataagtgaaatcatgcaatatttgtctttctgtgcctggccattggatacatttaaaatagtgatttttaacagtgtcagtctttagggtatgccaaaatttatatctgttgcatctatttaaatgcaggctaaaaaaattaaatgtcaacttaaaaagggaaggagaatatagtttttcaaaattattttaaaggatacaccaataacaattgtaaaagccactattctaggttaattgcctgagattggaatttctgggccattagagtcttggattttcagttttacaaaaccagattccaaagtggtagtaccaacgtctcatctaccaaaagagaatggaataaaatattttaactattaaaacttaggcccgatgcagtggctcacgcctgtaatctcagcactttgagaggccgaggcaggcggatcacgaggtcaggagatcgagaccatcctggttaacacggtgaaaccccgtctctactaaaaatacaaaaaaaattagccgggcgtggtggcagcgcctgtagtcccagctactcgggaggctgaggcaggagaatggcatgaacccgggaggcggagcttgcagtgagcagagatcgcgccactgcactccagcctgggcgacagagcaagactctgtctcaaaaaaaaaaaaaaaaaaaaaaaagagttcgagaccagcctggccaacatggtgaaagcccatctctaccaaaagtacaaaaattagccaggtgtggtggtgtatgcctataatcccagctactcgggaggctgaggcaggagaatcgcttgaacctgggaggtggaggttgcagtgagttgagattgcacccctgcactccagactggatgacagagtgagactccatctcaaaaaataaaaaataaaaataaaacttaaatattaaaaagtttaaaatttttaaaataattgcattttaataatattatattttaaatttatgttgaacctccattaaatataaagctttttttttttaagtagggcatgccctctttttctagtaagttgtctgattatgggcacccaataactttcttacaaataataatgttgataaatagtaattatagtggagatgttgcgtaacctgaccatgataaggtcaagttgtctctagaatgtaaatcccactgatagccgtttatattgtattattgatgttgttgtcttgaaagacatgttttaagttcttgcagcttggcaccatattcatcatgggtgattttttttccaatcatttatgttcctgcctctcaagatgtcaagtggctggaagccactgcatctgcaaagcagactgatcattgttgaatagttttcatctggaagttttctctttgtttgaagtgatactctcctgtccattggacatagttcttttctctgaatgataacaaatcagtttaatccttttatgaatgcccttgaaatatatgaagatagctatcatagtccatttagtcttgctttccctccttaaactgaacattcccagtttctggtatgccctggtctatgaactatctcagtcatctttctccattacccattagcttggcagtgtccatcttaaaaaggagtgccccagagtatacccagtgttccagatgtactcttttttttttttttttttttttttgagacagagtcttttgccagagctggagtgcagtggcgcaatcttggctcactgcagcctctgcctcccgggttcaagtgattctcttgcctcagcctcctgagtagctgggactacaggcacaagccaccatgcccaactgtctatttatttatttagtagagatggagtttcaccatgttggccaggctggtctcgatcgaattcctggcctcaagcgattctcccaccgcctcggcctcaccaagtgcccagatgcactctgggtgttgagcagcaccatcactttccttgttcaggacccagtgctggacacaatgcttcttagtgtgtcctatcattgcatttgtcaggtatttactgagcatttaccaagatgctgtgagggtgtgtggggataaagaaattaatcagtcaagattctacctttcatgtgctcatattcttggtgaagaatagaaagggaaatatgggacaaagaaatagaaagcatgtatccacagcattaattcatgacagaaaatatggcaagataggtaaaaatgccttgctgtgggaggaagaaattacgaaggaggacagggaaggcttagtgaagtatatgaactaggctttgtgaagagtgaagaggaattagacataggtttgaagaagagcacgaacaagtgataaatgtctaggatgtggaaaggaaagcttgggtcagactggaggatcgcgaatgtcagactcaaggaactttgcctttttaaattaggtagcgaggagccactgagtgggtgttaagcatggagtgccacgtgcacacctgtgctttagggaaatttttctgagttttgtgtaagatggatttgaaaagcaagagtatagagatagaggggagagagacattaagtgcctgaatcaggggacagggaaggaaaatggagaggaaggaacagattaagagatagtaaagaggtaaacttgataagactttggccactgattggctatagaagaagaaatacagattgaaattagtattatcttttctatgctgtatttatggtgatttttgtaaaacacaaattcaggatctcacatttatccattaaatttaatgttatttatttatttagagagattctcactctgttgcccaggctggagtgcggtggcacgatctcagctcactgcagcctccgcctcccagattcacatgattctcctgcctcagcctcccaaatggctgggattacaggtgcccaccaacacacctggctaatttttgtagttttagtagagatggggtttcaccatgttggccaggctggtctcaaactcctgacctcaggtgatccacccacctcggcctcccaaagtcctgggattacaggcatgagccaccatgcctggccaaatttaatgttatttttaagtcaccatttcagcctattgagatatttttgaatcttcattctgtcgtcaaaaaatcttagctattcctgtaagttccttgtcttccttgattacataagcaatcttttttttatgcatgtcattgaaaaaatgtccaacagcataagactaagttgagaattggggagctatacctcctgacacttccttgtatgttgacatctgtatattacttagtgcctcaggagttcatatgtttttctaactaggaacctgggctttagctcaagagcaggccctacagcttaagtttaaatgccagcttttctacctactatttatatgacactgaaaagctcctcagcctctctgccttgatttcctcatctgcaaaaaggtaataatagtcctttcctcaaagcgttatttcaaaaattgtcaatcttttataactggttttagcgaagtgatatgctcccccaaaaatgatttgctgctattttgataatgataataatggtaatgacagtgattgcctttaccagttcccatgacactattccacatatttcataatctgccctataaaagattgatcaggtttcttgctggtgtcttcccagcctgattcttttaatgcagccaacccttcctcatgttggcatgcaggcctgttatggacaatactagatatttgttcaagaatcctcccatccctttactgttaggacccacttctcccaactgaagcattccttaagaactctcttcttgggcagctttcaaattacctttggaaacaagatcaagataaccaagagccaaatttaccaccgccccagtcagttaggaaaggatcatgtgacctattcttcgtgagatcctcctagcttctagtgagtaccactttctaattattcatgaactatgttttaattatctgttcagaattttgcctacaattccaaattcacctcatttctgtaatttacgttgcttttcttttatgaacatcagggatttgctcccaggcattttctcctgtgtgtcaggataccttcaaaaatgatcagcagtggttctgtgattccatgctttgaattatttcggcatcacaagatccttccctaaatttgttaaacctttcaggaatttttttgatctcaataaccattaacaaacacagtggatcactgcatctttaaaacaatttattcacttggtttctagaattccatttattcaacaaatatttattgagtgctagtacaagagtttgtagatataacagtgaactaagcagattaaatatctgctttcatggggtttatgttctgttgtgaatgggagaggggagatagacaataaatgaatgtaatacataaacataaagaattttagggccgggcgcagtggctcacacctgtagttccagcactttgggaggccgagggcaggcagatcaccaggtcaacagattgagaccatcatggccaacatggtgaaaccccgtctctactaaaaacgccaaaaaattagccaggtgtgttggcaggtgcccgtagtcccaactactcaggaggctgaggcaggagaatcgcttgaacccgggaggcagaggttgcagtgagccgagattgcgccactgcactccagcctggcgacagaatgagactctgtctcaaaaaaacaaaacaaaaaaaaaaagaattttcgaagatagtaagtactgtggagaaaagaaatggagtaaagtagatagactcaggagtgtgagaggagcaggttgtagttttaaataggatgccccagggaggctctgttgagttgagcttagaggaaaggctccaaggagttgaaagagtttgaccagccatctgggtagagtgcactggcacagggcaaaggccaggaggcaggacgctccgggacacttttaaggaacagcaaggaggccagcatggttggagtaaagtgagcgagaggaggaagggtattgaaggatcaccaagagggaatggaggtcttggtaagccactctagggatgctgagtactactctgagtgaaatgagaagccattacaaggattgtgcgtaggagcagcatgatcttacatatattttaaattttaagtattgaaaataggctttaggtagtcaaggatggaagcagtgagaccacctaaaggccacagtggtaacccaggtgagaaatgaagactctttgcactgttggtagcagcagagatggagggaactgggtgaactctgaatgtatttgaaggaccagccagctgaattccctgccagattgaagatagggtgtgagagaaagaaaggtgtcaaaaataactctcaggattttatatttgagcagtgaaaagatggatggagttgccagctattgtgacggaggatgctgcaggtctaggcaagcagatcagtgcttaaatttagagtgtctcttagccatgtgggggagggagttggacatatgcatcaaaacaagagaggtctggcctggagatagatatttggcagccatcaacatataaatagtatagctaaatggaatttaaaactatgggactagatgaaatcttcacaggagggagtatactcatggcaaagaagaggaccatggacttttatgaagtttgcaagatgacgagaaaccatcaaaggacattgacaagcagcagccagtgaaggaggaggaaaatctagaaaatacagtgttgtagtgttgccagcattagaactcagcacggactgagtgataaatgtagcacggactgagtgataaatgtaaatgtttttgtggagtagtagggatgaaaactggatgggtgtggccttaaaaaagagactgggagtagaggaagggtaaatagaggcaaaacttttgcactgagttttgcagcaaaggcgaacagagaaatggcatagtggctggagaaatgaggtcacaggaaggtttttttgttttatgtgttttttaagtcgaagaaataagtacatatttgtatttgaagaaaaggacttgggaagaatgaaaatttggtgatgtaagaaagaaaggggaaaatccctgaaattatgtttttggccagggaagtagcggtggaggaggggtgtgcaactggagtgattggtttaggcgggaacatggatagttttgcctgcgctgtctgtccgttctataggaattgtgttatttctctgtcattcatattttaccgctttgtccaaacagcaaactctatctctcttggactactactctggaacatggccattgctttggtttttgacatattctggtcatcaggagcattttgattccttcccgtaagaaactctactgctgtggcatctctgctagccacagtctctgaaatggtgtccacctgttggtgcccactgtcacatctcaggggattatctgggagggatctaccatagttgctgaatgatggacctgggttaaatttttctcaggattgggaaaagtattctttgaggctttgaaagggaataaatagaaaatcatctttctggttgttatacaacaatgcacactcaaaggcacaacacatgcccccacggtgctgttgctgctggttaatcagcgtattcaggtttctggagaaagtgttttcttattgtatgactctgaagatgcaaagtgtccttacttcctctcttcccatttattgccctcccccagattggcacctgctgaggactaattagggcagtcctaatttggacggccaaatcctgattacagtgaggggaaaaacaggaaatgttctagttttgctgccagcaaatgactgacttaaatagaaagccatatacaattcaaatgatccaaaatggtataacactggggaaggaggaagggagcaggaagacgttgcactctgattttctcccatgtgatcctcagcagatatccttcagagaaatcatcaaatctagaaactcacaatgccctctgctgagggttggcttgttttccaagcttcccatgaaaacctgggcagctcctgggagcttagagatctgaggaaaggtgaaaaacatatcacctttctatgagtacctcactctagagacagactgtgcctcaggtaatgtcaggttacatgctttggataaagaggggtttcctaaacagggaaatgagggctagaagtcttttccctaattatccacaccccttggggcttaaagggaaactcagctgtgaattctgtactgctcctcattaggaatcaggcacttggcccatgagttgcctacttccaagcagagtgcttccctccccttgcctgtcctctgtcctgagatccatccagcagctcatgtgtcccaaaataataatttaaagattggaaatcgcagttttcggaagtttctctctgttccaatttactatcagttcattaatcaatttttttttcttggaggtgggggataaggaggctctctgccttgtgttgggcctggcagagaatacaaataaaacctcttccctagtgttagaggctcagttggtttgagttgatttaagacataagcatgttacctttagcacacccctttcacaacttcagagaggagctagaactcatgctggacatgaagaaagagtgagaggaggagaagcctgcactcgctgatggcagacatcagagctggcacggggctaggcagcttgttgaccctcggtatgctcattgaggaaatttctaccagactgaacaggacgagcaagcagtggagcagcatggacgaccatggtgcgtgggagaaaggttgagaaatcacagtgactagagtggacagtgtggttgggtagaaatgggcaggaaaggagaaatttcttgtattaggtaaaagagtgctttcataggtcttggtaagaaggagtacatgatcgaagtggtgttttatgatctcactggccccactgtgctaaatagcacagactagacactagggactctggtggcttctgaagcccttcaggtttcctgtgtagccagaggccagggtcctataggaatgagactctccttgagctggccttggagcttttgccaacctaacttaactttgaacctcagagtgagaggcaggactagctggatttcttggccaactaagaatccctaagccttgctgggaaggtgactgcatccacctttaaacacgggggcttgcaacttagctcacacccgaccaatcaggtagtaaagagagctcactaaaatgctaattaggcaaaaacaggaggtaaagaaatagccaatcatctattgcctgagagcacagcaggagggacaatgatcaggatataaacccaggcattcgagccggcaacggctaccctctttgggtcccctccctttgtatgggagctctgttttcactctattaaatcttgcaactgcattcttctgctctgtgtttactacggctcgagctgagctttcgctcgctgtccactaccgctgtttgctgccatcgcagacccaccgctgacttccatccctccagatccggcagggtgtccactgtgctcctgatccaccaaggggcctattgccgcccccgatcgggctaaaggcttgccattgctcctgcacagataagtgtccgggttcgtcctaatcaagctgaacactagtcactgggttccacggttctcttctgtgacccatggcttctaatagaactgttacactcaccgcacagcccaagattccattccttggaatctgtgaggccaagaaccccaggtcagagaacacgaggcttgccaccatcttggaagcggccagccaccatcttgggagctctgggagcaaggaccccctggtaacaagaacggccaagggtgtataccagggaaaccctctgcaagctccagcttgtgatctgtctcttgaagctatgttatctcctaacactgatatatattcatttctattaaacattaaataagtaccaaaaacattataaaatatacacaatatctgtttcatagagggcattcagcaagtgagcttttattgtgtgctcctataatttattatgtgtaactttatgctggtatttattccattgtattgtaatttagacttttaaaatatattatttcattagttattggtttaactgtctttctttaaaaaaaatattgtttttcaattgtagcttcacatcaaggttatttggggaaacttcaaaacatacatcctgggttttccatactaggtccactgagagttgggcccgggcaagtttagtttaaaaatatcctcaaagtgattgtcatgtgttactggttagaaatcactgatctgggccaggcaggcagggtggctcacacctgtaatctcagcactttgggtggcctaggtgggtggatcaccttgaggtcaggatttcgagaccagcctggccaacatggtaaaaccccatctctactaaatatacaaatattagctgggcatggtggcaggttcctgtaatcccttctactcaggaggctgaggcaggagaatcgcttgaacctgggaggcagaggttgcagtgaggactcggtctggaaagaaagagagagaagaaggaggaggaggaggaagaggaggagaaggagagagaaagaaggaggggaaggagggagggagggagaaatcactgctctgaactcttagcttccagaagttattatgtcattttccacacacctgtctgcagtatcttgcatggtgtctctgtataggccttgcactcttgttttttgatcaagtgaatcccttcactcatcctttccagtacatatcagttgcccttctggccaaatacagatgctgcccacctaaccagttgtcctacaaattctgtagcaagcagccagtcctcatttctcctacccaactcactctaccataatcagataggagtctgttgcagtgaccttgacacaaagtaacaaggacctagactggaaagaaaatactcagtaaagtattaatacatagtctctgtgcaagggactttatggtcacagctcatctagtcagtcacaacaattctgttgaattagattctctgcctttcagatgaagaaacagaggttcaggaaagttaataacgtggcaaaggccacagagcataaagtggtagtgcacatgtgaaaagcactagctctgtctcagtcttcagcccaaagaagaggcaatggaattaaagaggaaataggaaacctgaaaaatgcttcacatgctttagagagacagtgtaatgactaggaaaatagactgcagaacagcgggtctgggttcatttcaggttctaccttgctagttggctgaccaccatccagttcccagccttctgtgcctctgtatttcgcctatcaaatggaagtaataatagtacctaccacgcagggtggttgtgaggattaaaagtttatatatgccaaatgctcagaagaatgcatagctcatggaaaaggttaaattgtcagccaatacaattatttattgttgctgcaattggtgttttgtattattgacttttaaattaattcattgatgatattattgatattcaataagaagacagtacaagaaagtttttttaatttttttattatcatactttaagtgctgggctacatgtgcagaacatgcaggtttattacatcagtatacacgggccgtggtggtgtgctgcacccatcatcctgtcatctacattaggtatttctcctaacgctctccctcccctagccccctaactcccgacaggccccagtgtgtcatgttcccctccatgtgtccatgtgttctcattgttcaactcccacttatgagtgagaacatgcggtgtgtggtccagaaagatatttttatgtcgtttgttattttcctggcgttttgtgcttcagttatgtcattcattccttcaatctgttactcattcaaaaatcatttattaagcacttctaggagccagcgttattctagggctaaaggtgaagaagtgaattgactaggtaaggtccttgctttcgtggattttacaccttaatggagggagctagataataatcaagtggaaataaacaataaatttctcattaataaggatgatgtgattaaacaaaacaacaggttcaagtgaggagagtaggttcagggaagacgccgcagaggacgtggcatttgagctcagttctaaaggatgagaaggagccatgtggaaatgtgggaaagagcactccaggtggagaaaggagcaagtccgaagatgggaactagcttgaattcaggttaatgagcaaagagaatgaatactgagtgacattagacaggtagaggggtcggatcatttgggtcatttctggctgcacatgagaatcacatgggagcttaaaacatagccagactgagccccacttcagactgtgaaactgatgtatttttaaaatgcttcccaggtgttttcatgtgcagtcaggattaagaaccattgataaaggatcttgaggctagagaatttgaattttattctcagttcagtgggaagacatgcaaggtttaaatagggagtcatctgatctgagatctacttataaagatcttaatgatattcaaacacagactatatttaaatttgctttattataagaaaaatctgaacattgacggttgagacagattttttttttttttttttttttttgaggagttttgctcttgttgcccaggctggaatgcaatggcgtgaccttggctctctgcaacctctgcctcccaggttcaagcaattctcctgcctcaacctcccaagtaactgggatcacaggcatgtgccaccacactcagctaatttgtatttttagtagagacagggtttcgccatgttggccaggctggtctcaaactcctgacctcaggtgatccacccatctcggcctcccaaagtgctgggattacaggcgtcaaccactgcgtccagctgagacagattttatatgaattcttggtccacttcctgtgttacagtataatttttttcttcttgatcttttaagtgtcaaacagttatgatccttcatatgagaacttgtctatttaaaggttgttactaaattatccccaagagttaccttctgtaaactgtcattgcaaagcctttttcccttggtcctcttggatggtttctgttttccatgggccttctccagagttatcagaagttgtcattctcaggtagacatatacactatcataaagctctctgaccagcattgagtatggtgtcaaagatgttctgatgtttctttcctcttttcctatgtgtgttgctccatcttaactgactttttggttttgtttttgtgtttgttttgttttatttggcagcataatactattatctttgcatccctaattgtcattatcacttgtgttgctggacatttcactgcggtttcgtctgctgcaggtccagtcattcacagtctaaattggacgacggcactttactttggaccagtcttgtccaaggttcatttgttgagcttggctcctagtttttgaagtatcttgaaagattcagtctgggaaagtacacatcatgccctggctgtcaccaaacaattgaatccaattagccccacctgcacctggttgtttacctaatgaaagactcagcaccccagctgtgtccagggaccatgcacactcgcacttcccaactgttccagagaggaagcggtacacatcagagccaggcgacaccagcagatgttttctgaatgaaattcactcagctgtatctcgagggtggacctttctcttggcagcctcatcacctgtaccaaaaggtacacctattttcctcttcctcttggaaacagatacaaatagttacacagttggctctgtctgtggctcattgagctgtgaattaatgagtacattatggttctggtagggatgattaaccttgcttctcctatggaataatttttggacatgtagctctccttttttgaggctatttggatatgtcctggaattctgtaacccacatgatctggtttaccagaaaatcaaaaacaaataaatgcaattagtcagggtggacttgccacttgagtaaaaaattttctttagggtaattgtttattgctgatcaatgccagtatttcaaattagaatatttggaattacttttgggattggtgttcattccaaatgtactaacatatttattgttgagggcagtatgttagtagccttttcattcatttggatgactattttttaataaaatgggatcgatgcatattagagataatgtaatcttgaattactgaattaatccagtcctttaaaaatatgtaagtaaataatgtgggtacctttaatgtcatccaacctaacctaatttttttatttcagctaatgctaaaatggaaaattctagcccttcaaaatgtacggtaccatctcacacctacagatccaactatttcctgaacctgagggcagatatgggccagcatggatgcgctcaaagacgtagatgctgacaaaatgagttgggcttgggcttctcactctgtggaacagaatttgacctatagtgtgggtctaagaggaattgaaccacacagccaagattctttctagatatgagtggtgaaatctcccacagccaagattctttctagatatgaatggtgaaatctcccacagccaagattctttctagatatgaatggtgaaattgaaattttgtataatttccacatgtcacaaaatattgttcttttagttttttaaaaaccattttaaaatgtcaacaccattgttagcttacaggacatacaaagacagctgatgggtaggtttggcccacaggtcatggtttgcccaccccattgtattagacagagtgctaattgggaagttatggataagtgcaaaaggaggggttttgtttgttttgtttccaaagggagagatcattgtaggctgacatagtcaacaaattcttcacagagaaagtgagtttttgaggagactttccaataataggccacctaggaataagtagcgtagaagggaaaggcttgtcaataatcgctctttggttcatttgttttatgagtcaggactattttacattggggtttttcaaagagggacacacctgtattcattacctgatttgtattgaatccagagaggcatggtgaagggcatggcacagagtgatctttgatttggttaaataccaaatgacttgacagctcatcaaagttgtttagagcagagaataaaacggaaaccattaagatgcttttagtgtaataagttatctagacttttgaaattgaagagggcttctttttatctctacttcagttcttatatgccttctaaataccaggtattgtggtaggcactagggacagaaaaactaagaagaaatcgactctgtcctcatagaactcatcatccaatatgggattccagcttgcaaaaaagtgtagtaggaccagttaaaatagacgttggcaaacgcaaaggttgtggcccttgagtgcacatttaaatcacatgggaaactccaaaaatttctgttgcttgggtcccgcagcccagagattgtgatttacttggtcttgggtatggcttgggcatctggtttttaaaatagcttgcccaagtgattctaatctttagtcaaggttgaaaacctctggtataggggtgatgaggcacaaaaaaagaggactcagatgtaccaagggaggagctggggcaatgcttgacaagtagaggcaaacaaggaggatgagaaaaaggctttctaggctgagatgacacacagaaacaggaaataatagatcccatttggaaaactttggaatactcatcatgggtagtgtgttcaaccagcatgggcaagagattggctaggaatcgtgaacagacacaaaggagaaaaggaatagcaggagataaagctgaaaagatagatgttcatgccttgctaagtctagccttggtcttacctggaattagaagtcactgaagacttgtaggaagggttataacatgattggatgtgtagtttagaaaaatgactcatctgactgatgtggtgagttcaactgatggtcttgtagctgcaggcgagaagcccagttacaaggttattgccaagtccaggtgaaaaaagatgagggtttaaatataggttaatagcagtgaacctggacaggaaatgacagatttattaagatattaaggagatagaattggcaggatgtggtgactgggtaattaggatgactctgcattcctgagttgaataacaggatggcttgaatagggaacattagatgctcagtggtagagagagagagagagaagtagttagtaaattgagttcctcttgactcattttaacttgaaatgcagatggaactttcaagtagagttctacagtaagcctttggatatgcagactggaaacttagaagagagggctgccctagagataataatttcagagtcatcagaatatagatggttcaagctgtgcaagaagatgagactgcccaagtcagcaatgcagaattctgtggaacacagcatttaaagtatggatggagaaaaagagccatcagtttggctaagaaaggttaggatggtaggtaaagaacgtgatgcggaaagcaaaagaatagtatttcaagaagagagtaatcaaaagtgttggatgctttagaatagtcaaagagtgcgaagaataaaataaaaagtgctcttgggttggtggagcaatttcagtggagtaatggttctagaaccctgactgcagttgatttaagactggattttgatttcctgtcagaagtttggtgcgaatagatttaaaaagcccttttcttgtttctaacttgtagaaattctggataaaaaaattataactttaaaaatattttaaatatgtaaccaaactcaaaaggatgaaagagaattctccagatgccatgaatgaaagaggaattaaaagccagaaacagacaaatgtggaagttgagtgggctacagaggtttcaggaccacatatagaggtcaaatagaggctagcatcttgacatcttccaggcagggagggagctttatctgtgcagaagttatgcaaagaactgtttcattcatatttcttagttcattcatgaatggaaccaagaaaacttgggacttaagaaggagctacccaacctggagtagaaaagtagcccctaaaagaaatcagaatcccacacctcatgtgatatgtgcaagtaagaactcaatttgtactacctgcgtagggagaaaaagccttaagccaaaaataaaaaataaaaaaaaaggaaaaaaaaattacaaacctatttggaaccagtgtaactcataggacccagaagaggcaaatgcagactacgtaacagtgatatcttgaaaattctgggcaaatgcaagattcctacagaggataagttccattgaagtagagcttccagaacaaagtagcagaccacatgaggaaatacaccatcatgagaaaagaaggcaaatgcaacaaacaggacacttgacatctacaagaactaccaaagaatataaagccacttcatagaaggaacttaaaaattgtggatttctaaaacattcaaggagataaagaaaagaacagattccatgatacaagagcaggacagtttggaagggaaaagccagtagatttgtaaaagaggcaaatagaaaatctagaaatgaaaaatataataactgcaaatttttcaaaaagcagtagatgggttaaatcgtaaagtagaccttggagagagatttcatgaatgagaggtgagacagtgaagtcaattagtgcaggctgctcctttgatgattgcctttgaaggagagggagcagctttgttagagaggaatgcagggaagagattcattcattcattcattcattcattcattcatttttaaaataacagaggattagggaatatatagtggaaagagtaaaaatacaggaaaaaggggagataggtcggggagaaaagatccccaagagcctaactagaggaattactggaaattaatgaggatgaagcagatttgaacatatttctgttgggggtaggaggtcaaatatttgaaagtatgtaattagatcccttccttctctgtcagataagaaggatatgggcggtaagcaatgaggagatacagaaagggcaaatgtttttttaaagaaatagctactaagataaatggggagatgaacctgatcagagacaggtataaagaatgtcagagaacattgaggggtacacctgcaacagtctcttatctgaggtggtaccatgctataagattgcacctagcaatgcaagtataagattgtaaaagttagattgttggattagtccataaatattacagaaaagatgcaaggaaataacaaaagagggaatagaaaatagtagtaagaaagtaatatgagagattggagggaagaagtttctgtaatccaatttttgtgtctctgaccatggttactatgagaaaacatttgcttatagtgaattagaagaattctagaatctgttttcctcctgcctcacctcatttcccatgcaagtgtgccttgagctcaaaactttagaagaataagagagcaaataaatagctctcttatttattctagtttattttaaaagaaccagggtaatattgttccctacaacagtggtccccaacctttttggcaccagggactggggtgatgttttgggtgagaaaaaggggatgggatggtttcaggatgtaactgttccacctcagatcataagacattagttagtttctcgtaaggagcatgtgatctagatccctcgcatgcgcggttcacaatagaatttgcgctcctgtgagactctaatgctaccgctgatctggcaggaggtagagctcaggtagtaacgctcactggcccgctgctcacctcctgctgtgccgcccagttcctaacaggccatggaccaggaccagtccgtggcccaggggttggggacccctgccctacaacatgaaactatgttaccttaagtcagtctgtcatgaatcaaggtttgtaggcttcaactttttgtttttgttttgtagagaaggtcaatctgtgttgccgaggccagtcttgaactcctggcctcaagcaatcctcctgcctcagtctgccaaagtgctgcagtcatagatgtgaaccactgcatctggcctaggctccatcttcttttgtctacaaacattaattgtctgttgggtcaaggaggtatcatacatacatgccatatatattgtttatttgcaagtgcataatgccccccagagtgacccctgtactaaaagagattcctgcctatgatggggcaatctcctggagtcttggtcagccccagaggagaagcagctaattggcactcctttcataaataaatgtcatttctgtcacctagtattgctgacgaggatatttagatcgttgaaattagttacagtgacacatgttgaaccgaaagaaaagctttttaattaagttgaaattgaacatttaagatgaatttacaggtaacattctggtaagagcagtgttaatagctaacccatgggccctatgaaaagacttgaagcctgtcagctctaggtcactagtcagagcccactggagatggcagtaatcaaaggctttttctgcctgacaactggggctgagggtttcttaatgatggtatattggctgtgaagagaggggtgtccatgattcaagcaataccctcaactagaactaattgatagtttaaaccaaggagtccagagtacaaccttttgtaacacttccgtcacctttcaggtactagttatgttgtcacttaatagcattcttttacatggttatcccactttttattcaacattttcttaaaaggtcccccccaaaacataccatatgcttttatttatcctaagggatcaaatatggtaagaggagctaattagttttttcaactgtcacgattactcaacaactaagaaactaagaatgaaatctagaaatgttgtttcccagtaatgtgacctattaatgggtatcatggactccaacttagataatggattatgttcaaaggagagatgagtgtgatttcttttttcctgcagcaaaggtagatgaaaatgctaactgaataccaggcatcatgctacagtgtctcttttctattggctgtgtttaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataaggtaaaaggtccattttctaagttgtcctaaacatagggaggaagcacatctgtttagctaatatttttttacatgaaatttaggcaaattctaaaaatcaagcagcaattacttgaacttagtaaaatatgttttcctcctgtctcacctcatttcccatgcaagtgtgccttgagctcaaaactttagaaggaaaaaaattaatgtgagtcaaatttggaacattgctaaattggattaaaatatctttttttttttttttgagacagagtctcactctgtctcccaggctggagtacagtggcgcaatctcggctcactgcaaactccacctcctgggttcacgccattctcctgcctcagcctcccaagtagctgggactaccggtgcccaccaccacgcccggctaattttttatttttagtagagacggggtttcacagtgttagccaggatggtctcgatatcctgacctaatgatccacctgcctcggcctcccaaagtgctgggattacaggcatgagccaccacacccggcctaaaatatcttttaatttataggttcttctttcctcttagaggaaaaatagaattcagtgattcattcactcagcaaagttgtttgtagcccccatatgggccataccctttcaaacatgagagtaagataaatttctgtccatacagaatatgtttctgtccatacagaatatgttatgattgttcttaacatgttctccagtccatagaactgtcagttggactttctggaaaatacaaatgtgcttcctgtgtgtgtgttcacatacattgtattatccgtgattgttttctatgtttcaacaaaagtagagtctttcttttaactttatcactcaacatttgcctttgttcaatttaaattatttacttagccatgaaagtgtggcctaatttgatgaagctactcatttccatatggctggcttgccacagtgaaacattttcacctctgtcacttatagagctgtgtaaagtagaaaaacaatggtggtaatactttgtcacatcaaagttgggattaatattatcttcttttgcctaagtgaatgaataagtggtaaaaataaaataaaagcattttaaagaaacaaagactagaagaggaataaaaggaataagggcccatgttttcattcatcacagaactgtgttcttatctctctcaaattgtgcaactgtagacaaatctttactgctcacaaagttaacctataatcatacactacagtgccatatttttatgaactttttattatgaaaattttctgtagcatcatgttaaactttctcaaaaccatgattcttgaaagtgcatgtgtaatttaacctaaattcttcctgtttatgtttttcttccttattattcacagtatctgaaagaaacttgttagctagttaattatataagaaaactgtctctctccccacctttattttttgaaggagcaattttaggtttacagaaaaacttgaacaaaaagtacagagttgccatagatccccttacacctcccccaaccatttcctctgtttttaacatcttgcattcatgtggtgtatttgttataattgatgagctaatactgatacaatattaatgactaaagtctgtagtttacattaaggatcactcttcatattctaaatatatcggttttgacacatgtataaggaatacatccaccattatagtattatgcagaataataattttgctgccctaaaaacttcctgtgttcctcctattcatccctccctccctcaacagcctgaacccctggcaaccactgatctttttattgtctccatagtttcgtcttttgcagaatgttatatacttgaaatcatacagtatgtttcctcttgagaatgacttattttgcttagcaatgtgcatttaagtttcctccatggtttttttattttgtggtattattgctcatttcttttttatctctgaattatgttccatttcataggtgtaccactctattcactcatctattgaaggatatcttagttgctttcaagttttggcagttatgaacaaaggtgctgtaaataatttgtgtgctggtttttatgtggatgcaggtttttaactcatttgagtaaataccaaagaatgtgattgctggatcataagggcaaaatatgtttagttgtataagaaactgccaaaatgtattccaaagtggttgtatcatttcacattcctaccagcaaggaacaagagctcctgtttctccacattcttgccaacatttgatgctgtcagtgttttggattttagccattcttatgaatgtgtagagatatctcattgtattaatttgcaatttcctaatgacatgtgatgttgaacatcttttcatatgctatttgctgtctctatatctttggtgaagtgtttattcaaatcttttgcctacattttaattgggttatgggtgttcttgttcagttttaagagttatatgtatattttgggtagcagtccttcatctgataagtattttgcaaagattttctcccagcctgtagtttgccctttcattctcttcacgatgtcttttgcagagaagttttaattaagtccaacatatttttgtgcttttctgtcttctcttgttttaattattttgtatggttccattttttcttgtcttttaccatattagttatacttcttttttttacaccttgcattcatcgtatacatttataactaatccaagtctgctttcaatgacactgtaccactacacaggcagtgtaagtaccttataacagagtattcccaattcttcctccctatcctttgtaacattgctgtcattgatttcatttatccataagctagaatcattgactacaatgttattgttattattttgaacaaactgttggatcaagtaagaattagaaaaggtttatttttacctttgtttattccttccctaatgctcttcctttctcaatgtagatccacgtttctgatctgtatcatttttcttctctctgaagaacttcttttgacacatcttgcaagacagatctactggcagcaaattccttcagttcttatttgtctgagaaagtgtttattttttcttcacttaaaggataatttcactaggtacagaaatctagactgatgtattagtcaaggttttgcagagaaacagacctaataggatggagggagggatagacagatagattaattgactgattataggaattggctcattaaattatgaggccaagaacatccaccatccaccatttgccagctgcagaacaaggaaagtcagtggtgtaatttattccaagtccaaagccctgagaacagggttagagggtggggctagtgtaagtcatggagtctgaaggcctgagaaccaggagcttcagtgtctgaggacaagagaaaatggatgtcctgctctagcatacagagaatgaattcacccatctccacctttctgttctattcaggccctcaatggattggatgatacccatccatgttggtgagggaggatcttctttactaagtctactgattaaaatgctaatctcttctagaaacaccctcacagacacaccagaaatgttaaaccagttatctgagcatctcttagcccagtcaagctgacatataaaattaaacatcacaactgaggattgttttttttctcttttaacaactaaatattttactccactctcttcttgtctgcatgatttctgaagagaagtctgatataattcttatccttgttcctctataggattttttttcctctggtttctttaaagattttttttgtctttgattttgtatactttgaatatgatatgcctaggtgtagaatttatggtgtgtatcctgcttggtgttttctgagcctcccagatctgtagtgtagtgaggtatctctaattgatttggagtaattttcagttactattgcttcaaatatttattctgttgctttttctctttcttctccttctgatattcccattatgcatatgttataccttcttaaactgtcttatagttcttggattgtatgttttttaactatctcagagttcttagatattctgttgttttattcttcttttctctttctggttcagttttgaaagtttctattgacatttcttcagtgtctccagttctttccttggccatatccagtctattgctgagcccatcagaggcattcttcatttttgttacagtgttttttatttctaacatttgctcttgattctttcttagagttttcatctcttcttacattacctgtagtttgctttttattggatatctatttattatatatacatacttttaatgaagcataataaatatatgagaatgtgcacatatcaaagtcacaactgtgccaatttttacactgttcacttttgtaaacaatactcagatcaagaaacagaactttagcaataagaacatagcaacaaagtgccttctcgtcctccttctttctagttactgcctgcctcttcaaaagttacccttgctgacttgtaactactagactagtttaatctatttttggaccttatataaatggaatcatgcaattatatatatatatttatttttatgactggcttcttattttccacattatgtgagcaagattcatccatattgctgtatataggttctcactacttcataatctatattgtatttcattatgtcactacaacaaggtttttaaaaaatttatacatggccgggcgcggtggctcatgcctgtaatcccagcactttgggagaactgagacgggtggatcacgaggtcaggagatcgagaccatcttgcctaacacggtgaaaccccgtctctactaaaaatacaaaaaaattagccgggtgtggtggcaggtgcctgtagtccccagctactcaggaggctgaggcaggagaatggtgtgaacccaagaggcgaggcttgcagtgagccaagattgcaccactgcactcaagcctgggcgacagagcgagactccgtctcaaaaaaaaaaaaaaatttatacatgtgtgtttctatgtgtgtgtgtgtatgtgtgtacatgtaattgtgtattcatacattcatcattctgctgggctcttggaactatttcacatagtgctattgtgaatatcctgggtttttttttttgataaccatatatgtgcattttggttgggtatatcctaggagtagaatttctgggtaatacagtatgcatatgttgagtgttagtatacactgccaaataattttccaaagtggtggtaagagtttacactttttttttttttttttttgagacagagtttcgcccttcgcccaggctgtagcgtagtggtgcaatctcagcccactgcaactgccaccttctggtttcaagagattctcctgcctcagcctcccaagtagctgggattacaggcacccaccacaacgcctggctgatttttgtatttttagtagagacagggtttcaccatattggccaggctagtctcgaaccttgtgatccgcccacctcggcctcccttatagtgttgtatgagagttctagttgccccatatctcaccagcacttatttttttattttagccagcccagtaggtttgtaagggtatctctttatcatttaatatgcatttatctcttgaacaatgaacttgaacacttttttatgcacacgtatttattggccatttgaatatcctcttttgtaacatatttgttcaaatctattgcccattttaattagcttgtctgtctgtagcgatttttaagagttctttgcatatctggatgtaacatctttgagatagacagatagaccaacagatcttctcccactgtacaggccaccttttttactgtcttaatggtgtcttttactaaacagactttttaaagttttaataaatttaatttgttattatttatggacaagacattttgaatcctatttaagaaatctatgatttaccaaagtcacagagatgttttcttctaaaacctttattgtgctgaatatattttccccctgcatctgatataaatgataagcttttacatttttatttcctctacctgttctcttcccttcatttgcatcatgttgtcatgactatagtgtagagagtaacttgagggtttttttttctatcaagacaggtaaagaatgattgagagatcgattggttagagccctgagtagaaataattaaactgaccttaggataaaggtcaggccacaaggctccactctttcacagtattaccataatattttcccactgccagattttgaagatgcctgggtgaacatgtccccactcgttctccgtaagcatactcatctaactacagctgtcaaccttaatagttgcgctacaagcagtttctggaagaaaaattattttttcccaactttacagattattttaaatgactaaatatctttttcttcttgttcctcagcttatttttgtgtaactccttaattgtattttatgcttgacaatgggattttccatcagtcttataggtatcttcaatagcttaaattgaagggaatgctttctagcctcattccagaaaagagaatactgatccaaagaaatgaatttttacccttcatgcttctgatttaaaaaagctagaatcaaggtcctggctttctttattcttattttgctcactgagttgtatcactttctatcttaaatttgaaggcaaaacaaattaaatgtatatttcttaatacatgaagcaaagtgtaatcttaagtgtataactaaatgtaatgttatatctcattatataccatcccagatcaaaatatacaatttttctagtatcccaaaaagtcctgctctcaaagtaaccactattctcactttcatcccatagtttagatttacttgtctttgaattttatataaatttaatcatagcatccaatttattttgttcaacattatgcctaaaggatttatccatgtttttgcatgtagagatggcttgaaaaacaaactatatttgccttaacaaaagaaaagtaacttttaggtctatttggtatatgattgactctttccttttaacctgtcacattctctatcccaattagaagtcgaaagcaaagttaagtagaagaggacactcttcattgatattccaatgtggtagacttgacagagtgccttgatttagcactttagagtaccatagaatatggcatgagccaaaaagactgaaaagtcacaatctccccctataattagtttttaaagctcagagggctgcttggcacatagatgaatatagaatccattgccctttgcattgaataaaggttacgttcccttcattactaaatgaggctcttttctattcttgttttttaactaaaaaataaaatgtattatttccaggcttaactttgaatggagagaggaaaaataggtcacgcaagggctttcatagaaaaaagaaaaatagcaaatatccttttattcccaaagaagctgaaagcaggctttctagcccattgtctttgcacctgccatatatatgtatatatttatccttttgagatcaatgattatctgctgataaaaggcattcctgctttctggagatgtaattaacagaagggataaggtgttggggaagcaaagaggacagggaaggagctagggaggccatgtgtattagaaaaacagcccccaccccaaatggttaccctcatttcattcataccctgaatgaaagaagaagaatcagttctctggagcctggtttgaaaattcttaagtggataggtgtgattggtaggacctggagcagaattttcaggtgataaaggtcaagcaatatataaaacctacagattagtcttgaaagatgcacaataaagaattaagattgtgcctgtaatcccagcactttgggaagccgaggcgagtggatcacaaggtcaggagttcgagaccagcctgaccaaaatggtgaaaccccgtctctactaaaatagaaaaaaaaattagctgggcatggttatacgtgcctgtaatcccagctactcaggaggctgaggcaggagaattgcttgaacccaggaggcggaagttgcagtgagccgagattgcgccactgactgcacacctgcctaggcaacagagcaagactccgtctcaaaaaaaaaaaaaaaaaaagaagaaaagaactaagatcatgcagtttattccagcagtcacagcaataagagtggtcagtgcctggcacagtatagcagcagtacgaattttcaggaattattattcctactcaacatatgaggaaactgaggtgcagaggaagtaaatgacttccccaagttcacacagccactaagtgacagggctagaatttgactctaggtaattgactctgacttccagagccaccacactatgctgaccagcctaaaaatggatcaggaatttgtggattttgacatttgaattattcctttattttcattgatcatcataatcttgactgatatttgagtcattttatgctaatgtcacagacatttatcatataagcattttgactctagattttgttatcattggtattcattatattatacctgatgtattatattgttacaggttctctcctttccaataacaggttgttaaacagaatatccagctatacttggaggaaaaataatctattgaatataggtgctttaaaactgcttgtcttattttcctctgatttatatgtttgactaatcaatgcaaagaaaaaataataatcgttgttgaagatgggggaatgaaacataaaaatgatataaaataaattacatagattttgggtagagggtgatgcagtcctgaatcaggaagagagactaaaggacattttgtagctatttttacttattgagttatttagaaaataacttctttattttatctggagaatcaaatgagtggtatgtttactatgactaccttttgtggttttatgaaattaggaagtcaacatgattaacagcaaaatattcatttccagcaagcaagatggttgatcttaagttattatttggcacgagtcatatattaaatgttcagtgaaaaaggaataaaagcagaaagcaggtttgcacttttacttttcttctgtggaatcctcttagtatgctaagaggtcctcgtaccataggtcctcagtaaacgttgaatgaatgagaaggatcagcccctcctcaaatgaaagaaataaaatgtaaaaaaaaaaaaaaatggggaggcctcagccttcagtgaactctctgaaagttacatgcatagtaagaaattccctttggaaagccactggcctacattctggtcctcagcaccatcattaactagtttgttttgtttttgtccttagtaggtctttatacctcttcaattttttcatccaattcagattaaacaattctaagagatgcagaaatctagcagagccaggaatgtgtttagatgtggaaattagatgaataaagtagagcataaatgattttcagaaaagttcctgttgggaatttgaaaggttctcaacgtaatataagcaacagctgttaaaagtttccagctaactatagctattgaagaatcttcagataagtttgaaggagtaaatgaaaggggcgaagcaggaaaaaaagactttagctatcttgaacaaagtgttcatatttatgttcataaattggagacatttatttcattatctctggatgcttaatataacttttaaaatataattataaaaggaaagataaatcagaaaacatgaatatattaaataagtgcaagagtaaaaaatgctttactaaaatattttctttgctgcagttaaatgagatgaaggtcatagatggatatagaacgctgccaggcaagtctggatgagaagctgacttaaatctcaaaactaaacagaaaagacaggtcattaactggagactcagctgcaaacatatcaattaatgttcaagatgattgaattaggcattttgttattatatgaaaatgataccattcttgttagcataagagtggcagtaaatggaagaaaacaaaatttaaaatctcccctacacatcacattaatgctagtgtatttggacaattatttgagaattataattatctgttagtatcattaaagtgtcactaatttgttttctaaatttcatttttatttaattttagatataattatttaatttttttccattaaggtggacatttaataccattcctctttcatttgaggcttaatgaaagaaaaaaatgcaattcttccaaggtagtcccacttagcccttgagaaagtcaggctggcagtggtcacctgtgccattgtggtggtgggcaggatgcctgtgatcaagcctgggtaggttgcaggcagaagtgttcctgagacaagggcaagcggtgagacgctctagtagcactgccgaaagcccgtgcctgctgtaatcttggccccactctgtctctgctgatgcctgttctctgctgcaagctgaaattccctgccagcgggtgaaggaccatttgcctcctcacatctgtctttctctccctgttgaattgtttccacttcctagtccaccatcctctttcatactcacctttgccatcaagattcagcttaggtatcaactcctccagcatctcctcccagaaaccctcctcccgctccacgctgcaccctcctcccctcactcacagtctgtgggtgagtcaaaccagtaagcagacccttaatagtgtggtgagtgctactgctggagggaaaaatatggataaacctacacagaagaggccagagaactaaaaagcattagaaagaggaaggggatggagttggagctcagaggagggggtcctcacccatccatcaagcaagaggtcagaagacagtgtctaaaattaacatcaacaagtagccgtttcaacagattctttagagagatggtgaaaaactactggaagaatttagaaacagtagtaccttttttttttttttttttttttttttttgagacggagtctccatctgtcgcccaggctggagtgcagtggcaccatctcggctcactgcaacctccgcctcccgggttcaagcgattcttctgcctcagtctcccaagtagctgggactacaggcacgcaccgccacacccggctattttttgtatttttagtagagatggggtttcaccgtattggccaggctggtcttgaactcctgacttcgtgatctattcgccttggcctcccaacgtgctggtattataggcatgagccaccacgcccggttacagtagtacctttttagacagttatatatggttgtttctggggcacaagactgagactggggagtggtaggacagtggggtcactactgattagtgtaggttatttaaccatgggtaattattcctttggtttagaattgttatttgttttaaaaacaattctccacacatcctcaaaccctgtgactgctctgatagttacctactgctcccaaatacactgtcattctaacacttctatcccagaaaaaaaaaatggatcatcttaagccattttcacttttttgccaattttacacaaagcatttactcttctttatagtatctctgtttttttactttccagcttttattttagattcaggggtgtgtatgcaggtttgttacatgggtaaattgcatgtcatggggatttagcctacagaatattttgtcacccagttaagaaacatagtacccgatgggtagtattttgattctaaccctcctcctacccttcaccctcaagtagtcccatgtctactgctcccttctttgcgtcaatgtgtatctcattttgcccctgccaaggttcacatctctctcttccttcctcctaaaaccccctcccctgctcattcctcatcccttctcttctctattccaagagaagagaaaccttacctgacacctccttgcttttgcctgaggtcaattgtttaatgtctctgctctgaacagatttcaattcttcaagaggaaatcatatggcaatttgagaaataaccaggataatcaataagctggtatactcaggggaaggagttcaatgctatataaagtatggcttttaaacctatactcagtagtggaaaaatcagagtataatgtgttcaacttataataagtgattattggttattttactcctatcacctggtaatctattttgaagttcaggaattctttttggaaagttactgttataattatgcactgtatcatgcatgttatacagtgactcctggcagaaaaactgcatacctacagaagtcctagcgcctaaagaaaaaacatgaacctaattgtttatacctagtgttgcttgacaatatctatgaagcaaagttagtggccaagcttatttgagtgtcttagctaaagaaagatgcattctttttccaaactcatagagcatttccatgcaattgtgttccaagtctacatatcataactctgagctggtgctgtcagcatcaaagtaacatgctgctttgcagttagctttttgcttagtttctagtatcagttttcatggaattttttcattgtctttacccactgatacatcagtgtactcttctgcttggtaccaaaaacggggatacaaaacgtggagaaaccctgggactgagccttgggttcctgccctctgtgccactaactccccgtgtatcccctcctcctctgcacctccagctcttcctctgtaaacgacaacctgtgagtctccaacttattggctatttttttcttaagtgatgtttgtgtgtgtgtgtatgtgtttatgtgtatttatttgttttaactagcctgttaggtcttatttaacatccagtaaagctctgtttttaagccagatatttatgcttcagagtaggttggaaccccttgtgtaatcacctagtatatttctacccattttgtggaactttgaatataattgtactatttttagttactacttcaggttctagtttacatttatggcattttttttttcaagcattcgtcatttatttgatgtctcagaaacacaaccttcaattgtaaagctgttttaaaagaaaatttggtcaattatttgataattaactattttccagtgaggtttccagaaaaacattgtcatacaaccaaaagctgcctgtaattgcttttgaaaggatcaagttcttagataaactcaggattcaacactgatatcaaaggcataaggttaatgaccagggtgcctagccggttttattgttctagaatttaagtgtttaatgacagacatcatatgagtcacccaatagtggctcaataaatacttgttgaatgaatgtatgtctgtattcatgtgctacttgatatataagtaatggattcaaataagagaaaggatagtgtaggaggaatctcagaatatggagtacaaagacttaattgtttgcccaaattctgagctgcagttttatattggcaattgaaaattactcagaaataaaaaagttaactatttaaaatatagaatatattgttaataatataggcaaaagaacaaaagttatgctgctaggaaagaaaaactgtaacttaaactaaaagtataatgatagagaaattttaaagaatttcttctcatacacgttatatagagctgagtcaaataggaacaggtgttttcaaaacataataaatctctcatactaatgcatttgaacttatcacacaccttgacctgtgattaacatcttggcctctaattggagaagctgttcgaatcctggtgttctgctaccaacccagcctccataagggtgatgtgtttgtgtctttcttttagaccaggagcctgcatggtggcaaagctgccttagcagaatggtgtctgcaatttactctctagacctttgcctctgccatagccttggtaactctaaccttgcttcttctagaagaggctaaattatgcataatagtttttctgtgctcagccttaagaacacagcacataaaccactccaaaatacttacacaaggacagaaagatagactgacagaagaaactatgcatttatgcgttcctggattgaacatgtcaaaacgtaactgactgtcattctaaattttctctctccagttctgaaattaaaatggcagagacagtttgcggggattctgattgctttcgtaatattgcttaagtttgtaattggtgcattaacttcttatcgtacatgttatattttgtgtaaaaccttcatttccagaaacagcacgctgggaagaaacttaaagagcactgtcaaggggtctatgtggaagtgattcccaggagctcaccatcttaggaactattttggacaggagtaggagagatactgattttgaaaaacccaacaaaaaattctttttctcacttcttatttgttccctgagcttaattaactctttgttgttattttagaaatttgaaaaatagtaaacccacagaaaagttaacagtgcagtgaatgcatatgtaccatatactgactgagatttcctgaccactgacatcttgctatactcactctatactatctccaaatatatacacacatttccttgccaaaccattcaaaagtaggccacagacataatggcctctattcttaaactctttagcatgcatttcccaagaagaaagacattctcttatgtacccatatcattaccatatgtattagttttatgttgcggccttgtaaccaattaccactgttgtcaatagtcttggccatttgagtctgtcctgacctttcccctgctctgttctttattacaggggaactgactttgcaggcagcatttcctaggctcttagggcagttatctcaggtctgggctcagcaataggaagtggtgatgaaagatttggggaataggaccaggagagagagagagagagagagagggagagaaaataaataaaatgtgatcagatacagcacaggtctgcagaccaatccctgaaaccttttgtaatgtttcgttcataattgcatcaggtctgctgaaagcgcagatttttttttttttcttttttgctttcctttcagtagctaacagaattctttaaagactaaatggagacaattttgagcatctttggcaaaatttccttaaatgaattcttgtcagatagacctttttaaagattgtaattgtgtggtaaaattaagttaaataggtttaacactcctggcaaaattaccttaaatgaattcttgtcagatagagctctttaaagattatcaataattatgtggtaaaaattaggcttaacaggtttaacattcttctttagtttcataggcttctatgtgagcctgttggccaactgatttggaaggcaagtcctcagatgggatccagtacccaaaacattcatgttttgagttctgatttctgctcctggctgtgtcagatcatctttgagcaattgctgagtgcctgttacctctgagtttctgttacttcaccttctgaagacaatgttaatttgctgcctgtttcactcaaaaatacatagtgtcttcattaaataatgtgttatcataataagcagaagatgaagggtacataaaaattcaggcctagaaagtggaaataatactgtccagttgccaggcagcagccattctggctgcgaggtcttctgcaggggacaagtgactgtgtcttccgcaagcctggagccaccagtccagaccagcttcaggccagtgcgcccattgcctcccaccttggcacaagtaactaatacccaatgtcctccagttttatgtgctgggattcctggcgtgcccatttgaaagttctctcatatgtggtgagacgttccgtttttctcttcactaaaacgtgaagttgttttttggagaacatatggacagtatagaaaagcacaaagcatgatacatttctgcagttgacattttggcatatagatatccaaccttttttctgctcatatatttatttattttcttaatatcatacagtacctatagttgtataagtttattttacacaactgcatatcataatgaaaaataagctacaccaaacatttttctgtgttaccaagttttttatatacataattcctaatgacttcatggttttccatagtatagatagatcataatttaataaatcagagggattggaaaaaaatctgtagtcaaacagctaaagccatccctttaaagttattctaacacataaaaaccttccaccaagctctttgacacacacaaatcctcgaaggaatgattttttgtgtgaaatggttatagctgtcaatcacttattctctgtgtcatggtttctgtgctcttttcaggttgttagggggtgattatggattcctgtcaaatgagatgtctgctgtgtattcaacatgaagcagtttgtatttttctcagtctattgctctcctgtctgaggaggttaagcaaatcccagtgagccagagggaaacgggataggcatcaagcgctggcagcacacggcagacatgcccagggcccaagatccccactcaagcagattagacttcttacataaatacatttgtcttaattgtcgcattccacctagggctacacctaatatgcataaaaatggctccaagcctggttttcaaagccatttgccccccgctgttgctttttcaccacccagctcagaggcattttttgtgttatatctatcacagatgattaaggggctcgaagagttgatatataagggcagattaagaaaactaaatatttacaacctgactgagtgacagccaagggaaatactgtaaatgtcttctgggctcaaatcacggaggagacattgttttgcttttcctagtaagtggattttagagctatccaaattcagagaaagttttcttgggatgacatctcgtatgctaattagataaatgagtcagctagaaattgcatttagcagctactaacagaaacttgaaatagcagtggcttaaagaagtagggtttcatttttctctgctatgacatgaagctcaaaagcatttttattgtctgggactgcactattgctccatgatggcatcagtgcaccattgccccaccatctttgggctccattatgctcagcactggcttccatactcaaggtcacccgatgtttgagaagagctactgcagccccagttgccgtggcttcattccatgaagagagaaggcaaaagagtctctgccaactaagattgcttaagagagcttccttgatgcccatctactgatttcagtttacatctcactggccaccacatctgcaagaagggcaggaaaacttggtggggttttttgttttgtttcatcttaagttgggcacattgctgaccccaacaacatcagggtacttttaccaagaacgcatgggataatggatactgggtaggcagctaatggtttctgtcacaataattaacatcttgaaaattctgatgaaagtctgggctgtaagacgctgtggttggtatttgtaaaactagcccttgatatgtaacatacttcctcctgctcactcttacctaaattcattcatcatcccactaaataaactagccatctcaacagacctaagaataataacaacaatagtttttaccaagtaaaaactgtttgcactgtgttatgcacttaaaagcatcccctgaatgatttgccttaaaatattctaaagtggtgatggggaggcataaataaggataaatggaataagacttccatgagttgctaatagttgaagctggaagacagttacatgggggtttgttatactcttctttctactttcataattattgaaattttcccaatgaaaagctttaaaaatcacacttaatccttacattacttcatatcaggtcagttcttttacctccagataataatgcttggagttaagcagtgtcacacaacaagcaagtggcagattcagtattcaaacctgggtttatctcactttgaagtctgtgtcccacccttgccactcaaggaaaacacttttcagacaagcagcctgggcatcacctggaaatcagttagaaatgcagaattcagggccccaccccaagaccttttccaagcccctcagatcagattggtgcacacccacattccatgcgctcggttcactgctcttcattgcctcaacatcaactgtgacgtttcctttaaaaaagataaccctcggctaaaataaggaggctagtcgtgactcattacttggtaggataaacattttagataacgatttgattcacagcagttgtttctttcaacattgggcatctgctgtagtgctgggcactaaacacctatgtgtcaattaagcatctttctatgtgtcaacaatttttattaatcactgcatgctcgaaacttaatttggcttgttctagttaaattaagcccttgcttcttctcaggtaaggtgtgtgagattttaaaagccttgggtcttacagaaaactctccaggtgcctatttcaacctcctccagcatcagctctgcttacccacctgtgtgtaactttcttgatttttttcccctaacattctcagtcatcttttttgttttgttttgtttttgttttgtttttttggagacagagtctcatgctctgttgcccaggctagagtgcagtggcacgatctcggctcactgcaacctccgcctcccgggttcaagcgattctcctgcctcagcctccctagtagctgtggctgtaggtgcatgccggcacgcctggctaattttttgtattttagtagagacggggtttcactgttgttgcccaggctggtctcgaactcctgagctcaggcaatccacctgcctcagcctcccaaagtgctaagattacaggcttgagccactgcgcccggccttcagtcatcttttctaattttagccctcttcctttttaaaaggaaagagagctgtggaaattaggaagcctgagtcctagctttgccactcatgtgtcatgtaggcagaacagttaactgttggagcctccagttcttcatctctgcagtggctgagctatatgatctcaggtcccttccagcttcatcctttgtaaccccctgtaacttgatttttcaaccccgccctgccccctgcaaaacattttgaagatattgggctctgcgtgaaacccactagattatatttttccagtcagtaaaaggatcccagcattgattttttttaattggtttctttttccaaatgctaaatgccttaatacttatactttatgtgtgttggatcctttttagaacaactaagtaaatgaataaatgaagcctgtcatccatctcagttgtaacctcctcttttaaagaggctggatcgtctttgcttttgaacattattcaatattttctaggtgccagattaacttggttattttattttcactacaataaactttaaaccatgtacatatttaacaccctaagctgtttatcaacttctatagcataagaagaggcaaggaaaacacctacaggagagcagtatagacgccatccccaggaaccgtcactgtataaatcaggcccatactggtccctgttgaaggcacaatcattggagtcacttatttcttcttccaagaactttttcccttatcagaatcatgttaagcaggcatgtgatagttgtctcacaaagttaaacctaggaaaaagagcacgctgtaaaatagtgctcatgtcagtccttgtgctaggtgtgcctaaaacagtgttgcccggtcctaccttttccatgctgtatatatgaagtgtgtttctgatttgcttttcagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagagtaagtatctagtaggaagctgttgtggggacagttgaggaactagactgaatgcattcattgaaagatgagagtgtacactggtcaccgtatgggggcgtgtcccaagctgtcagaagatcctggttagaattctgcttgtgttgcacctcttgtactttgtgattctgggaaaggaactaatcttggtttccctgtgtggaatgtgggaatccaggaaaggcccatgttaatgtggcttgatattaacatggccttagaaacataaattcatctaggattgagccattaagtctcaagaacagaaagcaataccttttttcctccttacaacaacttctcaagggcagaaactgtctcggagctcagggctgtatgcacagctgacattctcattttacttgacataaagctaatctttttattagtcatagaagtgattaaggtgctagaaaatagagtcaatgaagacaacaattattctggaaaaaagatggctaagagatagcaattacagatttcaaagaaattaaggaacagaacatgaaattagggggaacctctttttctatgaaggaccagtgacttagagaaaaataatttgaaaactttagggcacataaactttaataactataaaattatatttaaagcattacttcaggagtatgtataacacagttaaaatagagacaaagaaaacatgatatgaagaaggcataaaggaaaaggcagatttattctttatttgttgagacagtctcactctgttgcccaggctggagtgcagtggcacaatctcagctcacagcaacctctgcctcctgggttaaagcgattctcatgcttcagcctcccgagtagctgggattacaagtgtgcaccaccacacctggtctcaaactcctgggctcaagcgatccacctgcctcggcctcccaaagtgctgggattacaggcgtgagcaagcacgtccagaccaaaagacagatttagatgtgtgaatggagagatagaaacaggatagaaaaagcaaaagaaacagcaggaaggataaggaagcaaaatcacctctgaatttaatattagggctattagacagttattagaaagaaaacacattatttggactgtacatgtcagagtgagctttttttaatcaccgtcatttgagaaggtattattacttgattaaccatgtttccagcctagagatggaaaggtgtggattaaattcacagagtaaattattcgcttatcctctaagagtctaaggaaccccttgagtgctcactacttgcatggcctcatgctgattctctgcctatcccaagggccaatgcagggtgggaagaagggactgaagcagtgggcttcagagggagatcatagaatctgcaccagaaatctccttaaaatattactgcatatttatacttttattcttacgtcttttattgaaaatactacttatttttgagacagtcttgctgtattacccaggctagtcttgaacttctggctttaggtggtcctcccatttcagcctcccaagtagctgggactacaagcatgcaccaccatgcccaactctaaaagactgctttttatctgatgatgaaattatacaagtttattctcagaaatctataagaatagaaaatgtgtctaccaattaaggatagtttgggcacagtattacttttgagcagattttacataaggaggtatccgtaaaggcccctttaactttataatcccataatatcaggcagttctattacaagcagcagtttaaattatccattttgtctcccaaacccactctgctcccttctcccctctagaaaaagtcagaaagaactaattttttctttgctaattgcaaaatgagcagctctaaaaaaggggccacttgcctcttttcctagttttctttgacttgcaaatgcagagctgcttaggtagtttatttagtaatgtttggaaggggtgctctcatttagtatgtcattagcatctaatatttaatgctacaatctcttatttctaatgacataccattctagatttctattctgcccattctaaaagggcttcacaaagcaagatagtacataacctgtgtagcaagccactgagtgatttacacaggctaacctggcatcaactgttttcaaaaggagaaagatgcattctgagttatgcttaactttgtaattgcacgatttagctgttgtgttcatgtcactgaaagtacccagtaaagttgatgtctaattcatgcctataatcatctctgttattctgacaaagatctcatctaccacgcctgttaatcctttgcctcatgtgctcagttccattttataatataagttgtaccctctcagttccttgcagggtgattattccacccagtgagtgatttaagtaactgtcagcattttgaggatcagtgcaaaacccaagtgaactgtaatcactacttatggtgtctgctaaaacaaagcatcaagcaagcctggtttatcctactaacagcaagcctggctcacccccacttatgtgctctttgaattcccaggagagatgcccattgatgtttataatttgaacaaagcaggggattctctgataatggcttactttgattgccctatgtcaatgtgactctagaaagggaacaaggggacagctttttattatttttttttttttgaaaagtgaaccaaatgattactgcaacaaaagtgtttccaagtctggagactagagaacatgaggaaaatgctcagcaggatgggaagaactcaagaagatcttcagtttatttcttgttccacattctgttaactatttggtatggtaaaggccatgttttattaagcttaagaagctattgctgtgatagggtggaaaaagtttgcagaaaattattttctttctttttttcttttttttttttgagatggattcatgcagtggcgcgatctcggctcactgcagcctctgcttcccaggttcaagcgattctcctgcctcagcctccctagtaactaggattacaggtgcccaccaccacgcctggctaatttttagtatttttagtagaggcagggtttcactacattgcccaggctggtctcgaactcctgatctcgtgatccgcccgcctcggcctcccaaagtgctgggattacaggcatgagccactgcgcctggccgaaaattattttcatagtagaatatctcttcagataggacagtaggagtctcatccacctgaacatttcatgtcaggtattacatttagaagaaagtagagaaaaaagttctacattttagttgcagagcatggctggctatacattgttcaggaggttaaaactaattatttttttcctaaggtaattttttcatctcttttagtgtttgcctaaatgtttctctatctcctttacacataaaagggtctcctggttgtatctagctcctgaccacaccaaaggtaccactcttgcatttcccctaccacacagtacacagttccctgttccttctcctctggtattctcccctcagtctttctgacactgtttctgcttaagattctttcagttgaaagtcacagacttaattgaaggaaaaagaatgcattgactcatacagcagataaatcaaaggacttcaagagtggctggatccagaggttcccaaaatatcgtcaggtcccaggcatgcttacagattctctctctctctctctctctctctctctcggatctaagtttctacatgttttcctgcattcatcacaatttcaaccttgtaataaaggcacaaataatgctggctctttgtaatgcctgctgtttgtaagatccctaaataaagactccaaaattgttatcattaagaaaattctcagaacaatatatgacctacataaaaattgttagactatttttcagtttaacagtagtgattttcttttgcatcttatcctcttgttttaaagatggattgtttttaaaaatagactacacagaatttgaaggaggctcaagggcttattttgtcaccatggcttccttagggaggcccttctctctatcttggattctgtaaaaatctctgggattagagattctacaacctccttgattatatattctactccataccatctaggaagtcttttttttttttaagtgaagcccctgtgcttcagtctaaacctcattcttcttttgtactctcttcagaaattaaataattactattaatgactattttctctataaaatattgtaatgcatccaaaaatatttctgtagcctcttctaattttttgggcaaataaatctcatagttttggttgccagaattggtttgtgaattgcagtattagttatacaattatttatatacttatttcttacaggtaaattattgttaggtatcttagaaatcatctggtctaactcagtcattttgcatatgaggaaattaaggtctcagggtggttatatcacctgtctgtgccaaactgagatggagcaggtcttcagaatcccagtttaattttctttctactacgtcagttagagccactaattggaccgttcatgccgtattcctattaaaccattccagcagggttggcatattttgttttaatggaagcactttaatgcttacaagcaagttgtggtcatttctgatcattttcttgtgcctaaacagaatttctacacctaaatatatggaattattgtacaaacccctcttgaatttcatcttagttgcaataaaacatttctgtaatttgccactctctatttttgttttgcaagtattttctaagttagaaactccatctgtcttgttatcatgccgtgtaatatattctagatattgcattgccctatatattagccactagccttgtgtggctatttaaatttaaattaattaaagttaaaaatgtagttcctctgtcatactagccatgtctcaaatgctcagtggctgttatattggacagtataggtatagaacactttcgtcatcacagaaagttctgttggccagtgctgtagatcatcactgaggtcattgataaaggttaaaaataatgccagtccatattcttagcctttgaaagatacttgaaatgcctacctagttctatcaaaacatggtgaactactttaattgtccagcctcagatcacatgtaccctcctgatgaaggttgatgtttttggctctgcattatcaaaatttctcctattgatgttaactaatgctaaagggaaaaggttttgtgatcaaatagacttggaaaatattaaagcacattaaatataattcaataccagaaaacctctaaaatctttactatattaaccagataattacagcagtggaatgtttcttaaacttacttttcagtgaaattctgttgtcccagcgtatctcacggggctttttatccatgaaacaacttctgggtgacactgcccaatgctatatttatgtaatttgtttagaatattttatttctcccggcaccatcaggctcagggcagatgttccactattgcgggaacttaatttcatattattggcaaatttgcataccatcagatgacttattttgcaatttggttatttgattatttgattcatttagtgatttttagaaatgttcaagtcagccaatataaaataaccatggtttccctttccgcctgtttcaggcttggctactgctatagtgacccttttccagtcattgtgcttttctcacaattctcaaagattctagctgcaattttataacacaccccaattcatgcaataatgtcaatgtatccatggtgggggtcctgggattgatttatgataaaaattttgttgtataatatttttagatttagtgtaaagttgcaaagatattacagataatctccttatctctctcatccagttcccctattgttaatatattagtatgatacatatgttacaagtaatgaatcaatattgatacattattattaatgaaagtctatacttagttcagattttcttagtttttccctgatcttctttttctgttctaggatctcatccaggatatatcacatttataccacagttttcccatatcacagttatcacatatatcacatagtgatgtctccttaggctcatttagactgtgacagtttcctagactttccttgttttttgtgaccttgagagttataggaattctggttgggtatttgtagaatcttcttcaatctgggtttatctggtgtcttttcctgattagactgggcttgtgggttttcaaaaggaaaactacagaggggaggtaccattctcatgaaatcacatcaagggtacatatcatcagtgtaactgattactgatgatgtctgggattgactttgtgcctccaatttgtgtagtcctctctaggcagttccttccaaattttggattgactctccactttctgactacaaattgcttatctttctagtggctatttttttaacatgatagaagcatcttattataagcccaatgtttggatgagttgaatacttgctaagaaaaatggttgtctaccttaaacaattatgcagttgataatggattataatcttgtgggtctgaaagactctgtgggaggagctgttttttaataccttgagccacttgactaaggcctgtagctacttttgggttgctacatgtgctaaacatcccttaataaatgtatacaaccatattaatttcaaacaaaaccatgctgacattaaaagagtttaactaaatttcttcactaaaaataaagtcttattttaacccattttaattaaactgtaatgtgcattgttgactcaaaacccattcacaagtggaactcgcttcctgagataagtccttttagagtagaatacctcataataccgagctgcacatcagttataatcagttagagagctgtaaaaatactgatgtagagattttgatgtaattgttcctaggtatgacatgggcaacaggctacaccccagaccaatcaaatcagaggcagagaaacctatgttgtaaaggagtggttttcagcctcatcgcattagaaatgcctgtgctttttaacatatccccaggcaattttaacaaacaaccaaggttgagaaccactgatttagagcccctaaaaatttcttctttaatttctgtcactctctatatttgggaaatgctttgtaattattttgccagttcttctatcctctggagcttgagattaacgtgatttcccattttacagagaagaactgtaggcatggagatacggtacttcgtgtccatgccagagtcgggaccacagccttgcttagcagttgttagctaaactgtcacccaaatctgattaacaacaaaaatgttcctcttacacttttcaagccagctaaatgagaagggcacaaggaatctgtgtctctcaacacaaaaggctgcaattgccaaaccaatggaatgaatgtagatatgtcattgaaaataaatggaaaaggccgaggtgtcggtccacccccatcccccaaccgcacagttgcgcaatattccagcatgttttttatgcattcccgatggtgacttaatattttctatgagatggaatgtgaatattctcatgctagagctcactatcatggactctttgtgccttaatagtaaatgaaaaataaaatgcaaatcctccagctgtttgtttttctgccttggcacaaatgaaaataaaaatttccctacccaagatctcttgggaatctgtcgtgtttcaggtttgcttttgtcagaccattaagccggagttttccttgtcataatttcatctgattctttttaattagaactctatgcgtggtaattcctctctcgcttcagtatttacaagtttcaaatatttgttgactgttatcagacagttcctcctcagcctaccttacatgtttagtttctctaatcacctttctatggttagactttccgtgcccttcatcgtttttcattcttagtagttgtcattttcctaagctgactttcatattgtggcttcatttctgtcattcttcttttattgacgataccttccaaactcattgccattggttgatttcatgatcatgctgttgactaagaaaattaatttaccattggtattgtattttgttcatgagcttcccaccccctgcctgactctaaatatattttggccttatctcattaacattacttgtacttctgttgagcctttctctcttttaaaaataatgtccaaatatatttccatgttgtgctcaatgtctcaactaatgttttgtaggaacaaaagcaccaactgataattgtatgatgatccagttttgttcattttcagtcttaaatgtactctgcttatatttacaaactcgttgaaacttatcataatgaagaaagaattgtgtggaaagccgctgtgcttagcgtgttcacctgattattcttagctgtcttctgaaatctacgttattactaggaatggagatgctgcttgttcttttattttctaaggaataccatctagacctctctgtctccttctgtttatcgtgcaagcttcagactgaccccagtggggttccccgtgttccttggttttgagcatatttgaaattgctgataacacaagagttaccccttttttaaaacacatctactctggttttccctttcctgtcattgagtgtcctcccttggctccccaatcatggttacttttgactctcctcacatagccttgtcttcctattaattcatagagtctttgtcattcttattccttagtctaggagacatatagcacatatttgactttgaagtctgacgaacttaaggacaaatcaggcaagttagggtataaccagggggaaactatttggcctgtccgagctaaataggtcttctcacctgttaaatacaaataatgatgcatactcattgggttgctctaactattaaatgatctgatgaacttgaagttcttagcagtgtgtgatacacagtggggctcactatggggtttctgggcttcctaccatgaatcttatccctggagctctcattcattgtactgggtcttccccttcctcctgccccttcaggcttctcttttatctcaagttgtgtggttgctttcaaaactgttaatatgtgtgttcctaaatcatttccagtaaatcatggctctcactcaccagagctcccaaaatgtttctgaggtcatggaagtgtgtctgagaatgggcctgcactggagggcctacaggtgctcatctgagaagccagggttgaatttgaaaaaggcaccttttgttcttcaaaactacaaaaacaaggctcagctattgttgaaaaacatgccaaacccaaccacaattccctctgtcaatcagctggtcgttagtagagttcattgtcctgtgctgattagaaagcagtaccccacccccctccgtaaggaggtgattatcaactgtggagctacagaaggctagtgctgtgggcatttcaatgtaattatggagttctaagtacttgcccataaaaaattatgtggctgtttctttggaaatgccaacatttgtacccataagggaaatattttattaaaatatgataatatcatggatgcttaagtgtggtggctggaagctgccagctgaatgattttatcttcaagcaaaactataaaatggaaacaacaagatatgaaagaatctctgggaaagaggagagacagaaggagttagaaagcaagagaaggctctaaaatggcatgctgaaattgcaaagccagacagagaagatggtggaaatgcagaatcaccagagcctgagccgacacccagcacagcagagaggaggagcggctgctgcagcagagtgacttgaacaagacatctgagtggattgatttggttgccacacagaaccacgagttccaatgaggagcagtggaagattgtacctgaaggcgctgattgtgctattcaatctggcctcttatctagaaaaacccttagacacttgggtgctttaaaacctgggataagcccaggaaccagtgtgaaatcatgacttaatgaactcctcaccagagaaagagtgtgtctttccattcttcacccttgaaactaagtttagatctacaaaatgcagtgggtgagggagacagatcctgacagggaaatccaaaagaagatggagggctggctgaagtgacatggaaggactctccattacttggtgggattgattttagaaaaatgttctaaatataaactggatgtgctttttttcaaacagcttccttattaatcaatagtgcataaagactttttccagacagcccaggaaaatgtagcaaaggggcgagatgtgcgaattgtatgtgtgtaacagccccaaaggatactacggtaatgataatagactcaacattcagattacatttcagactttcaagaacctttgtaaccactcattcttaatctcttatccctgcctcaagccgtagttgacagaccagcctttatattctcagttttacaaggcatgagcatgaaatgcaaaagtttggcagtttcccaaggtcaaaatcagtcaatgacaaaaatccagaccacatctgtctgttctcagagtgcagaccagagtgtctggaaaaacaacataatcacctattacgagttacgagtgacagagttacaagcacaccaaaccagcgtgcctttgtttccccacggaggcaatgctgttgttcagctatctcccaaagctacagcagcaaggcgaatgcaatgctgtgtgcctaatataaatggtatttaataatacactttaaaaggaggagtggagaaaagtgagcttaacattatttgactctctttcagaagctgagatgtaaaagctgcacctcttacccccaaaggacctattttggacccaaatttggtagtcatgcattcagggagaggttctcttattatcttaaattcaatactgtgatttatattaaatattgtaaattatacaataaaagatttccttcatatgggtacagagatagatcaggtataggtctctaaggcacagtgttccttattaatagcagttaattctgtgtactaacatctttgagctctggtcgttgaatcctaggtggatttgactagagttcttaaccaacattttaatccaatttttatgaaaggaagagtaatgaggacttttctctaagactgatgaaaaacctaagtgtctttatagaagccaagaatatctgatcagattcttcaaggaagcaaaaatcctgtaaatgtcagaaagatgatgctggaaaacccctttggtcaaattcatctaaagaaggtactatttgtaggtgacttttcagcaagtctgtcaaaagcttcttgctacagataaaaattcaataacctttcactgtggatgtgccacaattatcactaatttaaaaacagtccctctaatagagtattttatcatgccggacagtctctgcattgttcattatttagtgtttgctaagctgatggcacttccaccaacttttcttatctctacttcttcagaattggattttatatttccaaaccagccagatatgacaagtcattttcttctctcttgtcttttaagaaacgcaaacttgatttttttttaacaatcaccacttaaaagattaaagttattggcaatgtctgtattaactagcattgggatgtgcagtaaggcctattgcattttaattgcaactggggtcttcccttcttcttttttattctttctcttttccaatacatgtgtatgtattctctatctctttggaactccccattctgctaaaacacacagtgtatggcaaagatgaggtattatgaagcctgatgtagttagaagacaaggcaaggagagtattatcagaactattatattatagaacctccaaaaggtggtgataaatggtataagtagatctttcagtaaatatagactgtctttatatgagaaacttcctgaaaggaaaatgataaagtcattatcctgacacccgagggatacatgccacttcaaacaacatctctttctatccatagctcattattgaaatttttaactattttaagcctgaaaaaattctactagctgtgattctgaaagattttaaaagatctgtatactttacccaagctttggaccacgataagacagccacacatcttctgtcattgggaactctctccttaggcctcagggcatcttctgtcattgggaactctctccttaggcctcagggtctgctcctctgtccaagagagtctctcccaattttcagggaagtatagaacttcgttcaagaagtttgatgataagattttgaccttttaggggtacagtctttcaatagtgatatcagaatgctgaaaaagattgtgttagaaaatctcaccaaaatattcattttaagatttgtggattattgttgtaagcatcaaacagaaatagcattgtagtcagtcttcatacattaataataagggctgccctttaggattggctttacaaagaaaaatatttgctcaaactttacccagagacaggagatgcctgtcacgtctgcttctaaaagagggagtgtgactaaaaatccaccatcttattacttgtttaatggtaccacaagtccaattaacgcatttgttcaagccaacagccttttagcttttcacagaaatcttggaagtgtgctagagaaacacccccacaaaaaggttttgcatatgctgctgtatctgcctctctccaggaagcggagcatgggtcactgacagacagatggctgccacaagcgccaccagcggccagaaactcctcccaccagctcccattcctgcaaaacaaatgaggaggggtgcttttcttgaatgctgtgcctggactttctctcccttgacccagccctacccatggaataccaaggcaacctcaacatctgttacactcctgccttaattctattcctcagcaccagcataactcaatagaggagtatgggcttgtccttggacaaggtacttgacattgctgatgatgtcgtctgtattataaatccctcataggttatttggaggctaaggtcaactaacgtatacacaacacctggtacaatgcctgcaaacagtgatcacgtgataaatagtagtttcttctgctccttcttttttaagctcttttcctcattcttagtcttcctgagactattttatttcttgctttctcatttagctaccaatatttgcccatagtggtactcaacatgaaatgcccaaatctgccctctgtttatttccccctactcctgtccttcctgttgatagctgggtcattctgcccattctgcctgatactttaacttcatctcaaaagatctttgctgtattgcatttgaaattagattttgagctcttaaatttaacagccttccaaaatccacatggcttgggaacacaggcatagggtaaggtcgtatttattcagggccacaatgagtgaaacttaaggttaacctccagatctcattaaatgacttcctctgtgaacttgtatgtcagcatatcgagaaatatggcaatgaagaagctgctgaattggccaggtgcagtggctcacgcctgaatcctaccactctggggggccaaggcaggtggatcacctgatgtcaggagttactagcctggccaacatggtgaaaccccatctctactaaaaatacaaaaattagccaagcgtggtggcaggcacctgtaatctcaactactcaggaggctgaggcaggagaattgctggaacccaggaggtggaggttgcagtgagccaagattgtgccattgcactccagcccgagctgacaacagtgagactgtgtctcagaaaaaaaaaaagaaaaaaaaagaagctgttgaattgtggcttcagtaaaaactataacaaaaatggcagaccagctaatttcagagcccacagtagctctgggactcagaccttttaacatcaagggaatgattctgtctgtattgaagtgggctttggaatagctgtagttaagatctacccaagcttcagctgggcatcctccacaggggtgacaatgatctggttagctgcttaccccttctctgctgcctaataacacacttacaggaattctgggagtctcagttctgctaggatcttaggagtgttagctaggaatggaaatttgtgttcttttttgttatcatttcagccatttttaaatgtccagtttggtggcattcagtacattcacattattgagtagccatcaccatcatccatctgcagaacttttttcatcttctcaaactaaaactccatattccttaaacaataatccctcatttctccttccctccagcccttggcaacctccattctacttcctatctctatgaatttgactactctaggtggcccatataagtggaatcatgtagtatttgttgttttgtgactgacttgttttgtttagcatgatgtcttcaaggtccatccgtgttgaagcatgtgttagcactcccttcttttttgaaagctgcatgatattctattgaatggctgtaccacactttatttctccattcatccatcagtggatgcttagggtgcttccatcttttgcctattgtgagtaatgctgctgtaacatgggtggacaaatatctgttcaagtcctggttttcagatcatttgggtatatacccagaagtgaaattgtggaaattagtcatttgagattagatgtactgcacgtctttctacttcttctcaactctctgattgcttatataagtgacgtcttctgaaggaaagttcagcattttttctcagatatgataataatatatgctaagatcttggccaggcacggtggctcacacctgtaatcccagcactttgggaagccaaggtgggcggatcacttgaggtcaagagtttgctgccttcaaatcaatcattacttcttagcacctcttgaaatagaaaataaaaaatttggccaggcggtggccaggcgcagtggctcatgcctgtaatctcagcactttgggaggctgaggtgggaagatctcttgagcccaggagtttgagaccagactgggcaacacagggagacctcatctctacaaaaaagaaaaaaaaaattaattagccaggtgtggccccatttgtacaaaaaaaaatttttttttaattagctgggcatggtcatgtacacatgtggtcccagctactagggaggctaaggtgggaggaacgcttgagcctgggatgtcaaggctgcggtgaggtgtgattgcaccactgcactccagcccagcaacagagaaagaccctgtctcaaaaaggaaaagaaaagaaaaaaatgtaaaagccctagatagtaccctcctttcactcctagagaattcaaaatttacaatggaaatttaagcttactgtcttgttctctagatcagctgtttacaatgttggctatatgccccccaataattgtgtaaaacaatacattgaagcatgggaaggaaacatgagaccatttatgtatgctttttaaaagtaaaacaatcagaaacattgcaagttttactaatatttaacataagagatgacatgatagccctcatttgagccatatgtgaagtactatatgggaggaatcctgcaggaaccccaaggattcctcagcagagagaggctcaatcttctgccatttttaaaaattttcaacattttgtaatatgttccaggtgaagtagatttatggattacattttctagtttttactaaacttaccttccccaaatggataagtgacttaaaagggaaactgtggattgacactataagcaaaaatgaacatgagaaaatggcagaactggcattgtcactgttcctggtggggatcttcatcagtcacattataattatctaagcagtaataatctatcagatgactggaaactggcaaaagaacttgtcaaggatattatttggaatacggatttacatctacaattattaacatgaaccttgctctaagtgtatgtgtgccttgaaatattagctaatacatgttgaagctgtaatcattaggaagacatttaagaatatcacttgtttcatctttagcttactttttattgatttcttttctggttatatttttaaacttatataatgtattagtaccagtatatataaataactaaatgtacatttactattaatctggacacaaatatttttcgctgttggaatatataatcaaagaggtttggaaattgttgtgttactggatccttggggtgtcccttcaccagcaggaagcctctgtggccactggtgcctttgcccgagttttgctcaggaccactgggctcacttgacctggcaggctgtgcttggcttggcttggcttgtgctaccggcctggatcccatgcctgtcaagggcaagtggagcagcaagaggggtgtgagcaagtgagcatgggctccagccactgctcacagccagatacactggctgcagtgggatggacaactccagggaccagcataggcaccagctgtctgtgaggctgcagctaaaccaggcataccacaagcagcttccacacctggcaccagggaacacggtggtacacggaagtttggagacaccaggaactgcggagccccaaaggggatgtcacagccctggctcggggagctcctacatctgggcttcccaaggggccgcagctcttctctcctctcttctgtccttgttgcttgcaacttggtgagcaaggggagtgtctcagccctgtttatgttatacctcttttagccctgccattcggcaggtcctgatttcttgtcctgcatccaggaagaatgagttacatgttcaagtgttgtgtgagcagagtgaagaggagctttattgagcaacaaaacagctcagtggagacctgcagtgggtaactcctttctgtagcaaaggcatcccaatgagtattcagctctcagcatagaggagaccctgtggtgggtagctcctctctgcagctggttgtcccgtcaagtgttcagctctcagcagagaggagaccctggagtgggtagctcctctctgcaggcaggtcatcctgtcgagtgcttaagtctggctgagtctggggcttttctgggcttcagaggggaggaagtgtgtgttgattggtccatgggtgagcctggaaaaagtaacataagttcccactctggtccatgggactggcagcctggcccccaggcttcagacctttctttacttaaaggtggggcttcaccggggacctggccctgtctgccctggagcttgtctgcctcctgctgctgttcatggtgcccaggctgtttgtgccaaggggcacctacaggcctgcaccatgctgccctcagcaccccatctgcctccctcctgacaagccagcacccaaaggccagaaggggctggcgtgtcagcacttccctgagtgcgtgcatacgtgaccaggttgcaacagtgcccaggcttagcctcaactttgctctgagatcagagtgggcactgggagcagggagaagccaggcagtgagagtaggcacttctgagccttcaggggcagttggggggcttcccaggcccctgagagtccagagatgcccaggtccacagctccagtttgggtggcagcagctgcacctgggagggcagggctcctgcctgctcctggcccccaagagcacagggaggcctgggtccgcagctgcaactgggggccatcaattgctttagacactattgtctccaaatgaagttgtaatgggaccacagggacagtagtaccattgctttttatgttcttttttttttctttgttttgtttttagatgaacactgtgaattgtagctgataatatgacataattaggagtttagcagtctccagattctttccataaaacttaaagtaagtgttaaaagatagaggcggctcaaataggatgggattttctgacagacaagcagactaacaacagttcttcctccctggaagctcttttgtctgttttaatcattgcaaagtgaagcatataatggccaatgctggagtgtacagaaacttggcctttcagttatctgtacctagtattagaacaaaccagcccagatacttctcgcaattcagtgagttgactgagcagcttttctagccagagctcctcaagtagctgtgctcagctggcagctcagtgggggctgcatcatgtgggggaactgggggcctctctccatgtggtcctttcatctgggctgcttcagtgcacacaggtctcagggcagctccaagaaggcaaagactgaagctagaatagctaaggcccagattctgaaactcacataacagaacttcagccatatcctatcagtcagtgtaagctataaagccaatcaagatttaagaggtgaggaaaagactctatttcttaatggggaaaagctgcaaagaattgtgatcatacttattccaccacactggtaaattaggaagaaacaataccaaaaaagatatttataattaatcactttggcctgtacagagagcatgttttctatgcatttccttataaaaagtgtattttccacgtgataataccattgatttttttttttgtcaatgtgagaactatatagagaggctaaaatgtgcaactgaaatgatgcatcttttcagtgttcctcagtggcattctcaaaatgatcgttatattcatggcttaaaattaactaaattaagttttcaatgcaagtgttccctaaagtcaaagcttttcttcatttcttcattagagattaatttgtagcatgtctcattgaatggattgttcacagtgattgtttttcagttagacctcttagaaatagttttattttagaaaggcagaataattatagactgttaaatgtctaagtgaccctgaatagttctaggaaggtgtacagaatactgatacttccttaatgccatatatgctggaaattttagagtaaatatacattaattaaaatatctaccataactttcaagcacttacttttgaataactgtagtctttagtcttcagtaaaatcctgatgcaaagtacaacttagtctaaattaggattttcctgatagagtctaaggagtacaagccactctggtctttggaaagtcaagattcttaaatgttaatgtggcatttcctgtgttgaccatttggataatggattactccatcatttcttttgtatacccaccctttataaggattatttcttaatccttatatgtttcacatacatcatgaaacaacaaaaggcttcattatcaggagcttctattcgcttcagcagaaccatttgaaacatctaaacagttgagaaatgcatcccagtaatatactcagaaggcctaggaaacaagaatagtgaaaatagctattaactcaaattcattaggggttaattagccatgttgcaatctccttaattttctactttccacactgaattagtcatgtgtattacttaacccagccactattgccagatcagttagcactacgattccttttcctcagcaatgcttcatattatgacttagatcataaaccagagcaccaggtagaaatcacagccaatctgagtgtgctgcatggggcctcgtgatacttcctgttaatttagatgttgacagggccagtatcagtaatgaaattagttcagggcataactccttgaacatagcaggcacttagtaaatgttttatcaaattgaattaaattaacaaaatgcttccagtgagggcctgaaatcttctaccttgcttttatttgccaaattggctacttaatcaaatgaatcaaccatttttcttatttttgcaagtactatcatttcttttcctttttttttctccctcacatttcaaaaactgatagtaacaattactaatgtcttatagtactgggacgttcctctctagtcatccatttatctctgctaagaatttctcttaggattaaatagtatgattactatttccacatatttccacagtattttggtcattaacatacatatttaaagcaatatatttaattatatgcctattttatcccttgctaaatgtggattttatttactgaaactgttctctctgactttctactttgacttctctttctttttcttaaacaatctttcctatagtacctactctggcacaaaaaacactgttatattccagaagttcttttttaacccaaaagttagagaattggcatagctactgacattgaaagaggaaatgaagataaggctaaaaacaggaggacttgttaaaagtctgtttaggatatatttaccctcagatttttctctcttacttcatatacctgtgccactgcttctatcagaattgcagctgagcactggagttttagtttctgaaaatggtaaaatagagattccttggactgagggacataagtcatagctgagtgtgagggctgttattctgaaatcaggcaaagtttacattaatgactgctgacacttctgttctttttcctattggctggcatccaggaatataacttcagacaaaagactagaaagtcttttctgaaaaatctgataagcaccaggatggtgcaggtgtaggcgggagatagacactaacatcagtggttctccaataaaagagaccagccagatcacctacaaagacaactacaatgcatcagccttacctccagacacaaaactccagtcagccccacttaaatatgagcagacagccaagaagagtaatgtttgaggaaaccttataataggaaacagagaccaaaacaaacaggaaaagcaacttagaggaaacagggattatccagaaattaagaaaaacttaaaaaatgaaaattaatatccctagaagaaataagagaagatattgtattcatgaaacaagagtagtatagtatatgaaaggaactttcagaaaacaagaactcttagaaataaaaaataaagtgaaataaaaatctcagaagatagaactgaagaaatatccatgaaggtggaaaaaaaagacaaaaaagaaaaaggaccctaggaagcagcaggatattccataactgaattttaggtctacagagaaaaaaaggagagaaaatagagagggccataaaaaaaattaagaaaaattcccaaaatggaaaacaggaattctcaaaatgaaaggacccagtggatgaaaacagacctacatcctcaccaaggcagtcatctcaaaattgcagaaccctcaagttagaaagaaaaccctacaactgtcagaagaaaaaaaaaataaaagtttttctagaaagtacatctagaaaagaagcagaaaagcaatgatttgtcaaaagtggcagaggaagttaggtgacaaaaagaaaaaaaactatcagattctaagaaaattgattttcaacctagaattgtttatctaaccacactaccagttccatgtaagggaagaatacggacgttttcagacatacaagttctcagaaaacttatcttccatgcagtcttccatagaatctaccaaaccgaaggagtttacataaaaataggaaaacatgggctacaagaaatggggattctagagtagttacggaaagagaaagatctccagagtgatcatgacaggatatgccaagataacagctctgccacaggcctaggaagcagctagcccagagaggaatagctgatctctcaggagagctttgtggaggagcaggatgttgattagaatacctaatgtgttaggatttattgaaaaaaaaaattgtccatcataagagagtttggagttgagtactttaaacaacgaataaaactgttataaggaatttagcatctatgttcatcaaggatattggtctgtagttttcttttttggttatgtcctttcctggttttggtattagggtgatagatactggcttcatagaatgatttagggagggttccctctttctctatcttgtggaatagtgtcaataggattagtaccaattctttgaatgtctggcagaattctgtgaatccatctggtcttggacttttttttgttggtaatttttaaattaccatttcaatctcactgcttgttatttaacatacacaagtcaataaatgtgatacaccacataaacagaattaaaaaccaaaatcacatgatcgtctcaataaatgcagaaaaagcatttgacaaaatccagcatccctttatgcatccctggtgtgaaacccacttgatcatggcgggttatctttctgatatgttattggattcggttagctagtattttgttaagtattttagcatctatgttcatcagggatattgctgtacgattgattataagatcacagaacttgcaagtttgacagaacctcagccagtagtcagctgcaatgacaagcactgccatttattgagaatttatgatacacaagatgctatactgcagattttaggatatcgtctctaatcttcacaatcctgtgtaagtttggtaggcagaacaaatggctccccaacgatgtccacgtcctaatccccagaacctacaaaaatgtgaggcaaatgacaattaaggttctcggctcacctgagaatagggaggttatcttgggttatgcaggtgagcccagtgtaatttaagggctcttaaaagtggaatagggagacagaaaagtagattagagtaatgcaatgtgagaaagactcaaccctcattgctggctttgaagatgaggaaggagccaggcagcctcccaaagctggaaaaggcaagtaaatggattcacccctagagcctctgacacttatttaaaccaatgagactcatgtcaaacttttttttttttttttttttttttgagatggagtgttgctctgttgcccaggctggagcgcagtggcatgatttcggctcactgcaacctctgcctcccaggttcaagcaattctcatgcctcagcctcccgagaagctgggactacaggcgcacgccactgcacctggctaattttttttatttttagtaaagacgcggttttgccatgttggccaggctggtcttgaactcctgacctcaggtgatccaccgcctgccttggtctcccaaagtgctgggataacaggcatgagcccccgtgcccagcctcatatccaacttctaatctccagaattgtaagataataaatggatgttgttttaagccataaggtacatggtaatgtcacagcagcactgggaagctaacacagtaagtattaatgcctccatttttctgatgacaaaactaagtttcaaagattgagtaactttacaaaaaccatgactaagtaactggcacaggcaggactggaacctaggccagtgtaactcttagaccagactctttcaacagcagtaatagttggcatttgtagaacaccaaccaggtaggaagcaggctgtggtctatgcactctaatgtggtacctcatctagtccttacagcagcctatgggggaaggtggtggccgccctcatttctcagaggaggaaattgaggccaagcttggtggaaacaggatttaaagctgtacagtcaaactccagtgcccacgcacttaatctcaacacctctttgctatctcctagcagtttatgaatgagaaaaccgagccaggatgtctgactctctcctgaggtcacacatcaaggtgctgccacagccagatctagaacccaggttaactcttgtctcatctagggccttgtcttcttgaagaacatacttactgtggaaatacaggtgaaaattccgcatcaaacagagataccaaataacagctctaaatagacagtgatgcatttgctctctccttcttgttagtgtagtttaatttcctgagaagctttacacatacccctgagcttttctgtcacagctaattgtgcaacttccaagtagttgtcctgcctatgtttgttacttgggctcattaacataccctttaccgtagatgacactctcattaggttaaattaattaaaagatgatcattggggctacatagcttcagcccgggcagagatgtgccaccttcgaccctctggttcccttcgacagcctctgtggagatgtacccccaagacatttaaaaggctgtgctcttattttctgtcactctttatatactatctaaatcttaccacacaaacaacatttagcatgcaagttaaacagatttaaatttaagcaaaattgagtgtcaccacatgtgcttatgccagatctgtataattcttttgaggtttttggaaacgtgaaccaagccatttacgcttcataggaacagattatatcatttgaaatcctcaataaaaatgcagtctcatattctacagatgggtgtcatttaattaaaatatgtatttaaaatgcaaagggctacgttaattccacactgtggctgagattttaattgcactcaagttaggaaattcggagttaatgttcccctggcatctctcattcagcctcttagaacagatgtattgtgatccaaagaggatttcaatatgttttcacatgctgcacatgtaggaagggctttgagatacagggtggcagcatgataaaaacaggagttgatcccgagcaaaggaagggagtaccgcagcctgtggctgccttccctgtccccgcacttcaccaggtagcccttgctaatcactcacggcagttgtgcctcgtcccacttccctagatcaggtatcacagaaaggttgttggggtgctcccatttttgttttggtggggcagaggggaggcatctgtagtactcagaactgtaaaaatgctcataaattaaaaactcagtgaatgctttttagttgtagagtacattttagggtatacattaagggtttagggtacacatcagcctcgcataagtactgttgtaatacactagaaaatctattccacagtgcaacacacacattttgaaccctcaggaatttctctttagaccaaaggcagcccggaggcaaaagaaacgccaacacctgagggtgtttctgacaaggcaaggagtgaaaggaaagtgacaaatagatgttgtgggcctcagaaccccatgaaataactgcagtgtgaaggatttgggggaaacactggttttacgcttaaattattagagagttatccatgatattaaagtgtcaaaaaggaaagaattgagaattcccatgaaagcagagaagaacgtgaaattggcactgagtaagaaagtatattgtcttttcattcattctgttacttcaatcctttaagcctgctctgtgcccaggactgtgttaggcatggggcattcatcactgaccattagatatggtgtcactttggggattacaacctaatggggccattatctacataagacatgagttaaattaatgcagaggcttctgttttatttttaacgtggttacctaggaaatacagacaattatggagaaaagaagaaaggagtagttcatcttgaaaggatgactgttaagaatgttaagtacagaaatagggacttgtcttatatattttatgagaatgtttttattatgtatgtatgcccctgtgaaatctttttaattaaaatctgcaaagctagtatgaggtaatatatgagaaagaactttaagttcttagaaaaataggcagtgtgtaagtctttggggaagaaagtaaaccccaaacctccttagaaaaatcagcaaaagaaccagtcatagaattcagacctcctggctccttgtccagttcgttatgtcagagtcacaattttttatattgcaaaacaaagccagctaagttgaagaaccaaccatatttttctcttgagttttttttttcttcttctttctatatactttaagttctgggatacatgtgcagaatgtgcaggtttgttacctaggtatacacgggccatggtggtttgctgcacccatcaaccggtcatctacattaggtatttctcctaatgctctccctcccctagcccccgacctcccgacaggccccagtgtgtgatgatcccctccctgtgtccatgtgttctcattgttcaactcccgcttatgagtgagaacatgcggtgtttggttttctgttcctgtgttagtttgctgagagtgatggtttccagcttcatccatgtccctgcaaaggacatgaactcatccttttttatgtctgtgtagtattccatggtgtatatgtgccacgtttttctttatctagtctatcattgatgggcatttgggttggttccaagcctttgctattgtgaacagtgctgtcataaacatacatgtgcatgtatctttatagtagaatgagttataatcctttggatatctacccagtaatggaattgctgggtcaaatggtatttctggttctagatctgtgaggaatcgccacactgtcttccacaatggttgaactaatttacactcccaccaacagtgtaaaagcattcctatttctccacatcccctccagcatctgttgtttcctgactttttaatgattgccattgtaactggcgtgagatggtatctcattgtgattttgatttgcttttctctaatgaccagtgatgatgagctttttttcatctgtttgttggctgcatgaatgtcttcttttgagaagtgtctattcatatccttcacccacattttgttgggattgtttgttttttcttgtaaatttgtttaagttctttgtagattctggatattaacccattgtcagatggatagattgcaaaaattgtctcccattctgtaggttgcctgttcactctgatgatagtttctttagctgtgcagaagctctttagtttaattagatcccatttgtcaatttggctgttgttgccattgcttttggtgttttagtcatgaagtctttgccaatgcctatgtcctgaatggtattgcctaggttttcttctagggtttttatgcttttagggcttacatttaagtctttaatccatcttgacttaatttttgtataaggtgtaaggaagaggtccagtttcagttttctgcatatggctgccagttttcccaacatttattaaatagggaatcctttccccattgcttgtttttgtcaggttggtcaaagatcagatggttgtagatgtgtggtgttatttctgagtcctctgttctgttccattggtctatatctctgttttggtatcggtaccatgctgttttggttactgtagccttgtagtatagtttgaagtcaggtagcatgatgcctccagctttgttctttttgcttaggattgtcttggctatacgggctcttttttggttgcatatgaaatttaaagtagttttttctaattccatgaagaaagccaatggtattttgatgaggatagcattgaatctatgaattactttgggcagtatggccattttcacagtactgattcttcctatccataagcacggaatgtttttccatttgtttgtgtcctctcttatttccttgagcagtggtttgtagttctctttgaagagttccttcacatcccttgtaagtttgattcctaggtattttattctctttgcagcaattgtgaatggaagttgactcatgatttggctctctgtttgtcattaatggtgtataggaatgcttgtgatttttgcacattgatttttgtatcctgagactttgctgaagttgcttatcagcttaaggaaattctgggcttgagatgatggggttttctaaatatacaatcatgtcatctgcagacagagataatttaacttcctctcttcctatttgaatatgctttatttctttcttttgcctgattgccctggccagaacttccaatactatgttgaataggagtggtgagagagggcatccttgtcttgtgccattttcagagggaatgcttccagcttttgcctattcaatatgatactggctgtgagtttatcataaatagctcttactattttgaggtacgttccatcagtacctagtttattgagagtttttagcatgaagaggtgttgaattttatcgaaggctttcctgcatctattgagataatcatgtggttttggtcattggttctgtttatgtgatggattatgtttattgatttgcgtatgttgaaccagccttgcatcccagggatgaagccaactcgatcatggtggataagccttttgatgtgctgctggattcagtttgccagtattttattgaggattttcacatcagtgttcatcagggatattgccctgaaattttgttgttgttgttatgtttctgtcaggtttgtgtatcaggatgatgctggcctcataaaatgggttagggaggagtccctctttttctattgtttggaatagtttcataaggaatggcaccagctcctttttgtacctctggtggaattcagctgtgaattcgtctggtccttgcttttttttggtggtaggctattaattactgcctcaatttcagaacttgttataggtctattcagggctttgacttcttcctggtttagtcttgggagggtgtatgtgtccaggaatttattcatttcttctggattttctagtttattcacatagaggtgtttatagtattctttgatggtaatttgtatttctgtgggatcagtggtaatctcccctttataattttttattgcatctatttgattcttctcttcttcattagtctggctagcggtctatctattttgttaatcttcttaaaaaaccagctcctggattcactgattttttttttgaagtgtttttcgtctctctgtctctttcaattctgctctactctgatctgagttatttattctcttctgctagcttttgaatttgcttactcttgcttctctagttcttttaattgtgatgttagggtctcaattttagatctttcccgctttctcctgtggacatgtagtgctacaaatttccctctaaacactgctttagctgtgtctgagagattctggtatgttgtgtctttgttctcattggtttcaaagaacgtatttatttctgccttcattttgttatttacccagttgtcattcaggagcaggttgtttagtttccatgaagttgtgtggttttgagtgtgtttcttaatcctgagttctaatttgattgcactgtggtcccagagacggtttgttatgatttccgttcttttgcatttgctgaggcatgttttacttccaattatgtggtcagtttttagaataagtgcagtgtggtactgagaataatgtatattctgttgacttgggatggagagttctgtagatgtctattaggtccacttggtccagagctgagttcaagtcctggatatccttgttaatattctgtctcgttgatctgtctgatactgatagtggggtgttaaagtctcccactattattgtgtgggagtctaagtccctttgtaggtctctaagaacttgctttatgaaatctgggtgctcctgtattgggtgcatatatatttaggatagttagctcttcttgttgcattaatccctttaaccattatgtaatgtccttctttgtctttcttgaattttgttggtttaaagtctgttttatctgagactatgattgcaaccactgcttttttttctctttttttgctttccatttgcttggtaaatattcctccatccctctattttgagcctatgtgtgtctttgcatgtgagatgggtctcctgaatacagcacaccaatgggtcttgactctatccaatttgccagtctgtgtcttttaaatggggcatttagcccagttacatttaaagttaacattgttatgtgtgaatttgatcctgtcattatgatgctagctggttattttgcccattagttgatgcagtttcttcatagtgtcaatggtctttacaatttggtatgtttttgcagtggctggtaccagcttttcttttccatatttagtacttccttcaggaactcttgtaaggcaggcctggtggtgacaaaatctctcaacatttgcttgtctgtaaaggattttatttctccttcacttatgaagcttagtttggctggatatgaaattctgggttgaattttttttttctttaagaatgttgaatattggcccccactctcttctggcttgttgggttgctgcggagagatccactgttaatctgatgggcttccctttgtgggtaacccgacctttctttctggctacccttaacatttttccttcatttcaaccttggtgaatctaacaattatgtgtcttggggttgctcttctcgaggagtatctttgtggtgttctctgtatttcctgaatttgaatgttggcctctcttgctaggctggggaagttctcctgaataatatcctgaagagtgttttccaacttggttccattctccttgtcactttcaggtacaccagtcaaacttaggttaggagttttcacgtagtgccatatttcttagaggctttgatcgttccttttcattttttttctctaatcttggcttcacgctttatttcattaagttgatcttcagtctctgatatcctttcttccacttgattgatttggctattgctacttgtgtattattcacgaagctgtcatgctgtgtttttcagctccatcaggtcgtttctgttcttctctaaactggttattctagttagcaattcctctaacctttttcaaggttcttagcttccttgcattgggttagaacatgctactttaccttggaggagtttgttattacacaccttctgaagcctacttctgtcaattcgccaaactcattctccatccagttttgttcccttgctgatgatgagttgtgatcctttggaagagaagaggcattcttatttttggaatttttagcctttgtgtgctggtttttcctcatcttcgtggatttatctaccttgttcttggatattggtgaccttctggtggggtttctgtgtggacgtcctttttattgatgttgatgctattcttttctgtttgttagtttcccttctaacaggccgctctgctgtaggtctgctggagtttgctggaagtccactccagaccctgtttgcctgggtatcaccagcggaggctgcagaacagcaaagattgctgcctgttccttcctctggaagttttgtcccagaggggcacctgccagatgccagctggagctctcctgtatgaggtgtctgtcgacccctgctgggaggtatctcccagtcaggagacacgggggtcagggactcacttgaggaggtagtctgacccttagcagagcttgagtgctgtgctgggagatctgctgctctcttcagagctggcaggcaggaacatttaagtctgctgaacttacaattttcccacagctgccccttcccccaggtgccctgtcccagggagatgggagttttatccataagcccctgactggggctgctgcctttctttcagagatgccctgcccagggaggaggaatctagagaggcagtctagctatagaggctttggggcactgtggtggtctccgtccagttcaaacttcccagtggctttgtttacactgtgaggggaaaactgcctactcaagcctcagaaatggcagacacccctccccccaccaagctcaagtgtcccaggtcgacttcagactgctatgctggcagcgagaatttcaagctagtggatcttagcttgctgggctccgtgggggtgggatccgctgagctagaccacttggctccctggcttcagccccctttccaggggggtgaatggttctgtctcgctggcattccaggcaccactgtggtatgaaaaaaaaaatcctgtagctagctcagtgtctgcccaaatggctgcccagttttgtgcttgaaacccagggcctggtggtgtaggcaccagagggaatctcctggtctgcaggttgcaaagactgtggaaaaagcatagtatctgggccggaattcactatacctcacagcacagtccctcacggcttcccttggctaggggagggagttccccgactccttgcgcttcctggttgagatgatgtcccaccctgcttctgctcaccctccgtgggctgcatccagtgtctaaccggtcccaatgagatgagctggttacctcagttggaaatgcagaaatcacccaccttctgcgttgatctcgctgggagctaccaacccgagctgttcctattcagccatcttgccagccacccttctcttgggtttttaaacttcactgcttcaagatggtgagctatagagtcaccaggaaactgcaggttccaaatggtttcccctgacctgccttccttttcttcatctactgacttctcagccctgaaaaatgattcccaaattgcttctaagtctttgagaaatgtcttctcagttaaaaacccccagagaagctggttaaagactgaagagagaacctcagccctaactgtagtgccttcatgagatatagaggttataaactccagagaaatgaaataccattatgtgcatcagaggcccgggcttgactttctgattctgcaagggtacagaaggtttagagaaccttggcaaatggaggaaaacctaatcatcagggttaatgtgcaggacttgacgagtaagagattgatttctctttgttacgaagaccagtagggcttcagagttgttggttttttaaaaaaaatattcccagctccttgaaccttggctcttataagaaatgtggggaaaatgtgtatatatatatatatatatatatatatagagagagagagagagagagagagagagagagagagagagaaagagagagagaatatgtattctatgtaagaatatgtattgtgtattcttatgagaatatgtgaatatatatacacatatatacataaatatattttttcttatagaagattgtcttacctcttattttttattaaatagatttttctatcaagaggtgaattttcttaaggcaggatgtttgcagaaactaatggaaaacaaaccttttttaaaggagtaattgcctccttaaaagtgctgatttccatgtgaaatttatgccttcttccagaggcagtgaggagtaccccaggcagttcgaaggagacaattcattactggttagtgtacacacaccaagaaggacattaattcacaaaatgaaaaactaatagagtgtttagctgactctttatcaccagtggcagtctgcactgtctctccatcattagtgtttactgagctgatggagaccgcagtcaggcctgcttatcacagctcatcttagatgactttacatcactttcagagctacatggggcatccctcctcacttctttgaaatgaggaatccaggggtctcaaggaagctatgaagttattgtgtccatttttaaattttcttcccattctcttgactttctgatacatcccaagcaaaaactctagccctgtacatggtaccttacgctgtagtcatcccacagccactttctgagctaattagaaaactaccatctttactcctgttttacagatgtaaaaactgaagtataaaaggtatgaaccatctttaaccaatgagagagctgggatattaacctgagagctacattactttttattaaactaacaagaaattttaccctgcttctttttctccttcttacattcattattttccattttttcaatacccctcatgtaaatgattagtctgtccactatatttatgatttctactttctcatgtgacagaaaaatttttaccaatccgtcatctgaagtacaaagcaaaggtgtcttttcttctgaaaatgtgtttcagtgattcttggacatactttaactttctggattagggagttcgttacttatcttccttatcttttaagttgttttcttaactaatacaaataggtataatgacattataacaaacttaaaatatcagaattgctttattaagttcaaagtaaatttgaaaatatagtgtggtaggaatatgcaaagagaggatcatttacatatctttatattgaaataaagcaatgcttagataaatattgcaaatacaaaaccccagaaattttcactgtctacattagagaattttttggtaattttgtgtgttgtgggttttttgagttatagagcatgaggaagtgctgaaagtggtctcacttggaaaaggaaatttggcttccctgtttttgcctttgatctctgacttccatattatattccctgggtctgtcccctgtgtcactctccatcttctccagtaggcatcccctgctgagggaacagacagatacatagtcaatcagctgggtagccacaactgttacacacatagacagggattcatacatcatgtgttctggggaatttttccaacagaaattaaatcagtggtgcactatcttatgaggacattagagaagatattcatttattcaggaagtatttgtggatagttcagtttaacaaataacacagtaccagctctgtccctaggctacagggacatggataaacaagacccagcctctgcctacagggagtttaaaagtcgtggaaaatacaggcatgaaagtaatcaccccataatatgattcggcgaccatggaaaaagcacaacatataattggaatatatgatgtatacatcttaaggggaatgtaagtatcaaggaaggcattctggagaagatggcacctgatctgtgtcttgaagggtaaatagtaataagccagacaaagaggggttatttattatgttaaattgttattacattatagaagtcacattatggagggtaaactaagtgaaaggaaagaaaaggctatgaagtggaagaaaatatggtgagttcagagtaattcacatattcagtagggctacattgcagggcttactataggggagcagcaagaagtaacgaagctagagaggtaggcaaggtcagttgagattttatgtggaggacaatgtcaagctattgaaagattttagactaaaagagacatgatcagatggtgttttggaattatttctccagtaagaatacagggtaatgaattggaaaagaataattcttaaggtaagagattatttagaaacctgatgcattaacatggatgatagatggcaaaagatttgtcttagtctgttttgtgctgctataacacaatacctgaggctggctagtttataaagaacagagatttatttcttatagttctggaggatgggaagtcccaaattgaggggcctgcatctggcaagtgcattcctattgcatcaccccctggtggaagggggaaggcagaagatgaaaaggcaagagaaaaagggacggggccgcaaactcagccttttcataactaacccactcctgctatgatggccttaatccattcatgagggtagaaccctcaggcctagtcacctctttaaggtcccacctcttaacattgttgcattggggattaagttttcagcccatgctttttgagggacacgtttaaaccatagcagactataccaaggcagagatagtggggttggattcaagagatattaagaaagaatgatatagggagtacaggaaacgggcatcaaaagtgtttccaagttctttgtctgtactagtcacactgtggctatattaagcactgtgctaggatgcagaatcatctatgccaaatagaaccatatgttaaaatgacatttattaaaatgaaacttgacctgcacatcacacatgtgtattacagcttaattctaaatacaaacaactaaagaaaactatccaaattatttagttgaactagaactttatacagttttccttaggatatactgttgattcatagaaatctcttccagtataaagatatttgtagtaatattatttgatcggtagtacacaaatctaatcttagatattattctccagacatacctactagaagcagcaacatggactcacttgaatggcattttgttcgtgccctgtatttgtcccattcgggagatagagtgaaacaagagttctgttttggggttaacaggcagaattataagcagctaagcaacctaaaatagttcaaaacacaaaggcaaggaaggtgattctcaccctaagcaataagcttttgaatgtccctaaagtaactcagcttgttagtagtcattgtgaatggtttaatgaaagtaaaagttgatggtactaactgaaataaaattatggaattcttgtgtaagtttcactgagaattgaatctattgattttgcaagtagtaatcaacatctttgctctgtgtataatgctttcaccccaaattatggcaaagtaccagatggaccatttgcagcaactaagtaaattcaagcgctgtataaattcctataccttttttttttgagttctgtatcgcatatggaggaaagcacaaatatttattcaccatccttgtttataagtacagtgtgggaaatattttgtggaaattcacctctctgagaagttagaaaaaatattcaaatgaagattaaaataagtgaagaaggaagaagcaagtgatattttcataaaagtatactattcactcagatagagggtctggatcatgctttcttgacataaatgatgacactgatatggggatagtagggatggtttcaattagcttgacatttccagaagtcaaattcagccaaactagaatactagataagttcttaactcatcttttgggtgatttttcttctccagagagaaacacttggagactcaacattttgtgcataattctgaccaaaaggaagaattcatgggaaagtaaaaatttataatctttaaagaatgttatcatatcatattggaatttacacagcaaagaaagtaaacactaggcatagctagatgtttagttttaagaaagttaaatttttagacatttggagaaaatgtaggtatgatctcgtgaatagaaacctatcaaagggagtgtaatttatgatgaggggtgggagattatacaatataacatttgaactataaaatgctaagtaattttaacaaaaaataatagcaaacattcaatgacaaggtatattctaaaatgcgtgtgcacacacacacacacacacacacacgctattcactttcaccataacccaagaagtagatatcataatcttcatttttacaaattgggaaactgagtcacaggtagagtaaaataactcaaacaaggacacacagctattaaatggtgaagccaaaatttgaacctatttagtatgccttcacagcctgtgcttttaaccaccacactattgtgtagcattcagagaactctctgatgaggtcacgtagaagaagatgtattttaaaaatgaaagaaaagccctgcagtcaatcacagatgagtgcatatagcaagcacacaaaatgtccggggggcctgcaggtacagtgttggagacactaaagcctagaatgacttaatggtcatcagagatgttaaggaccacaaaatgcagtgtgtggctatgtttaggcacaaagagaacatcaaacagataggtccacagattggtgaagtagtgaatataatgttaagaaaaagcagaaccactctaacctctcttttgtttctgtcttatttagaaaggggcctgctcttcaaatgtaaggataagacaagttgtgataagaaacagctgtgaggaaagcgtcagatggcatctggcttctttagagtagaacttaaacagatcaaatccaagggtgttaaggaaatttgctgaatttgagaaattgtggagcatgtaaaaggtgacagaatacccagattacagcagatattcctattctcaaaacagagtgaagaagaaattctagaaactacagattaatgttagatagtgaaccaatatgatagttagcacatggaaaagaatatgatgagtgccaggagccaacatggttcacaagagggagaaaaactatcataggtgcccaaggactactgaaagaaaatgaacaggccttaccatggaagaaacacgggcactatgcatatgtccttgtagttaccagtcagagaccaagtcttgccacagtctcaaatacctttgtttggtttacaaattggtatgaatatgtatttttttaacttagctcttatgtcctaacaaatcaaggtttaccagtatcagcccactgtttctctgaaaatcaaatttgacttaatccagcaagggaacatgcaaaactttaagtttcactttttaaaagtgaatgttctgatgaatgagccttagaacaaagagagctaagcttttctgccttgataggtggttccttctcaatttcatacctttaacctaattgccaaaggcttgcttgaggcttggtggtctaacctgtggagcccagaaattgtaacacactgagtgtgctcatgggcatggactttgtttggaagatacattcagtcttaagctgaagcttttacagaataattgaaagcagctccaaattgagtgaccttgctaagaagtctgttttggtggggtctacatctttaacctgggattctagaaaatagtagagaaacccatggcatacttttctaaaaagttaaaaagtaaaatagtcctgtgaaacattttctgaaaggaatgttgaatcttctttgcaagggcatcttgtgtgtgttattgagaataagagcaattcataatgtgttcagtattcactaaatccaaaaaaaaagatactagagtttatgtagcaaaaataatgaagagaaaggagaaagcaaatcacttgcttccaaataaatattatttatatagattgtcctcccactcgtcctcagcctataggaacggtgccataatttgaatgtttgacttctatccctgccttggctcacagctagagagtggagtgcagtaggaacttgtttgctgtgaccaaatctttccttttcaaagatagtggtttgcgagcagctggttttttctttgctttgggttggtttgttttgttgttgtggtttatttgtttgtttttgtgtgtgtggttttttgtttgagttggttttgttgttttgtgtgtgtgtgtgtgtgtgtgtgtgtgtttgtttgttttagcagcagaaccctttcttctagcagaattttactgtaaagtctgaattgggtaacaaatcaaagtggagcctctctgactaaggaagcagggaaggcaagatggagagaatggagactgaaaaatgttaaattgaattaagtttggcccaaagctgcctctgtacatgttttaagtttgaccaaaaggtttctttgtacatagtgaactgtaacctaacttgatgtgcaaacagactagaacttactcttgtaacaggtagctgagtctcagccagtcacagcagccaagcttcagtcagtgataggcagccaactcttcaacccaggttcaaatgaggcaaacactgagctttaaccaagtatgcatcctttgtacatccctcccgttacatgtcacttccttttctctggctataaatataatctacacatgtggtagagcagagcattctgaaccatttttggtctgggctgctgcactattctagaatcacaaataaaagccagttgagatctacgtttgttgtaatttggtcttttaacagagattaggaactctgcagggcactttccaaaaatccttgccttagaggttgcagcattgcattaaaggtagcccagagatccttggtgacccttcatctcactacttcctggtccagtcttctctgagatttaaagtgccatagttcaaaaatgtctcaggagtagaaggttacattcattcatcaaggctcagttgggagaacagaaaccattttaggtatttcaagcaagaaggaatttaatgtagggaatacgatgttttagaaattgctgaaagggcttagacagccgttggaaggatacaaaaagcaaggaatctagctgctgcctttcaggataatcaggaaatgcagccggggatttcaccttcctgctgcgaggaagcagctgtctgcaggagctcttctggaagctgctgcaagcttctgatttgccagctgcctgagcatctttctgccactgtaagaagagaatcctgccttccctttctttttgccttacacagcttttgggagtacatctcaatggcagaatccaaacccaaaacccctactggcaagaagttgtagatgttcctatgcttccaggaaagtggctagaggtgacactgagttgacaacagacaaagcacaagggtatgttcccatttcactctgtacagtaaatttagtctagagtaataggaaggtgaacgtatttccaagaaagcagataaaataacaagtctcctgtggtagtaaatataaaaagcatctttccaaaataatcctgattcagctgttttaagccttagtggaaaacctgatttgtcagtgtttttatgtatatattaaaataatttataatccaatttctgtctcttcaggtgaatataacacaatttctatcatttgaggtcaaaacttcataggtatcataatggctgtttagattcagaatcattactgtcttacctttaccaccaggtaaaggtaatcacacttgagtgtgattacactcaagtaatcttcttcccttctcatagtgcctctttggtagaaaggaaataaacggcggtcaggaaataaatgctgactccaggccctgtttgagtaaggcagacatgatctctcaatcacatgaacaatttacaggctttggtgaatattctttgaattcctaaaataacccctaagttgcggctgggtgcggtggctcacgcctgtaatcccagcactttgggaggcccaggcaggtggatcacaaggtcaagagatcgagatcatcctggctaacatggcaaaaccctgtctctaccaaaaatacaaaaaaattagccgggcatggtggcgggcgcctgtagtcccagctactcgggaggctgaggcaggagaatggcgtgaacctgggaggcggagcttgcagtgagccgagatcgcaccactgcactccagcctgggcgacagagcgagactccatctcaaaaaaaaagaaaaaaaaaccctaaattgccttcgttaaagaacctagcttggcagacatcctttccttggaaagggagatgcctgtcattcttcaaaataatgttaaaaacactgatttatctcctcccacgctgctcctcaacatcattcctggctttcctaccaatctaccacctacctcatgcctgaaggccatctctaccactgaactggcgactggagaaaggcattctcccctttttatgtatgaaaagataaaatttgaacctgccctctgccttaatcccttttctctcctgcgtattttcactaatttaaacattgccagaatcctgtgctgttctcatacttctatgatgccttattttaagttcaaaatgtcatgatcttacccagtgtgtatgtttaatggattaatgtatcattttctttctggccattagccacatgaacaactaggcccacagctgtcagatttcttgcaaggtttttcgaggagtgagaggatgagtctaggaatctcactcttccaggatcctcaccagggggttcaataaagatcacttcaatgtgctgagcacttactgtgtgccgaaggttgttctaaatgcttcatgtgttttatatcattgaatccttacaatgaccctttgaggctgaaaatgtagtcacttcaataaacaggtttaacgatttccccaaggttatccagttagtaagtggttgaatcataatgtaactactactttctgggccaatcaaaaagaaatggttgtcaatccaaaagaagtgttgtatgtaagaatttggttcttagttaataggagaatactcatatccttttacttagcgaaaaatatttagattttgaagtaatatcctgaaattgtgtagtcaactgatagagatgattgcttctccatgtagcttactctcaactggcataaacacagattgattattaatcttttactttttaaaaattgattctggaagcatctatatgaactgttaattattctagggattatgtggcaaaactggaatggatgtgtgaatagtattcatgtgttactaacgtataaagacagaaatatagtcatatattattaaccttcacaaagcattagtcaatatgtgtatcacaccacctcatcaatcagcctgcacagggactgtctgacaccagacagattaaaggggaggtacttaactattatcttcaccccatgctgagaggtggccacacttgtcctcactgagtagaaattgtcttagcaagatttacacctgcaaagtctgtaccatgtgtcaactagttaattctctgttttttacttctaacatgcttcagaggagcccccaccaattacacagctactcatggtgatgatctatgtacttggtggcagggtcagcttcttcttccagataaatcagttgtccagatgttatccacatggcagtcagagtggccatggcttctaagattctgcctattttcctctgcagtctcgatggctctcagattttgcgatcaaatgtataaagctagtgtcattgtttcagtgcccacataaaactgtagatggagtgaaaaatactgggtttttaatttacaagaaaatacaaccccataaaaaagtgggcaaaggacatgaacagatatttttttaaagaagacatacatgcaggcaacaagaaaaaaaagctaaaagtcagtgatctttagagcaatgcaaatgaaaaccacaatgagataccatctcacaccagtcagaatagctattattaaaaagtcagaaaaataacaaatgctggtaaggttgtggaaaaaagggaacatttataccctcttggtgggagtgtaaattagttcaaccattgtgaaaaacaggtggcgattcctcaaagggctaaaaacagaactaccgttctacccagcaatcccattactgggtatatgcccaaaggaatataaatagttctactataaagacatatatatgtatgcaaatgttgactgcagcactgttcacaatagcaaagacatggaatcaacctaaatgcccatcaatggcagattggataaagaaaatgtggtccatatataccatggtagaccatgcagccataaagaagaacaagatcatgtcttttgatggaacatggatggatctgcaggccattatctttagcaaagtaatgcaggaacagaaaaccaaataccacacgttcttacttatgagtgggagctaaatgatgagacctcatggacacagaagggaacaacagactctgggccctacttgacggtgagaggagggagaggatcagaaaaaataactactgggtattaggcctatgcctgggtgacaagataatctgtacaacaaacccccatgacgcaaatttacctatataacaaacttacacaggtacccctcagcctaaaataaaggtttaaattaaaaagatacgggccgggtgtggtggctcacgcctgtaatcccagcactttgggaggccgaggcgggcagatcacgaggtcaggagatcgagaccatcctggctaacacagtgaaaccacgtctctactaaaaatacaaaaaattagccaggcgtggtggcgggtgcttgtagtcccagctactcgggaggctgaggcaggagaacggcatgaacccgggaggtggagcttgcagtgagccgagatcatgccactgcactccagcttgggtgacagagtgagactctgtctccaaaacaaaacaaaacaaaaaaagatactgggtttttgttacttattcaacacctttattgaggaggaggaggaattgccatgtattagcaattgtgtgtcaaacgctgttctaagcctttatatagtttctcatttaatcatcagaatcctatgggtcagataggatgatcctcctttcacaagtggcaaatctgttacagagaacttcttccaaatagtataatatatgagaaagtcggaaatatgaactcaggtcagtccgcctccaaaggaccaccttcctgttcactatacttggtacttacctgctggtttcagaaaacacattatgtgttagggatacaaagataaaagtgaggttgtacctgctattgcttaagaggtatgatagtctgttcttgcactactataaagaaatacctgagactgagtaatttgtaagaaaacagatttaattggctcatgtttctgcaggctatacagaaaggacagtgctagcatctgcttctggggaggcctcaggaagcttccagtcatagcagaaggaaaaggggagcaggcatctcacatggcaggagcaagaggctggatattcacacgctttaaacaaccagatcttgcaagaactcactcactattgtgaggatggcaccaagccctaagggatcctcccccatgacccaaacacctcccactaggccccacctccaacattgggaattacatttcaacatgaggtttagagaggacacctttccaaactatatcaagaaggtaatgagtatttcaacttagatccaaatttatgagtgatgcagctgcctcagaaagaaacccatgaaataaagcaactggaaaaagttaagttgaagaggaactccatatgggacttccaattcaactgctttagttctatttccgcttacttgctgtgtcatattgggaagtatgctttatttctgtttggttcagtttcaccaattttaaattgtcctaatgtttccaatttacccagtgaataagccgttccctaaggctctttggaagatttacatatacttaagctagaaggatcctgtttgaacacatagacaaatgttacctctctgccatgtaatatttttgcctctaaaattctgctaagcttaaatctgtgtcccttattcatccaaaaataccttgttaagtattggttaacacttttagatgctctttgatgcagggttttacagaaatacaaaaggcttacaaaagtccatggaaatctaatacagcaccacaatactgcttttcaacagaagaacaggagctgttcattagcccccactcccctacccaccctgtttctctttcatatccggcaggagctgaattggccacaccatatgcttttttagcaaatgatgagtttttttaccaagccttagggaggattatttggaataaaggaaaaatcaatcgtaatgtttctccccaggactgaaagacactgaagtctgtactatcaatcacaaggtataaaaaacatgtgtctaggctggtttgcactgtatgcagataggaccccaaagctaaacgtccttggggacctagggcttgctcagacttgttaccatcaagcactgtttcctgagtaaccagatgcaattttctctctgcagagctgtgcagtgtgtagtgtgtactcttggctcacgactggcctcttatcctgtggtagcctaagggaacgactatccatttctactttggctgttatttttgttttgctcatcagaatgagccttccatgaatctcctttgttctttctatatagtttgatatttggaacaattcttccatttcagacgctcatatccttcctggagctttagtttcttaccctgaaacagaataatgttccaggtgaatgaactatttggaagacattaagttaaaggcattgtgaaaatataatgaaaaaaatggttataaaactctttgatttgtccttaacttgaagataaaattcaacaaacattatcagcagtctactgagagtaaggaagagctatacactgagagatgccaggaagaagtagttattgtttttgttatcacagatctcacaatccactaggaatgctgtgggcaaatacagtgcaagatgaaatgtgctaagtccgtaggagagaggcagagtgttaccagggctcgaaggatggcccttagctttgttgcaggcacagtgcaaggtgccacatctcccatttggtcctcacaacaactccctaagttgtgtatttgaggaaaacgagacttagagttgttaagaaatttgttctagaggtaataaaaagtgcaagaataaattatattcctctgggaagcagcaggagaaagtatggtttcatagagatgaaaacgtctcttaagcagcagagtttggtttttactcttttttgggaggctcataatagtatattctcaagcgaatgttgagacatctaagacattaagctgggcagtgaatggaacaggtatatcttttcttcccccaagagttaatgtttgtagttagggtaatataagatatttcggaggaagcattctaagaaacactaaaaagttatattgtccatagtcttatgaccagtggttgggggaaggtgtaacacatgatcatgtaaataacaaatggtaccgcataaaagaaagtaggtctctgcctcctatacccaaatataaaacatcccctctgtgaaagttcattatacaaattgggtcattcttgtcatccccaactgaatcaaactcaagaggccacaggtaaaatcactctgtgtacattacacctgctccaagaattaaatgttccacaagcccagctgctgaaatggcctgctgtaactctaagaccagttttacctagaagctgcttaaacaacctgctgtgactctaagattgcttttatctaccaccatcactcccagtcagagcttgacagctaccagaagctcctctagggccaatgagctttcttttaaacaatatgtaatatttgtctttctcgtaagactcttaaccttctctttgttctttggacatgtcacaaaccacccattctctgtgtatgccccaaattgcaattcttactttccaaataaaatactttaaatttagacattcatctctatattttgtctgacttcaacacctccatattcaggaagcattttttaaatataaatatattaccaattatgtgactagaccatagaacagcacatataattaagacaccttctcccgatcctccagttccctcattcttatcccttttttccttcctgataatttcttccacttttctccatcccagttcttaataaatccctttcatctctcttcttcttctgtaaaagtgggcaaaagagagagagcagtgaaaaggcagggaatgattgctccgttattgagatgtaaaaggattcattggttggatgttgtgcttcagagcgtaggctttatttccacatctggctatacacatgtgtatgcatgcataggacctaatctgactaatgtgcattatgtccccatcctttgcaatcagaatatcaatgagcatggtggttttcaaaattaattgattttgctattaatagttcaaacctaaaatttctgggatctgtgaaaagaggtagttattacttggaggcagaagaactattgcttctgaaataggaagcaaaatgaagagagctttccaaatgtgtttcttagataaggcccatccttatgtagaaacatagcaaaagaacttaaaactagattatagatggtttggaagatgggaaagaacaagtaaatacatgaattgctagtagtggcagaagccaagtactgttgggaaaagagtagtagctttggaaaaagggactcaggaaaagagtgatcaaaaatagttactatgaaattttagtttggcgtaatgacttagttcaagaagaaaggacatctctattccaagaaagttcaaatcaaatgttaataagctggtatgtactttagcatgtgaagatcacccctctgttccaaaaaccggtaggcttcataaataaataatttatttcttaaacatgtatttagtgcctacagtgtacaaagcactggggtaaggaaagattagtttgtacaggtttgcaaataattcaaggcaataaataaaatgtagggacagtagtacagagaaattatgaagactgggggtagaattagctggcattaaagctccagcttggaactggagtattatggtgtctgacactcaactgtgatcccagtgttaggcttgatagcagcatatcccttaggcatttaaggagaggaaagaagttagatggaggggctcctgtcactgtccccactgactttgtaggcctcgtgaatccttaatatcacagacctaatgagcattcctatttttatttttttttaagtatttagttttgtccaggcaacaacatcaaaggatttcagagttgtcttaagacctggtaacatattgctatagaagttaggaaggtactattaatagttttctaaataggaaaactgaagattaaaaattaaatattttggggctgggcaaggttcctcacgcctgtaatcccagcactttgggaagctgaggtgagaaaatcatttgaccccaagagtttgagaccagcgtaggcaacatagcgagaccctttctgtacaaaagaattaaaaaattagccaggcgtggtggtgctcacctgtaatcccagctacttgggagatgaggtgggaggattgctgtcttagaaagaaagaaaaagagagagaaagaaaagaaggaagggaggaagggagaaaagagatggaaggagggaaggaatgaaggaaggagagaaaggagggaagcggggagggagagaagaaggaagaggaaaggaaagaacttattttatcccaagttagagtagaaaactgtgtggtgtctttcacctctgtacaaataggaagaggatttggaaatcattattataccaaaatttgatcttctaaaatgttttcaatgagaaaatctcatgggatcattcttcactgtctttttctatcttctagaaagtttgaattcacagtgttaacctttcctttcgtgccgagataaccatctttcccttttcaatttctcacttgcctgacagctgataccagtctaagctaatattgtaacaattttagataatattgcagatgcacaaggacatcctcatatgaatcaattaaagaagtcacagtgagttgccattgaaagtgtggcagctgcatccttgaaagcagatgctcttctgggtctgaatgagtccaattttaactaattttaagacctaaacagatttcagtctggttaatattaggatgtggaaccacttgagacatcctaatgtcctagtctgattacttctccatgacagtttgtatgttgactttccttgagagatgctgggtacttaatgccaggcatttttatgtcaatcgtaaagagagaccccaagtcatggctgcagcaaagtgcactgacaactcgtgaaattgaagtggcttctaacagcagcatgatttatagggaaagaacttggggtatagggattcaccagaattgctttaaactatatttctgttagattcctgaatccccagaaacaggctataatgaactacttccccatccctactctctctctagattatactcagaaaactaaggagaaagttagagttgtaaatggcaagttgctccttcttttttctgatttttctttaacaatctgttattatgttctttgtcatattgcattggtcagtttaattaaaaaggcattgattgagcttctgtaatgcctctagttattctgctggccttgaatgggggaaaatatatataatacataattctttcactgaagtaattaatgatctggaagggagacatagttaatggaatataccttctattctagaattgagaggggtaggggaacatccagaagagccattgacccttcctggggaatcagaaaagactttctgagccagagaaggcatgaatagttttgaaagaggagtaagagccatcaaaggtgtagaatcatgagacagcatgatatgtttaggaaatttgctttagacaggtggtaaatcaaacggcccagggttggagaggggatacgctgaagagaaaaaagaaagtggtaagagatggagaaaatctggagggttggacagaaataaaaaatcttggaaagctttgctaaggagcttagacttgatcatataagccttgggaaacactgatgttatttatacaagaaattaacatagtcaaatttgtgttttgggtaaataacttatctgactcatatttaattagataaaagggggccaggtaagaagcagagacaccagtcaggtaactattgcagtagtccatggaagagatggggtccaaaccaagaaagtggcagtagataacagaaaagaaaaaataaatattaagaaaatatttgtaaataaaattggtacaaatttttctttgctagagagagtcaaaaattacactcacgtttgcagctgggattcccagattgatgtatcacctataaaaagagaattcaggatagagaacagatgctaaagaaagataatgagtttagttttgaacacattgcatttgagatgcctatgggatatacaggtagcagtatcttgcaaatcattaatcaaataaggtttaggagccatcatttcatggataatagtgtaaacaatgaaaagggatgagctcactcagaacatattggcaagtaaggaataccactagaggaaaaagtccccagaaacaccggcattatggatggactaaaggaaggggattcagtgaaggaaactatggaagaaatgccagagagagaaaacaacacccagaagagtatgccatataagccaaaagaagatgatttcaagaagtaaagggccagtgaattcagagatagcagagagcctgcatgagatgaggactgaagagcagccagtagatttggcaattacagtatcattgatggctattaccagaaaagttttgaataaaaaggtgagggcagagtcagattgtggcacactgaagagttaataggaggtgggactggagaaagtcagtgttgagattcttttgaagtgtttgttgaggactaacagggagcaggtaggacaaagggcctgaggagaacagcgcgaatttggaaaaattgctgagaaagggaaggaggtagccaagcaccagggaaaggattgacaagtggtaccgcaagcttcttttgaaattaaaatccagaacgttttagtggcaacaatctatacatttttgtctttttaaattaatatattatagctgtacgtattttgggggtacatgtgatattttgataaatgtatacaatgtataatgatcaaatcagggtaactgggatatccatcacctcaaacatttatcttttctttatgttgagaacatcacaattctcttccatctattgtgaagtatacaataaattattgttaagtataattaccgtgtggtactgtcaaatactagaacttatttcttctaagtgtatttttgtgcccattaactaactttcccctcccccccccacccctttttatttctcagcctctagtaatcaccattcagcctccatgaaattccctgttcaggtcccacatttgagtgagaatgtgtgatatttgtctttctgtgctagcttatttcacttaatatgatgaccttcagttccatccatgttgctcgaatgacaggattttattctttttgtttgtttttgagatgcagtctcactctgtagcccaggctggagtgcagtggcgcaatctcggctcactgcaacctcctcctcctgggtcccggttcaagcaattctcctgccttagcctcctgagtagctaggattacaggcacgtgccaccatgcccagctaatttttgtatttttagtagagacagggtttcagcatgttggccgggctggtcttgaactcctgacctcgtgatccacccacctcggcctcctgaagcgctgggattacaggcatgagccactgtgccccaccaggattttattctttttatgggtgaataatattccattgtgtatatctaccacattttcttccaccattcatgaattggtggatatttaggctggttccctattttggctatggtgaatagtgctgcaacaaacatgggagtgcagatgtctctttgatatactgatttcctctctcttggatatacccagcagtgagattgctggctcatatagtagtactatttttagtttttgaggaaactgcatgctgttttccataatggttatactaatttacattcccaccaacaatgtatgagcattcttccttctccacatcctcaccagcatttgtcttttttataatagtcattctcactggtgtgagatgatgcccccttgtggtttttatttgcagttccctaatgattagtgatgttaagcatttttttcatatacctgttggccatttgtatgtcttcttttgagaaatgtctattcaggtcttttgcctatttttatagtcagattatttgttgttttttttgttttcgttttttgttttttgtttttgctattgagttgtttgagtcccttacatattctggttattcatcccttgccaggtatatactttgaaaataatttgtttcattatatatgttgtctcttcactttgttgattgtttcctttgctttgtagaagcttttttggcttggcgtaatcccatttgtttatttttgcttttgttgcctgtgcttttgaggtcttacccaaaaatctttgcccatatcaatgtcctgtagcatttccccaatgcttttttctagtaatttcatagtttttaggtcttatgtttaaatctttaatccattttcagttgacttttttaataagttaaaaaatgagcatctagtttcattctttggcatacagatagccagtttttccagtaccatttattaaagaaactgccctttccccaatgtgtgttcttggtgcctttgtcaaaatgaattggctgttaagtgtgtgagtttatttctgggttctctattctgttccattggtctatgtgtctgttttttatgccaataccatgctgtttgggttaccatagctttgtagtacaatttgaaatcaaagtagtgtgatgccttcagctttcttgtttttgctcaggattgctttaactattctgggtcgtttgtgattccatttgaattttaggattcttttttctatttctgtgaagaatgtcattggtattttgatagggattgcattgaatctgtaggttgcttttggtactatagacatttcaataatattaattattatttcaatccaggagtgtgcatatctttccattttgtgtgtgtgtcttcaatttctttcatcagtgttttataattttccttgtagatgtcttttactttgattaaatttattcgtaggtttttcttattgtaaattggattttttttcttgatttctttggtggattgattgctgttcgcatctagaaatgctactggatttttgttttgtttgtttgtttttttgatacagggtctgacgctgttgcctaggctggaatgcagtgatgcaatctcagctcactgcaacttctgcctcccaggctcaagtgatcctcccgcctcagcctcctgagtagctgagattataggcacccgccaccaagcccggataatttttgtacttttattaaagacagggtttcactatgttggccaggttggtctctaacgcctggtctcaagtgatttgcccgcctcaggctcccaaagtgctgggattacaggcatgggccaccgcacctggcctgatttttgtatgtggattttgtatcctgcaactgtactaaattcatttaccagtcctaagagttttggggtggagtctttaggattttctaaatataagatcatgtcatctgcaaacaaggataatttgatttcttcctttctatcttggatgccgtttctttctttatcttacctaattgctctggctaggattccagtactatgttgaataaaagtggtgaaagtgggcatccttatcttattccagaacttagtgtaaggctttcaatttttccccattcagtatattagctgtgggcctgtcatagatggcctttatcatgatgagttatgttccttctatacccagtttcttgagagttttgatcatgaagggatattgaattttatcaagaactttttctggcatctgttgaaatgatcatatgatttttgtcctttattctgttgatgtgatgtatcgcatttattgatttgcatatgttgaaccatcttttcatccctgggatgaatcccacttgatcacagtgaatgatatttttaatgtgttgtcaaattctatttgctagcactttgtcaaggatttttgcatttatattcatcagggatattggcctgtagttttcttttttattgtttcactttgtctagttttggtatcagcgaacaatatgttcttttgttttcctgtcaaatgatgagttgtagaattgactcaatgttacatgagttttaggacaattatagtgaaagaaaagtattcaagggagttgaggtttatggtcaaagagtagctcagggaatcaaccatgcaatccatgctgaggatcctaagagggactttttctaccaggagaaaatgaagggattacagcattaaagttataatggaaatgagggtgggagagagttgaaagaagaaaagtttttgatctgagaatatgatactagaatttaaaatttcagaggttgaaaacaggatttaacttggcagcaagttattaatatatatttttaatttgcagtgatttaaagaggtgtttgtttttctaatatagcaaaaagtctgaagtcaagcagttgcttcttttggccaatggtccaacaatacttagtccagcacctctctgattcttggtcttttcctcttaataggaagatgatgcaacttcagatacctcaatcaaatcagaaaagcagggaaagtgggagcaagtggtggccacagcctcaattctccttttatcaggaaaaacaaaagacttcccaaaagccacaaaagactctacttagggggtcagtggacagactatgacacacgaccacctctagcaacaaatagggctgagaatacaaatatttagccttccagaatctgtaatggagtgagcaagggagagaatggaactggaagtaactgttggttcgccaaaaaggcagtgtctgctccaaagaccaatgttcagcttcctttcgtggaacaatgtttatgtagtacagaaagccacaatcatcctgccacaaacagctaactaggtgacttaaagatgcatgctttatgatgttcccctccctgtgcccatgtgttctcactgttcaactcccacttatgagtgagaacatgcagtgtttggttttatgttgctgtgttagtttgctgaggatgatggtttccagcttcatcgatgtccctgcaaaggacatgaactcattcttttttatggctgcatagtattccgtggcatatatgcaccatgcctatcggggggaggagggcaaggggagggagagcattaagacaagtacctaatgcgtgcgaggcttaaaatctagatgatgggctgataggtgcagcaaaccacaatggcgcctgaataactgtgaaacaaacctgcacgttcagcacatgtatcccagaacttaaagtaagctaaaataaaaataaaagatggcatgctttatgcagtggtcacaggaggaacagacatactaggaatgatctgatgtcatccatccctagtattaggaaaacagctcaaagtgcatgtcttcataaagcgatcaagcacttacatatttaaagcccaatacgcgtgggctcttctgatatgaagggtaatactatagataaatatacaacaatgtagcctttaaagggtatgtacaaggttttgtgtgtgtgtgtgtgtgtgtgtgtgtgtgtttctagtaatctcataccttaactgtaacctcccaagcagattgtgttagcattgcttttttatagattttcatttgacattgaagagctagttaattgcttttgtggtgtcttagattgccatgcttagtatttctttgctcagtatattctttcttgttaagaaaactttgtaagtttcagtaagccctgaggagttcacaagccaactttctagtagagctctgggcataatttttcatgttgctttaataaaatgttatctttttgccatagattatggtcaagtgaaatgtacagtgtgctgttacctgaaactactttttacctcactcattctaagttttacctcagcagctaatcttgccatagacttactcaacttagatatttttttaatttgtaatttgacagtggtcaattgccacatgataaaataatgtatttacaaaataagaaatgcaaattttttaagtttcttggcgggatttgtccagaatgcctttgatggaatttggtctattagtatagctttggacctcagattaggagtgagacttcaaagtccaatttctgcctcttctcattgatacgtagataactctccatgctacagtcactatcacccaatagaggaactgaagggctgaaaagccctaaaatgttttgaaatatcatagttgtatagttgctttccctctagcctgttccatgaaaatattgcaaaagcagtgatcttgtcttggcgatcaaacaacatgattaatgctaacgttagagaggagatgcaatgtcatgcatctaggctccagcagatcaagttagtaaacatctaggatgataccaaggctggcaataatttaaaatctacattgctacattcccttcctcctcacccatcagttcccttgaactacattctttttttttatgtttgccatgttattttaatttattagagtctggttccacagaggagaacttagccttacatgttagaagcctggattgtctatccaggcccttttctggacttagcaaagtttaagaatggatatagtgctgaaaggtcataagtgtagacactacacactacagcaagatgttggctctctaccctataaggtgaatgaccttctgagttagtgatgcctcaccaattcccatgttccctaagtccagagagcctctttcttccaaaggactctttgaaaaagagaaggatgttcatacagaaaagcaaaacatatcagaaattgaataaagattgatggaattattttgtaagtatatggttgctacagcaaccattaagcttaagacctaacctggacaaatcacttgctaaagaataataataattgcttatgtttcttgcttatattaagttttatatgttgttattctaagtgttttgcctacattaattcatttaaccccatgatatagatactattaccctcactttacaaaataaaataataaggcagagaaaatttaaataattagctcttggtcacataaagtaaatgttggagccaggacttaaagccaaactttgaggctctagagagctaagaaaacttttgaatgagatcaccaaattattgttggttgggaatctttgagaaattgtgaggacatggggatacaatagaagtttagagataaacagatgtagttttttgtttttgttcagcttttttttgaagaaaatgtctaagtggtgctaaatattttaataaatcgttttggaaatatatagaaggtagctttatcaaattttccaaaaagaccttcttagggcttttagttggccataagctatatatgagttgaagtggaatacagcacactaccacttccacctcccagaatttagggaggtgtaaagcgtcatggcatctagaaaaagggaattgatcattctctctagactggtcagccccttctgtagtatttattctgttttgtcctgagttctacatttcaagggaaatagagaaaaattggaatgttttggtaggtaaattttgagaattataatttaattcaatcattagaagaatgggtgaagaactgtggacattccgcatagaaaagggaagacttcaaggaagccaaaataggtatcttcaatacttgtagtactgactcatgtgtgaaggattacaaagttaggtaaaattagagccaatgattagaagttaatgaaggcagatgttggcttgatgtaagatggtcaaatctttcggagatggaacaggctgccttgaaaggtattgagtttcctttcgccagcatttgtgtaagtgtgcagccagaatgtggacagccacttgaaggtgcacagaagatggaggcacagaccagatggttgggccacatgacagtgaaggcctcttccaactctgaggttctgtttctgtaggttggtgcaaaagtaattatggtttttgacattgaaagtaatacttttgcaccaacctaaatattattatatgaattgattcaagataagccactgcacttctatgtgtaatcaaatatagaaattgtctatcatgtcttggacttctaatgctgccaacactagtgttaaccaagctagtaaaaacaagatgaacagcaaaataatatgtcatttcagaaaaatctgtaggcatctaatgaaatgattggtgttttatccttacctttcagtgctttctcctgctcaagacagccacacgaacacggatctccccccagtgtcagagcagatcatgcagactctcagtgaacttgccaaatcgttccaggatatggctgaccgctgcttgcttgtcttacatctggaagtgaggtatgatacagccaagcccaggaccttgcaatttgaatgcactgcggttcataaatcacttgcttatttccaggcagtatcaccataatttctggctcatattattgatgttatccctttttacactgaaagtgatttttagctgtattcagtgattatttgagcgcacagtgtattgtgagtgtggtgattcagagctggcatgatctatgaaatcaggtcacctagattggaatgtcactatcaactggctaggtgatcttaggtcagttaattaactttacaaaccacagtttccttattttaaaaatggaaatgatagtttctaacttatagagattttataaatgaaataataattagcacaatgtcagccacaaagtaagtgctcaaaatatggtagctttgctattgtggtgactttattgtgattgatatttttactaaagtgctctgctagtcaagaagggagtcacatttgaaaaagtagagggaaacaggtaaaagaattatactaatatattttagttaacccagtatatccaaaacagcatttcaataggcaatcaatggaagtgattgaggtattcagcattttcttttgcactaagcttttgaaatctgcacattttgtacttacagcacatcacaatttggactggccacattttaagtgcttggtagctacatgtgcccagtactagcatagtgggcagttgccaagagtggctggggctgactaggaatgggattcttttctttaagataaaatggtcagaagaaatgtgacaaagtaacaagaatgatcagtctgtacaaagacctagaggaagagagtttcagacagaaggaggcacactcacaaaggtcctgagacaaaatcaagcttggcggttttaagagcagagaggaggctgatatgcttgtaggctgatgaacaagctgggtggggaggactgaaagaataaggcacaggagacaggctggagcccaatcctgtggagtcatgaagcctgacacattacagggtcttacagaccaagtgaatcattcagatgtcatagaagccatggaagagttttaagaaagggagagatatcaattaattaacattttttaaaggtcactctggctgttgtatggaaaagggattgcagggaaaaatacaaatggaagcagggtgaccagttgaaaacaactctgagcatcaaggtgatagaggtagagatatgagaagcataggatttgggacatatgctgaaggtagagctaatgaagtttgttgacagattgtattggacacaggggctggtgcaataagaggaaagactcaaggaaaaccactagtttggggccagagcaactgtgtgccattaactgaggggagaaacactgagggaggagaagggtggaaatcaagtatgccattgagagatgttcagtttgggatgcttattaaacaactaggtagcaatgtcaaaacatcaggatcagaaagtgcatggtgtggtaatacattctattctgtattgctttggaacatgattaacattgatagaatatttttcttttcatttgaagtctttactagatttagattttaaaaatgtaaataggactttgtttgataggtgacccttgggaatatgtttggactccagttagaacttggatttctttccagggtgactccttgtgtgtgctacttgctttttatccttcattaccattgcccagtgagttacttccttattgcttgtgagagccttgtgagtggaacaagagaagtaacattgcagatttagaatctgtgttacgtggcattattcctgatgttatttctcacattaagctgtccagaaataaagctctttctgtatattttctgatttgttttacaataattttcatatttggtatctctttatttacaagcggacagagaaatcaggtgttttctatgaacaaatatttgcaatagatggaaggaaatgaaaaataccaagtaatattctaatgccgctgttacctgagttacaaaggaaaacaagggaataccaaattagttactatcacaattcctggaatttatactattgatcgtgtgcttatacatattctacattcagaattgtttacttatgtgtagttaattccaagtgggatatttgcaacacatttgaataagatcttttaaatccttaacccctattctgcccttttgatacatcttggcaatactcttcttaatactgaacatgctttagtcattaatttacaagaaactatacagtgctatagcactggttgccatatcttcttcaacattagtctaaaaacagaaaaatgtcatttttaagaatgaatatcaaaaaagactgaattttagagccctggatgtagaattatctttccttgaatttaactcagaacacgaagcatgggatttttttaaattaaatttcctcacttcctcatgtaacatggttccaacactcaggttgctttctaatgagtatgctccattttgtctttgttccttttaaagtaaggtagatacaactagcagaatacaccacataaggctcggatagtgaatgtagatgcacttactctatcctggtcacgttaacaattttttttcagtttgcacagtgatgatacaaaatgaaaaagacagatttcatgccactctagtataataacgctagaatagaggtgtctgctaagtgctctgggggcgtgactgtggtagagaccatcgagcagctcttccaggtgtggcttgttcattgtgatggctggccctgaaacctaatatcctgctgtatataaggtgctcagtaaaaatgtgattaagaattagttggtttgaaaccaaacccagataaagtaagggctactttacaaaacaaaacctgttgtctttaaagaaaatgaattggtttgcagtttctgtttttacatagcagtccacttgtaagtccactgcattatcttaagaggtacagaggctgtgtggccaatatcattctcatcaactaatgtttgttttgttcccatcctgctgtaaaaaaagaattagaacgtaggcccggttgtccaggagctggtgtggtgaaaaagtggctggttagctcctgtctctggcacttttagccaagaaaccactgtaatagtacagatagaagaaaacaattcatggaaaaaagtaatgggatatgctagcaaaaagtccagaacaacttcagatgccaaaaattggtcttgttcccccaaatatctttatatccatagcccatatttttctttgacattgttaaaattcaaaccaaaaactgttttccaatccagcgcagtctgtgttgaaggatccatctaaggagtgtttgacattttacctgtgtcattgtaggtcacattttaaccaccaagcagcccctttccacagtttgaagcataaagcaaatgatacccccaagagatgaaagacatggtgagcccattaaaaactattgaggtttgttttttctatttgaactttagaagaagaaaattaagttgccatttgagtccaagatgccaagaatgtcacctttatcagctgatttttctcaccatcaggagggctctaagtaggttcaacagcaactgcctatcactgttgggatcctaagtgtgcactctctgaaaatcatccaccccactgtgtaatcagcagtgtttgcagaatacgttaatgtcaaagtcatagtaaggtcagcaacaacaggccagaatttaaatttaaaaaaatactttatttgaatttggcattcgctgatgactattttaatttcttttttttttttaatctctaatcacttgggaagaagataataccttaaagaaaggttatatgtcttctcccccagtagcttgaaggtctcataagctctcacctccagttcataagaatttcctaactagtcactctacttccagttgcttccattctctgctattaatccacttgtatactgtgccagagtgatcttgccaaagctcaggtctgattatattattcacttaaaatccccctaaggatccctatggcttctaggataaaggcttgattccctacatggccttcagagcctgtgctgacctggcctgtgcccatctccccaagctcgtggagtgcctgtaatgtgggatctgtgtgcagcagaaaagaactgctcaccagtcctcagaacatcctgcatttatagtctcatgctattttacatggtcttctcattgcctggagtcataatgtctgtcatttactttaaaaatactttagcatagatgctttaattttattttcaacaaagtgctacttcatttaaatttcaaccacagtagcaatcagtgtgctagtcatgaatcccattccagagttggtcaactttcattctgtcagaaagctcacattccagaggaggctacaaccagtgccattactggtattcttatcaaaattatacatttgtgccaattagtacttgaatatcagaatgagtttttattggtgaaattagtcattagttaattagcaactgttaagatgagcatctatcagtaaaaatgagcagtagtcaagatacttggattctcttggatgaactgcttataagaatatgacacatcccatataaaacttagcttaaaatggatcattcaactaaatgtaaaatctaaaactctaaaacttctagaagaaaacataggaaaaaatttttatgatcttttttaggcaaagacttctgaaatgtgacactaaaaataccatccaaaaataaaaaagttataaattgaacttcatcaaaattaaaaccatttttgatagacattgtcaaggttaaaatacaagccaaagaccaggagaaaatatctgcaaagtccatatctgataaaggacttgtatccagaatatataatgaactctcaaaacttaataataagaaaacaaaaaacccaatttttaaaactgggcaaatgatttgaacagatatttcatcaaagatatacacgcagaaaataagcacatgagaatatgctcaacatcattagtcattaggaaaatgcaaattaaaaccacagtgagatactgctctacatctattaggatgaccaaaaatttttatttaaaactgacaacaccaagtactgatgaggatgtggaacaactggaacttttgtatactgccagtaagtaagcaaaatggtacagctcctttggaaagcaattggtaatttcttacaaaagtaaacatacacttaccataagtgagatctagcaatctcacttccaggtatttatccaagagaaataaatgcaaagttatatgcacacaaaaatgtgtacatgaagtagctttatccacaaccacctaaacctggaaagaatctaaatatcaatgggcgaatagataatctgtgggacatccaattcagtggaaggctacccagcaataaaaagtaatgaacaacatgggtgaatatcaaatgctttgtgctaagtgaaaaagccaaactcaaaaggctacatactgtatgattccatttatatggcatcctggaaaagacaactgtaggggcagaaaaatagatgagtggttgccaaaggtttgggagttgagtagggattgactgcagagggacacagggaattttggaggagatgtttgtgttctgtaatttggttctggtggtggttatatgattgtacatgtttgttaaaactaatagaactgtacactaaaaggggggagttatactgtttgtaaattatttctcaataaacctgactaaagaaagatgacaggcaaagcgtggtcgcatcattagagataataatgcccaaggcttttgcagccattcatttgggaatatttcttattacttgatgccaactgtaaaggtaacagaacatagaccctggattatgtcatcatttcttacctccggtgaaccttccatgcaaggtcagacagagcacctaaaacaacagagttaggactagactgggcttatggaacagcctgtttgaactctgcctgccaagggatactattggtttgggatttttttttttttctgctacggtgggggattcaaaacaaatacctgcatgtagggcagaatttggactgaaacactttgattacaactttaaaaggctgtggcagtgcagccaatccatacccacctcagacttcctcagcagctactaatatctgccaaaaagcacctgagaattgtgtgtgaccagactgacacaggccattttcacacagaaatgccctccttcctcaagctgtcagatatgttctgtgagactcaagcatcaccttctgtcaggaccctttcctgataccccgtggcacatttccatggcacgtggatggatgtgcttagagtgagatgctgttctcttttagtcatttttttcttaatctaccccactaggttatgggtctttagggatacaaactgtcttatatttccagggcctagcacaatttcttacaaattcatagaggttccatacatgatttagttaactaataaattattgttaataaatataagactagtgatgacagccagtacttactatgcacgccatttgtgccagacactgctatacttaacactttacatgtagtagttactcacagcaccttatgagacaggtgttgttttcacccatatttcgtggataaggaactgagggatagagagataaagtaacttgcctaaagtcatacagctggtgattgaagccaaagtagtctccttacacttttaagatctataaactcggcctctcatcttcattgcaacaatatctgttgaaaattacaatgcttttcacagtatgcctacaaccctggcattgaagagaattttagaactccttcccaacactgtatagattaaacaagcaatgatcatagcagccagcttgccccagatcactcagttgttctatagaataactaagatggctttctggttaaaagaggggagggtgtttacattaaaatgtacaaggccacagctgcttcatattaagtgtagagcatagtgtctggcacaaatagggtacacagtaagtgttggctatcatggctagtcttacatttattaatgataatttattagttattttggtgctctgtcccaagatcattgccctccctggaaggatttattattaactgctctccctatctctctctttttcagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggtcagaccctgcttctgtctctgggagtttgggaggaagaaaggatgaaagttttcctgattttctgtattactgaagttcaagacttgtagaaaagagttgtttgcttgcttgcttgtttgaactaaatctgcaatacctagcctctttgtgtatgactaggtagacaacaatatggccgccatctgctccgggttgataaggagatttaatccaagataaggcagatggctgcctccctgacatgccattcatgagatttgagagaatgtgcagactgggccacaaattaactcaagaggagcttataaaagaaaaagaaaacacacatacacaatgaggagagaatcctgaaagatcactcattggctaaaattatcactggaacgggaagttttctcacagaatgttataatcatctggaaagaacagaagcctctgattagaggcaatttttaggaaggacgtgtccataaatgcctccaaggggcaggcaaggaagggtgtgagagacaggaagtgccatctaaagacattacccttcacaatttggaaaaaatgtgatggcacccaaataatttttcatggtgaatttcacccagaggatccctgttaggactccacattatgttccctttgtccatgttttggtttgtttgtatgaaaacttgtatctgtgttctctcacagaattaaactagtattatttaaaacaactaagaaggtacattgtccaaaggattgtggcaaactgacaatacatggccaatgtttgctttatgaaagttatattccagcaaatttgggccccccaaaatccaatccttaaatgtatatggagttataaagagatgtgttctgttggggtatatctctcaaagactttagccaaaaagtgtaagtgattgaagggttagctggcagttaaccccatggcactatgagtttggtggcatctgtaatattctgcagctttcagctgcagtgcctacctgagaattcacttttctgttattacaccgagtttcctctgtgctcttgactgtggctcttcccagcccctgcatatcaacatttgttttattcctattacaaaatgcatttaatatatttattataatatattattatttcttattctctacaaacagcataccccttcattgcccagtcttgcagaccacgttatattgtggcagcaaaaacaaacaaacaaacaaacaaacaaaaactgtacctaaagttacagacttgagagaatgacaccaaaacttggcctacagagatttttcatataaataagttgtctagttttaaatgtagaatctgcagttgtgtttttctttgaataaaaacttttcttcatattcaaatagtaacacatacaagtttgtggtcttgaagcaatgttgtttgagtgtagctgaagcaagacctgaatgcatctcctccctcatttctactttcaccttaatcaagggaaaactcattttgaagacatggggagccatggacctaaagataagccccgcactctgatctaaacctcagagtctcggggaagggactagacttcagaacaggaaaacaaccaatagcaaatggcttgcaactagtcagaccagtttacagttccaaggaaaatgtcctgctagcatccaagaataagaaagaaggaagaaacgtttactgaattccatttagaattaaaatccagcttttaaaaatagtaacccatatgtgcctcacgttgttctgaaccagtgtctctcaacttaattacatgggatatcctgaggaggacttattagtttgctgatgtcctgagctgccctttgctaaattttgcagaccataagacaaccctccagacctaagagcaaactacttgtgggggggccccaaaatgtccacaggtgtctcacgggaagtcaacagttaatgtatgatctgcttttccttcacccttttttctaattgtgtcttatacacccattgccattgttaaggtatattagcattattgccaataacccaatttcttattgatttattttttacttggcaatgttgaaatatattaacattattgccaatgcccagtgtcatattgattttatttatgtagcttcccaatcaacttttgagcccaaagtgtccttctctactttgtaggaggaaggagaggcaaaagggtcattgtatatgcctgtggtcttctctgcttcccaattgtgtataaagaaaagcgggatttcctgtgtacttcaacagtttataataacctggcctcttctctaaggccttggcatggtggcagtaggtgtacatggcaatgctggagatgtggctattaccaggctttgccaccaacatgaagtccactcatttgtaactactaggacaatgtagaaataccctaaaattattgtcagatcagcagatgcaaccatcagaggtagattttctttggtcgtttaaatgtatagaggattagaagacagcaattctgtgtgcaagtttctgcaggaatgcctctaatctgtcatccgttttctttgccccgcactgtgctgacccctcaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggtaggagggaaaactgggtttagtttcttatgccaaagctaagacctcgttgcctgtgaagtcatttttaaaaatagactcttggtgcagaaaaagcttagtttaaaaaaagaaagaagcacagatagatgtttttaggtcctatagagaaaataattccacagaattctattgaattttgttactttggcagatagtttttcctgatgtctaacccaagttcttcttaactacaatacttgaataactctttttttctgcatgtaaaagtatacatgctcattgcataaaatatataagataagatacaaagaagaatataaacctttgatctagaggctaagatatttggtatattttctcctggcttttttgcatgtgctgtgttgtttatgtgacttttcacacatattcaagcatgtgattgccctttttccaaaactggaactgtgttaatgcaattttatattaatttaattttgttttcccctatcaataacgttgtttgaaaacataatttttccacgttcgttaatactccttgaaaacgttacttttaatgatgcctgaataaatatttcatggtataaatgagccatatttattttttcatcacttgcaaatttttgaacatttgaatttttccctttttttctctcattgtgaataacatgtatctactgtatttttacaggaacctacttctcatttcttccatcttgttccaattgaaacccatctcttcttgttctcactgggaggaaagtgagaactcatcactatcctttctcttctctaagttttctgatcttaatttttttttaagtgacagggtattgctctgttacctaggctggagtgcagtggtgtgaacatggctcactatagccttgaattcctaggctcaagggatcctccgaggagctgggactaaaggcgaacaccaccatgcctggctaatttttatattttttttatagagacagggtctcactatgttgcctaggctggtcttgaactcctggcctcacgcaatcctccttcctcagcctccaaaagcactggaattataggcataagtcactgcacctggccttgatctcaatttttaatgtttttgtacaatacagtttttcaagatttgagagttaatttttttctctcttcatttgtcttaaccccatctaaaccttaattagaatatcaaacctttggtgctttaataaaagcttaagcaatttgaagatgatagatgataaatatgttatcttcatgctctattgccgtttatacctgagtggattattccgtaaactcccttattttccaaagcctttatggctaggaagtcctttgtttttaataatgcccaatgtttctgcctgagatttagtatttctgtggtcttttcacttgatttttttgattctttgagaagtgcaggaaaatttgaaacaatttatggagatgatgaaatattatattacttcaacaattgtaaagacaatatgctgtgatctttgttttgggtatgaaccatatatgttcatttttaacctttcttcctcaatctgttactccatttgttccattgctaccctgttcctctgcttttctgtccttctccttccctgtctctttctttctatttgtgggaaagtgagagagagagagaaagtgaatgagtgagtgtgtgtgttttcattaaattccctgttttaggctaaatttgatggaaagccttccttgctcagattagggaaaccaggtgtgactgaatgctgcatttatttggtcgctcttatggggaatgatctcattattgaattagtctagtcataataacattgacaaggagaagttaagaacatagaagcctgagggatacaaaaacccattactaatgctctaaggaatataattcctaaattcaatcatcctattttaaatgattttttttatttagctgaaataagtaaattaacacagtttttggcagacagtctggggcctgaaaaacctggcatctgaataatgcaatgctgactgggcaggattgaagttggcatcagcaggtcatgtgccgatgaagcatttcttcaggaactgagtcccaaccacgccttgcctttcacagtcggattggtgaattgtgtcccaggaagtaggtacaagtggcatgtgaccacttgggacatgtattgctactattattctttattctgacatggatttttgacaggaaataggctagcataaagatacagcactggatgaatctgttcttctgattctgctttagaagacatctccttactaagactaagctccaagaggccgagactcttttctcagtgcctctaccaaagtaagtgttaattgtatgtactgaatgaatgaaaagatatcaaatcaaggctaattttggtgtggatgaagaccttggatattgacaggtcagtttatgtttaattgcctgaaagtttaaagtagccggcatgggtcagttttcttataagcttgtaagaaaaagcgtatcttccttgcagttcgttctttgtaaaacagaaaccatattgtagccctactactcatagtctctttccctctcattttttcttgttttcatacagacacactttatagccttatttttcccccgcttcttgtttttggtagggacaggttttgtgaaaggggctccatcaattctaccatatttgaagctatgtaaaatacataaaacagcaataccaaaatagccagaaataatagactgcagcagtgtacctcagcattccttaagcaatgtttaatcaagcatggacagcatctgtatttccagcaaatctctataggaatgttatcttctaacacagtaattaatcactagttgccgtgtgtcagaaaacttatttaacaagaagttgcaaagtgcttgtagttttcttaccttctcagccttcctggccagtggaaaatataacacctttctgtaataaagaaatgaaggatctggagggattccattgatgttgattcttctactcatagtattgttatcttgtctctctcttttcatgcacaccttccctctaactaatctctaaatgagggtagatcttgggtgagcaaaggaaccagacaacttgtaacattaccagaagtacagagagcctctgtcctctatggtaatgatcatttaagctctcttacggttttaacccccctgttaattttcagagtcaaaaagatactttatccaggaaaatcagtgtagatgagttagaaggtggaagggctttatgagtgtgcttttttagttcctttcatcacagatcatcttaacttgagctgtcatgcacctttccacatgtgagtcacagaagccacctaggagtccagatggtggcagcataacaagagaggtctgaacgaacgatgattggagtccccaagatatatctgacaacctttctagcttgagtgacgccattgttcaaaaagaatatcccagagttttcttcccagttctcccctctttaccccattttgtttctttctctgcctcttcagctgtctcttttttctcctttatttctccaatagctctacttcctgctctcctccttcaaggtttcattgctcctcagtttttcccctgattttggttttttttggactggtatctttcattcttaaacctgcacaaggtaaggaaacaaaagctacgattcgggaagcggtagggcgaaaaattgtaacacccaagacagattcctcgcccggttattccttcatttcttcattccttcatcaaatatttattcagcgtatgttctctgtaggtcctggcctcatgaaacttgcattactgtggggcaagatgcaaagtaataaataagtaaaatatatataaagtatttcagatgataatatatgctgtagttaaaaaaaaaaaaaaagagtaggcatggggaggggaccagagggtgccagagtctaatggaggtaatccgaaattttagagtgttaatggaagtccttaatgagatggtaacatttgaggaaaaacctaaaggaagagtaggagcaagccatgcagctatctagggaaagagcgtaccaggaaagaacgtctaagggtgaagagccagagggaggcatacacttaacatctgaagaacagagcagaaaggccagcatggatgaagtgagtgagcaggggaagagtaagagatgaagtctgaggtttgatctaaggagctgagatctggaaagtcattgtaatgacactgagttttactttgcatgaggtaggaagctattagaaggtttggagcagaagagtgctacataatgtgaatcagtctggccgcgatgttgaaactaacatcacagttgttagttggggaggggaggttgtaggcaaaggcagaagcaggaagctctgttagaaaactgtggcaataatcttctaggtaaaaggtagtggtgattcaaagcaagatggtagcattggagaggatgagatatggtcagatgaggatatattttaaaagttgagctaacaggatttgctgaggaatcagaagtgaaccaaagactacaaagtttttgatctgaacaattcaaagcatgaagtttttatttactgtaatgaaagtgaaccagaccataggagaggctattgaagtgtgtggagggcggagagggggttcagatagagaggggataacaagaaatgtttgagatgcctgttaggcaccagaatagacataaaaagggagccggcaatacaacctggagttgagatgagagttttggagtcatcagcatataggtgggatttaaagtcatgagaaaggctgagaggtgagatctcaataggagcacaagtagatgaaaaagagaagctgtccaagaattggaccttgggtaccccactgttgagacgctggagtgctagcgaagaaccagcagaggaagttgaggaggcagccaacagaataggaaggtagctaagaaagggtgttgtcccagaagtcaagggaagtgttttaagagaagtgtgtcttcatctgtgtcaaatgctgttgataggttaaattagctcaagacagagaactggctactggtgggcttgacaagaggcctgaaatgctttggtttgcattcctttatctttcatacacaacttacctaaagtaggaatacgcttcaaatgtatatatttgggaataagttcctcactcctcaagtctacggtagggtttgatgtcatcagggcaaaacaaaaatgcaattagagtatttttagtgtgctatatgaaaggccaaattggcagcctctcttttctcaaggtcagtatcaacatgcataaatcatgttgacagtatgtctatgtgcccttgacatgatgtgatgaaaatggcacgttaccaaaacctattacctcaatctaatcatgagaaagacatcagaaagattccaatagagatacattctgtgaaatacctgatcagtactcatccaaactgtcaaagccatcaaaaacaaggaaagtctgaaaaactatcacagccaacaggagcctaggagacatgatgactaaaatgtactttgacctcctggatggggtcctggaacaaaaataacattaggtaaaaaccaagaggccctgaatgaactatagattttagttaaaataatgtgttaatattggttcattcattgtaacaaatgtatcatactaatgtaagatgttaataatagggaaactgggtacaaattatatgtgaactctgtactatcttctcaatttttctgtgaatccaaaactattctaaaaataaagtctattaataaaagtattaggcaaagtatttcagagaacatttatccaatgaaaatatacaggtggctaattcatattaagcatgaaaaatgctcaaattcatttgttattagggaaatgcaaattaaaaccacaatgagacatcagtctgtgcccagcaggattgctgtaacaataaaaaaaaagaaaagacaatgaaaatgttggcaaggttatggagaaactagaaccctcatttgccgctggtagaaatgtaaaatggtgcagctgcatcatttcctcaaaaagttaaacatagagttatggtatgacctaggaatttcactcctaggtatatacacagataaatgaaaacatacatgcgtacaaaaatacgcacacaaatgttcatagcaagcattatgtataatagccaaaaagtataaacaggttgggcgcggtggctcacgcctgtaatcccagtactttgggaggccaaggcaggcagatcacgaggtcaggagatcgagaccatcctggctaacacgataaaaccctgtctctactaaaaatacaaaaaaattagccgggcatggtggcagatgcctgtagtcccaactactcgggagggtgaggcaggagaatgcttgaacctgggaggcagagcttgcagtcagccgagatcgtgccactgcactccagcctgggcgacagagcgagactccgtctcaaaaaaaaagtacaaacaaccagatatccatcaacgtatggatgaatagaacgtggtacattcatacaatggagtttatttggccacagaaagacatgatgtgctgaatcttgaaacattatgttaaatttaagaagctagtaacaaaaagctattttgtatgacactattcatatgaaatgtccaaaatagtcaaatttatagagatagattagtaggggtcgaaaggaaatggggaaatagatagaggagtctttggggggtgatgaaaatgcactaaactagattgtgctgatggttgtacagccctgtgactattctaaaagtccttgagttgtaccctctaagtctgaaaattatatggtatatgaattatatctcgatgaaggagtttaaaaaaaaaagaggttgagttttaagacttgaaaaattaaatcattcatcataggaaatgaggagccaaagttttatcctcccattagtggggaaacttttaaaaggaaatatttggctcattttttagtttccctaatccatcctgagaggtagaagataaaggaagaatttttggagaaggaggtgatacttcatattagtcttcataggaattatccagaatagggagaaagtcatttggaagagaaagggtagttccggggactggagaagatgttcaaggaaggaggtggtgaaagaagagacctgagtcatcatcaggcctgaagtcagggctggctttgggtaagccacaaatgccaccttattaaggccttctctcctgcactttcaaaacatgccttcctcccccaccagcactccctattgtccttaccatgattttaaaaagcgtatatctgacatatttcgtatttacttatttgttcctcacctgtctacactgaatagaatgtaagctccataagcagggactcttttttgttcactgctgtagccccaggacctaaaccagtacctggtatgtagtagacattcagtaaatacttgtggggtgttaaagttatttggactttgtcctgtacgtaactgaaggattttaagcagaggagtgagatggtcagatttatattctaagtacatcatttcagcagcagtataggacttggatttgaggaagataaaactggaggccttgccaatcaactggaaggtgattgctaagaaagtggtagggggctaggcacggtggctcacacctgtaatcccagcactttgggaggccgaggcaggtggatcacgaggtcaggagatcgagaccatcttggccaacatggtgaaatcccgtctctactaaaatacaaaaaattagccaggtgtggtggcacgtgcctgtaatcccagctacttgggaggctgaggcaggggaatcacttgaacctgggaagcggaggttggagtgagctgagatcacgccactgcactccagcctagagacagagcaagactccgtctcaaaaaaaaaaaaaaaaaagtgatgtgtagggcttcaacaatgtatcagtgcttggtggtggggggagtggggatggaggagacatatttgagaagtgtgaaggagctaaaattggcaggtcttggagagtgattgaatagtgagggtaaagtgaaggagtcaaggatgactctccaatttctaacatgagtgtctagccagatcacactacagtcaagtaagataaggatacaggaggagagaggagtaggtctgatggagggaagatcatcagtggttgtggtgagtataagatggatgtgggacttccaagtggagacatctaacatgcaactggatatgtaaactggaagcttgagggaaaggccgggagtgaacaaacagatatggggaatcatcagcatggagctatttaaaaccattaacggagatcaaggctgtaggtagatggagagtaatcccctggggaagacccaaaagggcatgagaaggaagaggagcccctgaagaagatagggaaggaatggtctcatagcacaaggacagaacacagctcatgaagaccaaagagagtgcatgatcacatagctgcctgcacagaaatgctactttcaccataaattgatagagcatccttcttcccaataaatggaagcattttctcacgttaacttctccaactcttttaattaaactgtccagatactttcctcaagtgacagagtgataaagccagcctagcaactaaacatacagattcagacccctgctttatccttgaccttgtaccttcactaaggccaggaatgatctctggcatagctgagaatgttgaattcctcccaggggagctgtttacataaatttatttcctacaaacctgttgcaccgggaacattacttttgttttctgcaggaaaggttgtgagttttcctatttggaatgaccaaagtgtagtttgatagaaggggattagcaatgacatgctgccacctactggaactgcccacagacagccagactgagaatgtctgtggtctcctaaatctcccctcactcttctgaatcaagagtgggtattgcccctgaagcggacttcaaaggtgacttggcttgaaaatgtgaaatgccccacctatcaaataaaaatttatctgactgctttgctagaagaacaattttgtttctgagaaagaagcacaatatttgtcacatccttttctctgtttgcgtttcccagctttattctgccattggtcttgtttgccttcccaattctaggggcacctatccttttcccaagatttgcctttaataccccagatttttgactcaagattattagccgtgtagatttgggattaattttgtagaagagactagtctgctgccaaaaaaattctttttttaatgatgatgccccttaaaatgctgttaaatctcttaaatttaatagtgataaaaagctaaccctgattttcctaggggccagagtaaattgggaaatgcgatggtttacatggcttccactgccagatagaaagaaatataccagttgataaaattcagtaataaaaccaaatcttgtacggcctgatctgatggactttttaaagatctttatataaatagatttaaataatattacatctctccaattaaaccttcatttgaccttgctgtcccgtttctgaccatgccgcttttttctgatctccctttttttacatttacattaggtcccgtgcattgtaacaattaattgatctctaattaatcatttaattaggactccttgaatgcgggtgagcatgccttactggtctgcatatccttcacagagcacttcagagcaataaatacttctaagcctctcaaaaaaatctctcagtaactgacgtttgattccccataaacatatctcatgtgtgaggctttgattaagtaagatttcttttgattatgctcaattagtgtcaccatattttgtatatatatattgtcaatgtataatttagggttcctcgagattactggcagacagtgacactcttccctttgtagcacatgtgctggaattggaatgattcagagattagcatagatagcgagtattattattatccagtaaagatcccaaggaacagaaataagaagtgacttgtccagaatctgtcatcgaatcctgctgtttatatattctgcagtacctttgtattcatcatagttagttaattaacccacccagggaggctatttttctgccagggaagggttgcattgtactgaaaagatattaagcttgttctgtgactgaagcccaagaatgatcatttaccgactctattagaattctcactgaaaaatttgaggctggaagctgacctttcttgttttctaaataaagatgtagtgtttaaattttgatgcttgaaagtaggaaactggcacaatcgctgtcgtaaaagcagagctacagcccctgtaaaccacatcatgccagacttcccatcctgcccctccctttacctgctttatcatatacaggaagaaagcccttctcttcattcccacctcctgctttactgaacaccctttgctgatccaaacagaaaaagatcagagtactgaaggaaggtcacatggccacagtgaattctgtggccagcactccgctcaaggaccttttgttctctgaaaccttctccaatgtgcctggcccatatcacttgctctttttataatcctttttttttaattttctgtactctaaaattaatacctcattatgtgctatattgttcttcatttgttcccatcttttaatattttattcatctaatttttattaacatgttctctctctactgaattataaagttcttgtgactagttaccatgattgtattttgtttatttggtttctgggtggttttcccccttttacttctctgtaatagactacctgtcagcaatctgaagtatttatgaaaataatatgggttttaaaatatgtttgatatgtattactttcgatgtatgtttgtttttgttttttgtttgtttgtttttttgagactgactcttgctctgtcacccaggctgaagtgcagtggcctgatcttgcctcatgcaacctccgcctcccaggttcaagcgattctcctgcctcagcctcctgagtagctgggattaaaggcacgcgccactacacccggctaatttttgtatttttagtagagatggggtttcaccatgttagccaggatggtctcgatctcctgacctcaagtgatctgcctgcctcagcctcccaaagtgctgggattacaggcatgaggcacagcgcccagccacgatgtatgttttagagagcatctgtagctaaatacaaataggttaccaagaaatagtttttgtacctagctttacagacctttaactttaaactactttctctaaaacaaggaaagctcctgcaagacatgtgatttttttttacaaaccatcctagaggcctatattggtgactttctctcagtgatgatgatgatgatgatgatgatgatgatgacatattccaagtataatatgagtaattataattactgttatataatgatctcagcacatgacatgaacgttagtaaatgctttacctacattggttcactgaatgtccctgaaactctatatttagctattgctgcaaaaagatgagaaaactaaagcttaacgaagttaagtaaattcctagtttacataagaagagaggccagattcaaacttaggtcaatccaaccccaaagtctatgtatgctcttaactacgtgaagtaaggctaccattttggtcaatgttgggtctctcttttgcttatattaaaatatgattttatttttcagttattctcttagctatcaaacatttcttttttcctttattttctctggttgggtgtctttcccccttgatttccactgagctctgattgctaactgttttaatcagctttaatgggcagtttgacggcagaggggtctgcagactcttcctaccttggtggtgttatggggttggttttgctcagctgtcaggtgttcatgctgcttgtgggtcttctgctggccttccaaacaactgtccttggggagcaacacttagacccgagaccactctctcagaatctcaccacaaattagcacgtcatcaacagcactgagcagcaccatcattaatccaaatgcatacacctgtgcttttaagacaataagcagctaaaccaagtgcttcccaaagactagaaggtataagaatttccctatcagctacagggtctcttgcagggaaattgttttaagtggaaactctttgactccatccctaaaagttctgatttagaaggctgagggtagggcttgggcatctgcggcttaacaagtgctcaggagattatcatgcagaaataccggccctgacctcgttttctttgagattcatgcaatatccaggccatcgtctttcaacctcatgtttctcctttagtcccctttactcttatctcctactgcaggcagcaaaagtaaaaataacttgaaagcacttttctagattattttaaattattaaaatgacacacaaggtggtcaccattattactctcagttaacatgtgtagacattgaggcagagtcgggttgtattcttggaaatttgggagtaaactaaatagcatttcattcacctagtagttggctaataaatcaacctttaattgttgcatgaatttgagtaagtcacttcagctctcttggctgaagtttcctcatctataaaatgaagggtttgtgcctgaaatggcagcactttgggaggctgaggcaggtggatcacttgaggtcaggagtctgagaccagcctggccaacatggtaaaaccccgtctcttctaaaactacaaaaattagccaggcacggtggcaggtgcctgtagtcccagctacttgggaggctgaagcaggagaatggcgtgaacccaggaggcagagcttgcagtgagccgagattgcaccactgcactccagcctgggcgacagagcaagactgtctcaaaaaaaaaaaaaatatgaagggtttgattagaggatcaactatagggtctcttgcagattggacttgcctagagttccatgacataaagccagagagcggtttgagagatctagagccctgcctcaactcctagctctcaaaagagactatcacaggaaagctatctaagaggaaacaaattagctcccatccaattccataaagatactgtaaacatgtctgagatatgcagtatataacaggcattttaatatttgttgattggacaaactaatgcctgtgtgtatggatgaattaatgaggaaggaagtactgtaggcctgtttcttttcatagtcaagatcgtgcttaaagcatttgctcaccacacgtacaggagagtaaaacagatctagacgctggctactgcttttgcatgacctataaaggtcttataaggctctgaacagtaattcaaaatgtaaacgtgtaggtactcaaaaacataaatgtcacatctgctttagctcttcatctccattgctgtgctgtagttttccaattgatggaaaggttttattcagatcagccatttctctttttcctggaggcattcttaatctccgtgttctaacctttaacaatataggcttcagttgccgtgtgatgatttccattgcctggaatctacatgtttaaattcttccaaagaattgtgcaccttctgtttttctcagttgcagatggagtcaaaccagaaaaaaaaaaaaaaaaaaaaaaaagtggagtaggagaggccagctcttgattgacttctttctcttgacacacacggtcaggggaaggaatggatcaattgcctcaacttttcagcaggcattaacactgcatctcattctccttcaggcagtctgtttcgcagagacactgattaaacatttggggtattggggacagagggagggagggagaggttggggatttttagtggctagagccttttattgacaacattaaaggcttcatgatatatttgaccagaaattaattacagcccagttccccatttctcccttaggtgacagtcttctgttgatgtgtgctgctgtgaaagtaataataggtttcaaatgtttgtgaaaaacataaagtaattacttgctgtggtaaatcagtcatttgaagcttcagcttttctctgttctatgtgtgtggcagtctgtttcttttgttaactttaattatacaacatatgagaatttgtatttttcagttttcagaagttttgcttttttcatttcttggtgcatagttctccagggatataggtattgaaatgataatgacacataaccagcatttgaacaagggaagcacatgtgtgtgaggaagctgattgctttagttaagtttcgtagctattggctatcagctatttgccagttttctaatgggtcttaaatatttactgtctgttgtacagaggggaagaattggctttcaggcattttaaggctccttccaccaatagcacttgtttacattatgggccctcaagccaaagagtctgtaatagctctttcccctttttcaaattaaaaaaaaaaatctgtttttttctattaaaagctgcagctccttgcctggggttcttgccttccagtaagatctgtaaagatctgcctggataataccaacctctatgttgactcacctggacaaagagagagaaatttccttttggcagctgttttaacagggagccttgcccagacagaatagtgaggcctgtatactggccagcatggcatattatcacacatcaatttccttctgtctgcactaaggctagctcactcctcaaaataggaattgttcacatgtattttcaactcaaataattcatgttaatcttgtttctctattttgtctaatctctcttgttcattcctgatcagtgaagtatccttagtctgcatttcaaaggtttgcttaatttcccataccaagctgcccctcttaaaacaatgttttccccattcgatgttaacctctttctttgaactattatttatatttagaaccaaatataagaacagtaagaactggttatcagtaattcctctgtatggaaaattgtgctaaactaggactctgtgcttttacattgcagtgataattgggattcatgatgtttgcccgagtctagaatatcccatccattaccaaagaagaatactactacaattagtatagttagcattatatatattttgctgtattctgtctttgaaaaatcagtaactcaatatgatatatctgagaataagcaagaatatctgattaaaaatacccctcatgttcttttcatactgcatcgtagagtatttatagctctataattgtcatagcatttcatttcttccataagactaggtagtaatgacaaactgcttaaaataattttatattactttattatttttaatattaataactactatgaattgagtatttattttgtataacttatgtgatttacacacattgtcttatttaatccttatactaacctagtatgtttacgaattaactttttcattttgcaaatgggaaaactcaaactctgaaggattaagtaacccgggttctacactgtggtaaatgacaagaccatgattcaaagtcaggtctatctgcagtttagccattgcgctatacagcttatgacaatgtaatacattagtatttcaagaaaatgtaccacagcctcaatgttcttattgactgtattgcacagtattcctagtcaaaagaacttaaaggagggatggcagtgttttatcttcccagagaggaactgaaaggagatgttgtatagtcgacctgcagggtaaaacaaaagaagacccaagaagatgatgaaggaggattttagcacagtccctaaggcctgtctaggaatgaccacagtcattgatgggcccaacacaggcatgaagtggtgtaagacctcagagagacctggcatggcagcagtgttaggggtgcccaaatccaggaggaaggctggaccacaccttacagggagaatgagtccaccaagtacaaacctcaattcccacagtatcagtagagctcctacctagggtggtaccacagtgactgatgaaagtgtcttaaaatagctcttaaaaagttagtggccagatacggtggctcttgcctgtaatcccagcactttgggaggccgaggcaggcggatcacgaagtcaggagatcgagaccatcctggctaacgcggtgaaaccccgtctctactaaaaaatacaaaaaattagctgggtgtggtggcaggcgcctgtagtctcagctactcaggaggctgaggcaggagaatggtgtgaacccgggaggtggagcttccagtgagccgagatcgcgccactgcactctagcctgggttacagagtgagactccatctcaaaaaaaaaaaagaagctagtatgtttttaattaatttaaaatattcacaaaggaggagaaatcaagaagctctgtcttttgttatttcaatagaaaatccagtcattttaaaagaaaaagtagtgatatattattgacacttgtccatttttggctacccctcctctaaaatctatgtttaaggaattccccacaacctggtcttggagtgaaacaaagtgcatcttccatcataaacacacaaaagcccaagcttgcttactgtgtgggggacaacctcagcttcgcccatcagatgcatgcactctgaactctgatcggggagctaaggactccaagcacaagggtgacagagcaccacagaaggctccctcagcagcagtggtaacttctggttacctaaggtggcggcagtagtagtggcagtggtatggccaacatccacttctgctggcagcagagcaagacctggtgttctgtgtttagcagcagctgtggtggtatcttcacaaaactatctttgaagagtgattctggagagattttggccacaatcccagctgctgtctagctttgtttatttctgctccctttccaagtctcattctccagccttcctggctcatcttggagttgcccagtaccctttcaataattccttctctgcaactttgaaccctgattgttacatacatatatttatgtaaaatctagtaataattgttaatcttagcttttaattctggcagtccacagtgaagtttggagtcttacattattattattactattgaagtttcaacccacattgtatcacttatcttggtcaattatataacaaacttaactgtctatcaagagtttttattttttaaagaaaaagcaaaattgactggattgcatgccctgaagcaaggctacccagatctgggaaaagttagttattggatctacacatttgtttcccataaatcatcccaaagcgcagtacctaaaacaacaaccattatatgagttctcttagttgagcagattgactggggcccagctgtaaggttcttctctggactgccttgggttctctcctgtggctgcagtgggatggcagctagggctggagcatccggaatggcttgcctcatctgtctggtgatttggtggggacaactggaagcctggactcagctgggagatgggcatggctcagttcctctctctgtttctgtgtagtctcagagattccccctctccatgtagattttccatgtgatttcttcatcagggtaggcatacctcttacatggttacttggggctcccaaaagcatgaaagtagaagctatcaagcctttttaaggcctagacccaggacgagcatagtatcacttctgtcactttcttaaagcaagtcacagggctagcccagatttaatgtaggagaggactaaatagaggcatgaatgacgggaggcatgtttcattaggagttatctttggaatttagtcaccactatacttaaacttcagcctccagttatgtgcacccaacgcagtgcctcatacagtagacattccatctatttgtcagaatgctttcagtgcaaggagcagaaacttaattcaaatgatttaagccaataaaggaaatttcttgaatcatgaagctaagactttcaagggctggttggctttaggcttgctttaaccaaggattcagaccgtatcagcaagatcgcttcttttcttcctccaactcctgcttctatttgcatctgcttgtctttataactacatagcctgtctccccacgatggcaaagtagtagcccagacttatactcatagctggaaatcttagggaaagggaaatctctcttccagaatccacggaaggactcttgatgggctctgtctatttctgagccaattcctgtggcccagaggaatgcagcattctgatttgacaatttcaaatcacccacctgcacctgtggtgaaaagttgctcagtgtaatctggatctagaagaacattttctagagaaaaggaaggtttggttaccaaagaagagggatagatactagataaacaaaaacgagataatccctaagcccaatagcagtttgctgaatgaataaaatgtagcttataaatgagtggtgcagacactaccatactgagtttattaggtgtcaaagaagatagacatttaaaaacaatgctgttatggaaagatatttttatggaaagaggtagaagtgctgctggaacattattcaaagtgggttgaaatcgttagagaaaatgttgtagaagcagtttttgaactgtactttgaaaaaggtaagatttagaaggaaggaggattttataggcagagcaacgttgctttcttaaaaaacaaatggtgttaataaaagagaaggttacagagtataattttaggatgtttctgatcctctgaaactatacatgtaagaaaatcaagagtttggttgttacagtatgttgaactatatagttacagatttagttggttccaaaaagattttttttaacctgtatatgacaaatgggtgttttagtgattaaggggggggattcacacaaaaataaaactatcaaggtgattgctatcaaggaaaagaaaactcctttaaaaatatatagtatattcatttttgttgtcctttgtcactttaacagtagatgctgaaattaccagaaataacagtaatctgtatttatagtcctcctgtgaatctgaaggtttccataaatgtaaattaatttggttctactctcatgaactgtggaggaaacagaagcgaaatattcccaactaccccatccgcacttctgtctgagaaagacagtgaaagaaggactgagaatatgaggaaaaaagcagcaaaaactgaattggctggctgggcaccgtggctcatgcctgtaaccccagcactttgggaggccgaggcgggcagatcgcaaggtcaggagatcaagaccatcctggccaacatggtggaaccctgtctctactgaaaatacaaaaattagctaggtgtggtggtgcatgcctggaatcccagctactcaggaggctgaggcacgagaatcgcttgaacccaggaggtggaggtcgcagtgagccgagatcacgccactgcactccagcctggcgacagagagagactccatctcaaaaaaaaaaaaaaaaggaattggctgagctgactttgtagttctcatggggttagtgaaggagaaagaagcagagctcagagacgggatttgaatttggtaagaatagagtcctggttggctcagatcactagatcgtactgtcagaagctcagaaagtcttaattgagtaggaccttagagatggtatcttctagccccttcgtttatcaggctggagacttgctctgagagatggagtaactggccacaaatgatccagatagggctagaacccagatttctgaactcgtttttctgggctccctcctggagctctcaacaccccttacagactcatgtcaggagctctcagccttattcacattctccctgggaagagtgatgccctagggcaacgataggcaacccaggaagatgattactagaatcctctggaggaggagggtcattttgtggtgtgtttctgatacaatcctaagagtatcatgttaaccccattaaccataatatccaccttctctaatactagagtaacattgctgtggacacatctttacaaacaaaaattactatgtgatgataattatgacttctgttcacatactcaagtccttgttgctaagtaaatgcagaaagattattagttttattagcctttgatattgaaattgtcatgttctctcttagctatgaagacctgctctgcccacatcaacttggttattttttcgtaaggaaattaaagtagaaattataacacaattactatcaaaattctactaaactataagtcgaaacaaaatataagaaccgcaattatgtgagaataacatgtgggaaactgttcctgctgctgagatgcgtaaagtgaagtctttggaagaaggcatggagttactaggtagccgcagtgtggagggtggctggacttctctgtcgctagcaatgggcatggtgccattgccaatgcttggaagatgagtgtcttcacctaacttgttaagtgccaactagtcttctgcctccaatgaagatttctcctttgtgtgcacaggttcttctactgagccccaggagtttagggtcatcatgtgcccttaaagtgtggagtgataagagagaatctctatacctctgaccaatttggaggaaagcagagatttagtgttggggccacttacacgtaatcttctttttctcactttttcgctgagaggaatgtggtctaatctagacacctactggctgccttgaaagagcattctcagctatactggcagatctagcaaagagatgtgaaaggatcctcaggtggccccttcaggggtctttctgaggagtcaggaggaaccagccattgtgatgataagacacccacccaggtggttttctcttagtgtgataaaggaagctgaccctgtcgaggccaagatgttcacccagtgggttatccttcttatgcagagggatgacgtaccctcagtatccaaaacattctaatgtcttcattgtctgtttacattatgcctcctcctcactgtgggagttccaagaagttttgcgtctttccctataacttttataacttttgccaccaccctgactgatctcctacaacatacaacatgggtaaacctcaaaaacattgtgctaaatgaaagaagccagtcaaaagaaaccacgcactttataatttcattcatatgaaggtccagaatagggaaatctatagaaacagaagtagattagtgttcactttagggctggatggagaatagcggggaaggggatgagcactaaaggatatagggtttctttttggtggtctattgattgattgattgattgattgcttttattttatttattgcttcatgaatgacaaggttttactctgtcacccaggctggagtgcagtggtgtgatcacggctcactgcagcctccacctcctgggctcaagtgatcctcccacttcagcctcctgagtacctgggaccacaggcagacacaatcactctcagctaattttttaaaatttttgaagagacagggtctcaccatgttgcctaggctggtcttaaactcctattctcaagcagtcctccagtgtcagcctcccaaagggttgggattacaggcatgagccaccatgcctggctggtggcccttttaaagtagccttttcttaggctcttacatatctttggaaccatccactattgggagcttctctccactgctttctaaaatgagaatagccatgtacaagcatatgatttaaactgtttcaatatctggaacgtttcctaaagaagtcacttgcttgaggttataacagattggcaaggggtcagtcattccattcatacatcaaatatttattgaataaatgtgagagctagtcattcctggagctacaaagataaaaatatgattcctatttttacacagtatagcacagtagacctcagtaatgggagcagaactttgtgataagaattaagagagggaaagcattaaggtaagaaaggaggttaaaacctcgtaagatgccctcctaggtatatacccaagagaaatgaaaagcatgtgtccacacagagacttacatacaaatgtttatagcagtaggtagtattcataatagccaaaaggtagaaacaactcatatgtccatcaatgatgagtggataaacaaaatgtggtatatccatgcagcagaatattatgtggccatagtggacttgaagtactgatacgtgctacatgctgccaagtctgtcctgcagactctggccaagcgacagatggaagaagttcactggcacaggtattttgcctaacaatgcggctagaggaccccacagcttagcaccgctgatgagagtgcagtgcagccacagcagcccccataaggtggagacacttgcatttatttcgtacagatttaatgacaaaggcttggagcaaatacactttgtgggtaataaaccttgttgacccgcaccccccctctgcccccccagctcacccccccgccccgagtagagagcagtcctgcacacgactgatcaaaggttggtttctggagagagtaaacaaatttatctagataagtctctttacagtcctttgttatcgaccctttgctgtcaggctcccaataagagaatttggctgccttcagccaaattttcttttgaagcttttgcaaaacctcctggccttccaagaagttttgcatctttccctataacttttataacttttgccaccaccctgactgatctcctacaacatacaacacgggtaaacctcaaaaacattgtgctaaatgagagaagccagtcaaaagaaaccacacactttacaatttcattcatatgaaggaccagaatagggcaatctatagagacagaagtagattagtgttcactttagggcttgatggagaatagcggggaaggggataacagctaaaggatacagggtttctttttgaggtgaagaaatgttctgaaattcattatggtcctggttgtatatatctgtaaatagattaaaagccattgaattttacactttaaattggtgatttgtatggtatgtgaattatatctcaataaagctgttttttgaagaagaaaataagagcaaaaactgagagcagtggtagggaatagcagagagtttttggttttgttttgtttttgttctctctgtttctctaaaaggggaaacatttttatgggttatggaaagacagacgcaaggtttataaccctgcctggaagtaaggaaatggttttggtagtcttggtgattttagtgtcattactatcatcactgttgttattaagagttgattgtggagctaactaggactaaggagcttccaggtagaggaggagtagattacacttgggagggtagagacaagtattactagttcagaatctgacacctccatccagctggaagaagacttgcttatgctagaaaaggaactatgctgccataagctactgaagaaatagcaattccaaagttagaatggatgcatccaaagaagagaaggaaacttctatgcaagtgaatctaagactccattataaacccatgaagttaagaagagctaaagaagcatacagaattattttgtttgcaacaaagttttttttgtaagttttcatttgttgctgaatctctctcagttgtggttattttaataagcagtgagtttgtaaagtcctggtttaaaatactaaatgtctgatctccctattaaccccaagcatctgagattgtaaatcatgactctttgttgccacctgatgacaacaaagagtacagcccttctggaaatactagcctttctagaaacaaattaatttcttgaaagctgaaattagcaatcagtgattcagagatgttgacaaaggctttttataagttccttgaccttgatatgagaaagaggcctcttgtcataggcatcttaacgcatactgaagttttttcttataactacattacctagaaagcaacatcctccatattgaaagtgattttcaatatattacactaaagcattcagtgtgtattgccctaagtctgtcaacagtttctcctgcagttgtcgctgatgtcactgtccagtggctgcttctctcatgtctgaacagctgcaagcctgttcttactgttgctgctgtcatcaccatcacacacaaactgttgcccctgccaccatcttcctgctgctaatgggactgattggcacctctccacaccacatcaaggtgcaggagctatttcccctgccaggctcagagccatctgacacctcttactgccaccattcattatcaccctcacagcagtgaagccaacaggaactagctcagtcctgagctggggggcctcactggtgaagggagtgcggtggccacctttctgcctgcagaagcagctgggcctctcagactggacctggggactcaaaaaattctgtacttttaggggtcagcacattagagccccagcatgtctcttctgtactggttactggagatgaaagcaattagaaaattattctgtttaggagagtggacagcaccaacagcttcctcctcaccatgtgcctgcataggtaacaaataagcaatattctgccccttcctgaccactgggcaaagattaatgccatgcattgaaagttatttttaaatgtcctcaattagctataatatttttaacaaagcttgtaaggtttaggtaatgtgtagggtataagatggcagactcattactgtactttcacagagaaacaaaaaggaataaatccacaactgagaaagaataggaggatttaccaataaataaatgacagcaactttctggatgataggaagaagatggaacattgttaatggataaagtagttggggaaaaggaaaccctcagtctggaatgtgcaacgaggaccttggagaagttccatgttcataatcagcagttcaaaaaaaaaatgtcagagtgccaagagaaaccgaaaatagagactaatgaaaattttctagacataaaaatatatatcctacaggactattttcttcacccctccaaaatgttggtatccagaagttgttcttgaaagagccatcctaggaaatatttagggaaagtcaagacttctggtgtggatgtcagaggaccagaataaaacattcattttagcactggagggagaggtcccagcctgacagttggcatcccacctgctcatcctaaagagaaacccacctgttagcaccttctgcaccaccccacataacactcccaggaactccctccctctaagaacctttttagaaacatgatcttgcctatacttagaggcccaagatccaattggagtccgaggaaaagagaacagagaatgaaggggaggggaaattactgaagaactagtaaaaatgcttttctagaactcaggaagggcccaagtcttcatattaagagcctgttgggtgcccagttcagtgaatgaagaaatagcctcacctaaaacacagcctcatgaattttcagaatgccaaaagtaaacttataaaagctccagagagaggggcataaaaaaaagtcagctggtatcagacttatgatcaatagcactaagtgctaagaaataatgaagcattctttctcagctccaaggtagaatgatttcaacctagaattagacatccaaacagtgtatcggccaattttgagggtgcaataagggcatcttcagatttataaagacttggaaagttgacttttcatgctcttctttctagggaactttttgagaatgcatttaagcaaagcgagtaaataaaccacaaaaatcagaaaacgtcgtgtctaaaagagacttgatccagctcagaacagtgaaaaggtaaccatgaagcaggcttagagaggaaccagtccaaattgggataatgagatacagctgttctggagaaagttctctgggtgggaaaagactcaagaaaataggtagtatgatggagaggttgaaaaagaacctaagatgtgaaaaactcaagtagtacaagagaaaggaaaggcaattggaaatttttaggaaaaaaagcaactatacaggaaatgtgtggcctgcatgcaaagtgaacttctagaagcaccctctttgagaggcctcaaggctgtgatatagttaggctttgtgtccccacccaaatctcatcttgaattgtaatccccataatctgtacatgtcaagggagagaccaggtggaggtaattgaatcacgggggcagtttcccccatgtttttctcgtgatagtgagttctcatgaaatctgatggttttataaggagctcttcccccttcgatcagcacttctccttcctgcagctttgtgaacagggtgccttgcttacccttcactttctgccatgattgtaagtttcctgaggcctccccagacatgttgaactgtgagtcagtgaaacctgtttcctttataaattattcagccttggacagttccttatagcagtatgaaaacggactaatacaggttgtaagtgactgatagagaaggaaatataatccttagcatcactggccaagcactatttgtgtatatgtgatggcgtaaatgctttttattgtttttcgtgaatcatcatgcaaacaaagcatgaaagactccattgtgtttgcaggatagtatgtaaatgtttatcttcacccagcaaaagtaagaatgtagctgagagaaaatagaaggtgagagacagaaatatggtttggggtaaagaaggagataaaaaggttttttttcttttttcttttctttactttttttttttttttttgagacagagtctcactctgttggccaggctggagtgcagtggcatgatctgggctcactgcagcctccacctcctgggttcaagccattctcctgcctcagcctctggagtagctgggattacaggcatgcgccaccatgcctggctaattttgtatttttagtagagacagggtttctgtctgttggtcaggctggtcttgaactcctgacctcaggtgatccacctgtctcagcctcccaaagtgctgggattacaggcgtgagccactgcgcctggccaaaaagttttcttaaaagggtcattaatagtgtcatcgtaaaagtgggagtaggcaggagatttgttgaagtaaaaatagtggtttaggtagttaatttaaattacaaagaacagcattttcacacaaaaatgctaaaatataaccataaaatactagaagaaggagagcagtattacagatgagccatatctttgtcttccacatcaggagatttatcttttaggatacttttaactgcgtgtaacagaaaacactgacttaagtgactttaaactttttttttcaagttttctctcatctaatatgaagtcccaaggtagggtggcttgtgggtgggctaattcagtagcccattgatgtcatgaagaacccacgttcttgccatctctctgctcttccttccttaaggtgtgttggcttcatcctctgaagctactcctgtggtacagggttgcctgctgagtttccaggcatcacagagacacattggaagaagagtgtttccttctgggctttatcttcatcagcagggaaacatttcctagcagttcctcagctgacttcctcccatgtcctgttggccagaacttgatcacacattccccctaaactagtaactggcaacggaaatggagagctgctttcttacggccactcttcagcagatttgatttggtggaagtccctggaaatagcaatttgtatctcagcatgaacctaagacttaaacgtgacaactgttaatctcacctttcccttaattgataagtgttcataccagtagacctattacagacaagttgtctgtgctgcccctgtatgagtttaatgacaaacgtaattcagaaaaaaaggccacggtgactttctagtttccttgatcagtaattttcccttgagatatagaaagagagcatccttctctccagcttatgtatcataccaaaatcctcagagctgcccgggtgcaatggctcaagcctgtaatcccagcactttgggaggccaagatggatggatcatttgagctcaggagttcaagaccagcccagcaaatatgaggaaaccccatctctatcaaaaatacaaaaattatctgggtgtggtggtgcatgcctgttgtcccagctactcaggaggctgaggtgggaggatcccttgagcctgggaggttgaggctgcagtgagccatgttcatgccactgaactctagcctgggagagatagcaggaccctgtctcaaaagaaaaaaaagagagagaattctcagaactgctgaatgaattttttcttggattaaacagctttatataattcatagattctagaagtttcttcatctctgcaaatctatagattttacatttacatatgtagatattctgtagagacagaaggtttctgtgtcacttctcaaagtttccttgttttgcttggtgaggtggaaacagaatgcaaactagagcttgaatcccacattttactagtagctgcttagcccccagtagtttttaaccttttaatacttcggttaccttacctataaaatagagatgatttctttacactttagggtggttgtagataaaatgaaactgcaagtaaaatgcccagtacaaatagaagggggagattagtgattatttattcattcttattcttcctattgtaatgtgtaagaggattctagcacttagtttcccagtttttatatttttgatagtagcttcatgttattgaaaagtgagtcaaattagggggcaaggcagaggaatttaattctcattttaaacagcaatatagtaacaagaggagagatgaaaggcagcaaggataaagaccgaaggtacaagatatcagtggttttgacgaagttttctcaatcaaagactgcaagctgctcccacgttgcccagatccggatcctacagagctccattgaaggggatttcagtggaatggtttcctcacagaaggagaccagggtgactttatttcttcactgaaacactttgattataaaaagaaatcagatgatcaaaaagcatgagatgatgggtgaaatatgttatatgattataattcaataataattgaatttctctagcatttttcccttgtgggaggctcagagaagttcagatgtattatctgaattcgtttcggcatacattggtggagaggggccctgtgttaggctttccattcttcacaccctacccaggccatgagaccggagcaatgttcctgtagctttggtacccgtggctttataaacatgaacgtgaacattttaggcacaatttagaaggggattatccgcatccctcctcagggagagtccttgagtagaagtgtcatctttccagttccttctgaatccccttcgagcaattgctctaggttcaaacagttcatgaaacagaatgccacaatgaaactgaagacttcctatgagtttttacaagttcttatttcccagtgatgtcccaggagttcttgataaaaaggaccttttttctttctagtattccaattataagatagcgatcctcagcatcttgctactcaccaactcaggtgttctctgattctgatcccggggagttttttcaaaatgcctagaactgtgaataacaaggtgcaaacatagataacttatcttccactgtttacctttaaaaggtcaagacccagtgcaatctaggccccctatacctactatggaccactcagtagaacagacatcacatttcctgaggctagtctgagaagcatgggctaaggagtcgcagtatcgattgtataaggattagcatatctggcagatgggaactgtctgaactcattcaactgagaggcatctgcatcaggcggattggcattgctgaactttcacacggcaaattgaggattttaacatgcagcccaacttctcctgtggagatccagtgaacacataaaaaggtttcagtctttatgaattcctggatatattaggcattacagaataaaaatattttcccaagtgctgtattgatactctaggcacctatacttaacatttatgttcttcgggaaccactccatgtagtcagatattcagggattgttggactctcgtttcttttatatatcctttaattgccttagactgctgagcttcattatgtgggtcaattagtcttttttgagaaatcacttctaacacactaattttattctctattgcttccttctgattcctcatctctttcccagtctccaccctctaactcattctcatttttattttacttctcctgtttatttaccttatgttccttcgctatcctccacggccccatgccctcatcttcccagagagtgcttgaggcctagaccaagcagagcagccacaccacaggctgctcccagtctgtgtcacttaccattggcagtaactaggggctcttggagcatccctgagctatcagttggaaacaagctcttcctaggtcttgactaggtctaggtcaggatgctgagaatcaagatgaatggaagtttgcttacctagcagtctcaaagcactccaaatgcacatgtaaagagatacccatgtgtgtctacatggtaaatcccataacctgtgttcccacttctggagatcctgaggtttctgccttcattttccttgggggaacatggaaaggtccactcacctttactttgttcccctctcctgcttctgtgtatggtctgagttgacatcttgcttaatcagaaatagaaatgggtgaaagattgctatatgaggccataatgatcaatagatatagataatagataaatgtatatgtactcacgtaggtatggtatacacctacgtaaggagtataggagtataaaccatgtactcctaacttggagtgcatgataaagcttcagggagtgcataataaaccttggagtgcatgataaagcttcagggagtccataaacccccaaaattatatgcaaaatctgtgtttatatagatgtgaattttttctggcaagatagtccatgattttaccaaattttgaaaaggtgctgtgagattctaaatccattctctttggctggctgtatttactttcttgttcttagaattctgaacaaaacattagggatcagaacaggcaatcacacatactaatgctgaaataaaatcatatttccaggtctgctagtgttgtctccttcaccactgccctccatcatagtcctccattcagagctgacctctacccccagctggtcatattgcttttccttgctgccccagtacaatgagcaaccatgggaatacagtctcaggatacccaggttttcactatactgaagagtttacatgcaaagctcatcatcttctctcatacagcaggtccccatttctaactttgatagcattctcattcaggagggaagtcttggatggttgttcactcctgattctttttcctcatctgtatctggtcctagcaactctacttccaagttttcagatattagtaacagactaacagcttcattaacttggattttggttctctgtgaaagtagcctcaagatctgccaaatctgaatcttagttccatattccatcccttaaccttagatttcacattacacaaattgccaacacctctctatggctcacccatctgtcctgtcagcccttcatatcctgttaaacacatagacttgttgactctttcttcctccaaatctggaataaagcgacagtcccacagctgatgttcatgtctcttggtctcttcccttcagccatcctttgtgatgtagatagactaatcatcccaagatactgcttctctgaattttttgcccaatccttagagtgacttttttataaatacactatttggcccaaatttgtcagagttaaagaaaaacttgcctgataactgttctttcttaattggccagcatcttctctcattatttaaacttatgttcccactgatttgacagtcttctttacatgtgactcacggtgcaacctccatgcctttattctggctgttctgattcattcttcaactcccagccttcaaaacacatcgcactcccacccctcctctggaataattgactgctccagttgaccctcatttttcagtcttccgaagtcattgccatgttacttgaaacctccataatgaagcacatggcgtaaaacagatatttaataaatatttgatcatttcaaagatagttttccaaccaatggaattgaagagcaataaaggcatgtcttggggaaagcaggtagtgataatggcaaagtaatcagtgcacaaatttttagcaatatgtagctaattctgaggtaactaaagctcaattaacaatatttgtaatattgcatgtcagcaaagaaaaatatgtaagcaaagcatgtttcaggatgatccttctaaaggatagtcaatcacctgtggtactatcatcaatggtactagtattggtcaacatatgtggtataggtggtcgggccttctctttaactaatcagatgaatatttaatatagcttcccaagcctaatccttggctgaactgtgacacatgatcagctggtgtgtacctctaccctctaataaagccgaaccatgcattttccttcccctccccaaactgatggtaaaacccaccaaatttgcatatagcctcctctccccatgattatggcatcagatgtttatagatggttctgtttgagttgatcctaaataagggagacttttaccattgtaactgctgttcccaaagcgtaacataaactgctttagtcagcaaaatatatatatcatctttgccttggtagatattgaattgctgactctctcttctttagacccagtagtcatttctttacctccttaatttatgcatgaagccaaaagaaaaattacttcatattcttaataaaaatggcataaggtttagataattttttactatatgcagtaaaaatgcaaatgtgtgtggcttatttgcaaatgtagacattaataactgatatttaaacagtccagattagcaattttactgatatatttaagagatttttccaataatttgcacactcaaaatcaatttgaatacaacatgtaaattgaatttaattttttatataaaattgtggttatcagcttgaaccattaaatttactatttaatatatgctttccagatcacttggttagaatttcattgcaccttatctatataaatttaattaggcttgatatcatcagtatattatagaactaattaaagatttagataagtgctgagggggcttattgaaaactccataaagttccatttggaaaatgagatattcttccttcagttcattgtgagagaaggaaacagcaagaatgcttcttgcagtgtttctgaaaaattatttaactggatttaaagggcttattccattctttgaagagctttttaattactctctatctttgtgcagtccaacaacagttacaatctttatttaaaggctttaaaaatcctcatttccatcttctcccactgagccagctgtgttacattctgctgggcatatgtgcaggtaggtagtacagggtttgtgtaccctgattgcgatcatataatatgtagcagcatttgtggggaagtctatctagtcctcccaagcagaataaacattgagaaagctcagcgagcgcctgccacaaatgtcttaggaaaagggaaaagaaagaaaccctagcccaggaggatacctgggaaaaactgaggcttccactcaaaagatacagcgactttaagtaatcattttgcagaaatcacttttggattcccttgtatctgcatctctgctatagagtataaagcatattagtttaaaagactattatttcaactaagtgctttgtgtcttcattacaaagcacaataaagctttttaatacaataaagcctttattactttcaattgaatatgcctggaaataaagctttatcaaccacatttgccagtgtgctcaatgctcttgtcaaaagcactttttcttcattgcagattgagtgacacagagcatgctaggaaaaaaaaaaaaaggaaagtgaaaggacacatgacaaatatgggccatctacgactgggcacactgtcgattacgacagaggcctgaggaagccagggaaccggataaattgtcaagagcctgtgtggtgtaatagaaaggttacaggctttgggctcaggagatgcagatttaagtcagagccctgctgctgattagctgtgtgacctggacctcatcttttccacacctaaatcttgtttcctggaaaatggaaataatatcagtaatgctgccctggccaggcacggtggctcatgcctataatcccagcactttgggagactgaggtggtggatcacctgaggtcaggagttcgagaccagcctggccaacatggcaaaaccccgtgtgtagtaaacatgcaaaaattagctggccgtggtggcgcatgcctgtaatctcagctactggtgccgggggctgaggcaggagaattgcttgagcccgggaggtggaggttgcagttagccgagattgtgccactacactccagcctgggtgacagattaagactccgtctcaatcagtcaatcaatcaatataatgctgccccttcccccactgcagtctccctcatgggttcggatggtttttaaatgtcatatattctagtctactccatttttttttccagatatggaaactgaggtacagtgggattgtgtggcatgatcgtaatcactagttagctagtgctggggcaaggactggaatagatgcctcagagatgtcatgttatgtctgtgctgtcacacagcacataaaggagcagataattattttcttaatgacaccctggctgcatttggtaggggtgggattttttcccccaagcaactattactgaaacacatcactgctgttttcctgctcaaatggtttgtaaacatttacaccccccagcctgagaaaacatttgcagaaacatttgggtcacaaaccaatgtttgcttcaccaccacatttgaaatatttctctttgaaaacattagaaatgtttgtcagtaaaacagattctcaacagaagtataaatctggaaagggagggacacccacagccacctggtttggtgcattcagggtcctccagggatagcagtttcttcctggtccctaggaatgtgtgacacctcccagcatcaccgtagactctgacatttcttgggtgtaaactattaggggcacattgaggagtgcaatggtttcgggggaggtttggaggtggcaagtttgttctctcatgcagctgtgaatgtagggtagttgttgagaaggaagtgtaaagagaggaggcaggagattggccagggcagtctctgtgtagagaaggacaggctgaggcttacttgattcttcctcatcttttccctcattccccaacacagcctctacagctccaacacagttgtgctaattggaagtggggcctttaaaataaccttggtttgtagccctggcctgatcggtgatggagcatggtctaggaactggatcagcagtttggagtccaggcagagtgggttgaaccctaactctatttctgactcatggataatctcaactaatccaccttgccactgggtgaagcctagtggagaagagctcaaaggagcctgtgtagagtttgctcaaaagagtccttgtcaccaccttcctcccattttgttttctccaccaatatccaggtcatgagagcagcccttcctctgagccacagggaagtaatcaataaggccacatcccgctcactgacatccccactgaaacaggtgaagcacatgtggaaggtcatgagatttttgaaagcactagaaattaggagactaattctgaaggtagcaagtgtgagggaaatggaacctctgctgcgtcctgcctaccaccgtcttctgcaggatttgtaaaaaactaggttcaggtttccaggctatttttgctgctgtttgaacagtgtctactttttctactaggaatcagcatgtattttctttgacatctgtatctgctgagatcacaggccatcctggtcaccaccttgctgtctagaacagcgtcaactcaactgagcagtcatccattaccacgcataaagatctgaaggtccactctgtgaaagagcagacaatgcaaggcatctcctccttcgctttaatgtagcacacgttagcacaatgtgcacacttggagcagtcatctgcacctcagtttccagctcccccgatccaatgctgttaatatgttcttgccagacacttatattcacatagcactttacaatcgacatagggctttcacaaatatgatttcagtgagtctcttgatgagtcaacatttttgtctccccaagcattttctgatttgaactattttctcacagcctaactcagcagttttcctggaatgatgtgtgggaggtagggtatgatagtgtattgctatgtagtcaaactttaaccctgaaagtataaaagaattcaatactggtgttattgttaactagccaggtgaccttaggcaggtgttttgcctttggagcctcaggttgtgaggactaaatcaggtgtatgtgaaaggacctggtatatagtaagtgttaaatgctaattgttccatataattatggtcctccttaataataaacattaatagaatcattagtgaatctttggctgaattatatttctatcatacgtagagttgttcccaattctaacctatatttctcgtaagggttactcattactagttgttatcaatgtttcttgagaacagtatgtagggatggagaaagttcaaaggcatttagtacaaagatgctgggggtcagttaacttacaaaagcgtagagccctgagacatgactttaatacatttctggggcacttagtgaaaatgtgagctggtgaagatgttgccatatctgtcagcttacagaatcttctgtgcacttatcacaggagaacatggaactgcagcaaacatctcaattaatggatcaatcctcacaacagtattggctgcggacagatgtcttctgtatagttaagaagtcagggttccagtttataggatttgcatttttataacagctttatcaagatataatttacataccataaacattaacccttttaacgtatgcaattcattggttcttagtatagtcacagcgttgtacagccatcatcaccagctagttttggaacattttcatcaccccgaaaggaaaccccatatccattagcagtcactcctcatttcccccaaacgctacccctggcaaccatacatctactttctgtctctgtgggtttgcctcttctggatagatcatagaagtgaaattacacaatatttagtcttttgcggctagcttgtttcaattagcataatattttcaagatttataaaattagcacttgtcttaataacagggtatgagacagttaaaaatatactcaggtacacatcccaacacctggcctacagcctgctctctttttcatttcctttttctgtaggggtggggagaaggaagctaaagtgtttatatcgaagtatggcatacacacagtaaactgcacagatcttaagtacacagcttgattcctcttgacaaagagaatacacccttataaccatcactcctataaaaatacagaatgttaaaaccacctcagggccgggcacaatggctcatgcctataatcccaccacgttgggaggctgagacaggcggatcgcttgaggccaggagttcgagaccagcctggccaacatggtgaaaccccgtctctaataaaaatacaaaaattagtcaggcgtgggtagtcccagctacctgggaggctgaggcaggagaatcgcttgaacctgggaggcagaggttgcagtgagccaagatcgtaccactgcattctagccaggacgacagagtaagactatgtcttaaaaaaaaaaacaaaaaaagacggctcagatggtcccctcctaagtcatggccctcaccacaggcatttcctaattttatttgatttttttttttttctgagtttgtttccttgtgttatctattaatacaggtagtaagtacgtggtcccctgagcccgggagacctttccccagtactccaggcctcagttacctgcgttcgttaatgttggttcccagggaaaacaaagcagcaccaagcactcaggacccatggcctcttcttctgaacccagggactcccatgcctttgcattttctcctcgcttttgtccccagctgtccttctaaacaccagcaagctctcagcacaggtcattacaaaaaacagttcaggggagtggggcgggctgtagggggagcattaacccccgtcagggacaactgggggcaaatgttgcgctccaaaggcagatgttttgaggaggactcctaattgtgacaaaggcagcccctgcacactggatgctggccagcctctgccattaacacgcctacctcctcactggtgtgatcaaattggtactgctcttatgaaattatgtgtgttagctggctcttcagaaataaaatatcttttcttaaagaaattaaggtttcattttaaattgactttatggcctttgaaaaactttagtttttgtgtggtccaaagctataggttagcattagcatttaaatagaggcattaaacttgcctgaagaccttcctctcataatgtagccctttctgagaggttttttcaaatcagatactttttcgtcctaaaaaatgaatgcaaatgctctctatatttttcccctcaaaggccttttttctttatatgtagacttaggagagccacattgtggagcagcctcagtattagtctttttgtatggaaagggccacgtaaaaaaaaaattgctattctctcctacaatgcctgattttctctgctgactctcaggatgtatttgcctatggttaattttatcctattgtatgtcattccactccagacaccccccaaaggcacaaatccccattctacaactaagaatctaatgtaaactcctgctatgtaacagtgactctaggagttcccagtgtccccagcaaatccccatcactttagtagaatcagagcttgagcttttgaactggatgaactagagtttgagtcgtgtccatcacaaggaggttttgtgaccttctctgaccctttatttatctgccaaattaaggttatcaagcctttcttgtatgtttgtcaagagtttaaatgagatcatatttgtactcctgatttatactctgtgctcttaggtcctgtaacctaaccggacaggttcttcctgcctgctgcacaaataaagaccatggccttgcggtaaagaaagagtttaattgatgcgaggctggccatgccacacagtagatggagttgttactcaaatcaatctccccagaaattcagggatcagggtttttaaagataatttggtgggcaagggatcagaaagtagggagtgctgattggttgagtcacagatgaaatcatagggaattgaagctgttctcttgcactgagacatttcccaagtgggggccacaagaccagatgagccagtttattaatttgggtggtgccagcagatccactgagtgcagggtctgcaaagtatcttaagcactgatcttaggtttaacaatagtgatgttatccccgggagcaatttggggaggttcagaattttacagcctccagctgcatgactcctaagccataattttgaatcttgtaggtaattttttagtcctgcaaagacagtctagtccccaggtaggaaggggtttgttttgagaaagtgctgttgtcatcaaagtttaactataagctaagtttctctcaaagttagttcagcatatgcccaggaatgagcaaggacaccttggaggttagaggcaagatggagtctgttaggtcaggttctctttcactgtaataactttctcagttacaatttttgcaaaggcagtttcagtccccctccctcacatttcaaccagaccagttgaggagtaggttaggaggaacctttgagtaaagggtgtcctcttatttcttatgttctcactgctagccttctctttcctttcagccaccggcctcatctcagtaaagttgtgtgtattttaatggccccaggtcacatttgacctgaaggagacatactagaggtgagagcctgatgtgttgttctttactgaggtgctgccatccttctctctttgaggttgattttgtttagctacaagcttggggatgtggagttgtgaggaaaccttctagaagattggcgtggtctggtactagaaaaaaaaaatagccaagttgcccaacagtctgaaggctttcttaccctcaggtccatcctccatgctgcagctggaaaggtctttctaaaacagttgtcatcatgtgtgacttctttctaaaatcgtctgtttccagattcctccctgtcattggttccagattccagggtgtatgtaaactgaaactgattgtcctcatctatacgaaaattagaaaaataatgactgtactttgtgagtttctcataaataatgactaaaagtttctgagtttcccacacaataaaacatgtaacctttttgttctgagattattttctttccacttaaggagtgttaaaataccttcttttatcaaatcttggtaataataaatggtaattgttttgtttgaataatctaggcaaaataaagcttaattcaccttcatccttccactcacccatgaaagtccaaaatcttagcatggcccacaggtctgttaggctctaggcccagcttgccttgcccacctttccccttccttgctcttccccacaccccatgcactccagtgaggaataaaccacttgtcgttttccccaaataccgtattcttcctactgtcccacccagttcacacattctgtttcctttgctcgtggaggactttatttccttcatatttgcctcattgttgacaacttctccttctctattaagccttccctggctgctctcagaaacctacagcccttcctgcctgtgatcttagagaatctcctccagacctttattatggccactgtcacattgctataagtacatacagtgcctggctactttcacaccagactctgcatcgccagagaacaaggactatgttttacttacctctgcatccacagtatctactgtatactacctggtttgtcattgatgctgaaatatttgttgagcaagtaaacaaatttaaaaaggacttcgaaagggactatataagcagtgaggatgatacaaagagtcataagacacagtctttgacatcaaggagcctacagtctaggtgaggttaataaatactaataatggtacatccacacaattgagtactctgccaccattaagaagaatgaggcaggttgatatgaactgaaatggaaccttctccaggctctattgttaagtagaaaaagtaaggtgcagaacagtatgtaaacaccatttatccttagatatatttgtgtgtttatatacacacacacattcaagaaagactgcttctatatgtataaaatatatttggaaggataccctggaaactagtaatagtaattgtctctaggaaaggaaatggtgggagagaggctttacgctatatgcttattttgtaccattatctttttacgtaacaaaaaatattatgtgccaggcgctgttctaagcactttataaatattaacttgcttagtcttcttaacaattctatgagctaggtgctatcaatatcctcattttacagatgaggaaactgaaggcttacaggttaaataactttcccaagttcacaaaactagtaagtaaataccctagtaaccttttttattgtatcatcagctcaaaaagaatattaagagtttttttttaaaaaagatatgattctacaggataaatgttaagtgggttacccatgcagtaagtgacagagaagaaataaattgctcaggatagcttcatagagggtagaggatttagcgattttgaacatgaagtaggctctagatacttagagcccaaaagtactaagtattattcaggggacagtgagtagctcaatttggtttgaatggcaggttgaagcagggaagaactgggagaaaatgtggaatacaggtcaagtctttaaaaggccttggatgtcaatgttgaaagtttggacttgattctgttagcactagtgaacacacaaggttttttttttattattattaaatacagaatagtgatatgatccaactaagaactgggggttagtctaggaggagtgagtgagtgaggtggccagttaagaggcaactgtaacaatccaatgagaagagtgtaggatctgtgatagtgagattggaaagaagaaatgaatatgaaagatgttgcattgatagacctggtgacaactggaccaaaaaaatgaaggagagtgaagattccaggtgacactgagattttgaggttttgcaagctagttccgttaagcaaaattcagtggctagggaggccacctgacaagggcagctgatagaaatgtctgcagacaagtgaaaatgacgttttgatctactgagaaaccagatcttgagaaagacatctgagcattatatatatgcacagataagactttcagaagcagagagagaagaatggagggcccccacctgactggcaggaacacctgcagcaggcagacacagagccaatagcagaatcagagaagaaactcagagggagctgggagaagtgccttaaaaatgtggcttcatggggccaggcactgtggctcatgcctgtaatcctagcacttcgggaggccgaggcaggtggatcatgaggtcaggagttcaagaccagcctggccaagatggtgaaaccctgtctctactaaaaatacaaaaaattagctgggtgtggtggcacatgcctgtaatcccagctactccggaggctgaggcagagaattgcttaaacctggaggggcagaggttgcagtgagccgagatcgcgccgctgcactccagcctgggagacagagcgagactccgtctcaaaaaaaaaaaaaaaaaaaaacttggctacctgggccgatgcagaggctcacgcctgtaatcccagcactttggaaggccaaggcgggtggatcacgaggtcaggagatcgagaccatcctggctaacacagtgaaaccctgtgtctactaaaaatacaaaaaaattagctgggcatggtggtgggcacctgtagtcccagctactcaggaggctcaggcaggagaatggcatgaacccgggaggtagagcttgcagtgagccgagatcacgccactgcactccagcctgggcaatagagcacgactccatctcaataaaaaagaaagaaaaaaaaatgtggctccatgacagttgggttgaggatggaaaactgtcaaggaaaagaggacttaggaaaagctgctgtgcgtgtccatgaagacgtcattgacgacccttttcatagacacattggaggcttagaaaggacaggcagtgaatacaaatgatttgttcaagaaattcaacaatgaaaaggagaaaagacacgaggggagagatggagtggacatgggatcacataaagggtttggggtttgtttcttgatttgtttttccaaaatgggagaaggaggatgtttgaagcagacatgaaagaaccagtgaaaagggaagatactggatacaagagttaaaaataaaacaaaaacccagcagagtcttgaaagcattgggaggggtgaggatcaaaggcatagggttaatcttacaaaaagaaaaaaagaaaagaaacccctcttcttctgagtcaagagggaaggactgattttttttttttaatgtatgtcagcatggaggatgtgatacctcatacaattgtgagacccatagagataatatatacatgaacaatggccaatacagactacagaggaggatgcaaacaaagttagcagttagttttatcatttgtattatatcacatagcaggtgttctatcatatcatttgattaatcttcaaacctaatgtgatgtaatattatttatcccatgcttaaatgaaaaaactgaagttgagacaggttcagaaatttccagtcatgcatcttaggtaaaagatgtgggattcatgcctaaatctgccagagaatgaaaagctgagaaggattacagatcactagtgaaaacacggatctctgttgtctcccccttttccattagcgaccattatcctgaccatctccccccggagttacatcagaataaccctttgtgttttatacagatcaattatttcattcatagttcctcttttcccagtgtcagagaatcatagactgctttttagattgtatgccatacttaatgacatgtatagactatcagctgtctcattcattcattctttttcatttactcagcattcactagttaccgtcttcttaggccaaggggtaggagcaagttgaatatagaattcagccctgctctagagaatggcgtgaacccgggaggcggagcttgcagtgagcagagattgcaccactgcactccagcctggacgacagagcgaaactccatctcaaaaaaaaaaaaaaagaagaagaattcagccctgctccagtagaacctgcattggaggagggggaagcagatacttgtttatgtactaaatgcttctacattcttactctgtctagccactgctcttaatcatttaagccttggaacaaccctatgttactatttccttttctcagatgaagagaataaggcacagagagattaataacttgaccaaagttgtacaaataggaagaggcagaattgggtttaaatcccaggcaactggctcccgagtccatgatcttaaccattgtatatgctgatgaaagtatatctgattttatatatatatatttaaatatataattttaaatatattttggaaatatattttttagttggagatgaatgctaaaaagaaaattaaagctcatttaaaggacaaagcttgatgaggatggagcaagtaacatttaaaataaggtggtcagggaaaacctcacttactgataagcagacatttgagcaaaaattgaccagaatctcctttaatcttctattttcctccaacctcctgtccctttaatcccatctgatcctcttttctgattttctttcagttggcttacagtataaagcaaaagaagaactatgaagtacaacaaagacaaattaatgtcacttccttgctctatagctggtactttttattttaatttattttattttttaattattttttctaagatggagtcttggtctgttacccaggctggagtgcaatgccatgatcttggctcactgcaacctccacctcccaggttcaagcaattctcctgcctctgcctcccaagtagctgagactacaggtgcgcactaccacgcccagccaattttttatatttttggtaaagacggagttttgccatgttggccaggctggccttgaactcctgacctcaggtgatccacctgtcttggcctcccaaagtgctgggattacagaacttgtacttttaaaataggaaataagaaatgctctggttccatggcccttaacacccaccccaacacacccacctcctcctcgccacccagtgaccattcacccacctgttctaaggtttctcccaactattgaatgaatataggaggttagaatttctcctagacaaattcacttgggtttttctaagatgactcccctttcattacttgcttcccataattccagatttcctggagtccttgatgtgatttttcctttcttgttgccattcacagcccctccccgttcactaacattggcccctttcaccactctgtatcttcctgtgcattaatgaaggtattaagtgagatcagttctaaagccagcatccttagaattcactagatgcttcttttctgcatttgttgacttgccgttctcattaccctctgtttgtttttcagcctgtgtcctatcgagggtagccattcagaataaattcattttgctagttatatttttctagaggcactgcatcaaacggttcactgacattcaaatacgtatcagccacagtagtcttttcatccaccaaattcacattgttatccaaagctatccatcacgtttgtcagagtatttgggtctttaattaaacctgctggatattgttcatatttccattagctcctttctagttagtctattatttttctaattgacatctgttctgagtcacatgtccttgaatttcaggtggcccattttgtagctttggtttatttaggttttctctctttcataaattacctaaggatttagttaatacaccctcaagtgtttgccactgggacctgctgatttacatatgtttacgcttctcaaataatccagagttttttggttcttctacgaaatcattttcctttgaggcccttcagtcctgtaagaagtagtcttgtgtctcagcaaggcagagagatctcctacaatttcaagaactgtactagagtcactaaccaggaccagaaggtcaggaatcagggtttgagtgactcaaccaagtgatggctgaatagcagtccttgcgtcttaagactcccagaggctgtagtgggttgcagtgaactctccattcagcctcccccagccctgtcttaacatcattgtgaggtagctggctaggggcagagtcaacggccaaaaaatagaacgaattggcacctgccagaatcaaccattaccttggcctcactggcatcatgctcatcacgctttcgttgatgggagcatatgttcccatcaaagccatgaagtccattcctgttcccactgactgttctcctcacacacccacaggtagggcaagatccattattataaatacagaaagcccattacccattcacttcaccatctcatttccaaccctggtcgtcatttggagcagaagcattgtttttatcccttgtccagggcactccaactctttgtgcctttcttatgtaccaggagacaagggcaggcagggagactgccaagccctagttttgctttactttaaattaaaacatttgcttcatgccttgggtatttttggtctgagcctggattagattttaaaaataaataaataaataaagcttcttgaagccaaggactatacctttctatatcatattaacatttaaaatgttattagagtttcctaagcattagtaataacattaggttttgctttgaagaaatcctttgcattatttattgaaaaattaataatgtgattttattactaaaaattgaaaaagccgtagggcctctcagcagttgtttcccagattgctaatctgaaaaatatagataatatacactacaagagtcttgtgctaattgggttaaatgatatgtagctttgtggtcactaaagtatataatacaatgtcctttttatcaccctatgatattagataaattgtctttaaaaatcagaaagactctctaaagtgatatttgatgaactattttcttaaattgaaaagactctaaagtgatattcagctcagaatagcactccttaacctggactcaccttttgataatcaaaagaacatttacagaagtatgagacaaacacaattatgaaagtaaaatgaaggccctaaataaaaaaatcacagaacaagagggtaattctattcactctttcatatttcattatttgataacatcagaagatgaatccatcagaattgccttggcaagtgcaaacagaaatgtgcctgatcaatatttataaaaaccttcaaaatgggagaaggagttgagcagacttcttaatggactgaataattattcatacaaatggggtttgaccaaaggcagtgccagaccaaagagacacagttttaattgtactgaatttaaaatgcagatcttcctccagcccttttgtagaaaacttaatttaaaaaattatctgatgtagcagagagtgacatatgaatccttaagttgttgaagaggacatgtcaaccatagatatttataaatttagaacgtgttccaaaggtggggagcaaagttgctagctaagggaacaaaaagaaattttctccccatttcaatgactgtaactgagccaaggagtgtgtcatcatctcaacggtgatgggaatgtcctggaggagtttctttgtttcaagtggttttattatctgaagagaaataaagcaagtctctggctgctgctgtctatcaaaaatgtcaggatacgttcctgagaggagtgaaacagctgattttaactttcagcgtctccccaggagaacccccacccccgcagtactgctgaggcgtgatggttatcaggacaaggccaagaggtaactggtaactgccatttaaggatagtgccattgacaaagggtaggtgcgtgcatgtgtcactatatataaaaaacaggtaggtagatgaccgatcaaagaagaccgagcaagccttaaagaacagactcccaggctatctttacctcttgaatgattttcttctgccaccagctgagggaatataagcaatatgttttctaaagaccattattcacttctagcgtgtcctgatcagaacaaaaacctatacaatccgttgtgagaagtgtaaaaaaaaaacaaaaaactgtcctgatacagaatatatacctaattgtgccactaactgtctgaaaattatttagcttttctccaccttagttttctcattcctaaaatggaaataacttcagctcattttaaattagaattttcaatcatgtttgtaataaactttaagctcttcgaaggggaatacaaataagagcaattagattatactttttaataaactaatttattcttctgacacacaggattaccatccattttattattggtcggaaagtccatttgagctgagattacacttgttcagagtgttttcaagtcaattgctactgcgtcttgtctaccattgcttgaagaaaaacaacatcagctaattctgatgggagccccatgattttgaaggaccaagcaggggacgctgtaaaggtttaaaatccaaaaatgccagtgcttttatatagcatctactgtaacctttctgttttggacatgagaaatagatccagatagctggtggtatttgcccaaggtcacatggctagttagtagcgaagaatgaaagacttaaccagaatctgagtttagttgatctcttaaatatttacctcactaagttgttctgctataaccacaatctctcaattatttatgggatgattatctggtttatgggttattcttttttctcttgtcatttccctgttattatcatagataccattgagtggctggagaaaacaggagttcactgcttcacttgacaacttagtgacccatctaccattgggtttttattaaagtgctcaaaatgctgtagatattggctaaaaataatgttgggagctacagtcaatactaacttttattcagctcaatttttctccctctcaaatttgtatttcagaagtcagattcagcacagaattcacttgttgacattaatactagagctttatcttgggaaggactacaagagaaagtctttacaatgaaaataattatctcccttccccaaaaaagtactgaatcagagggacagtcaacttttggaaagaaaggttacttcatccattaccaacttgaaggggcaaaaagggaagaaataaaaagaggtgacaaaatgaaaaagccaaaaactcttgcttgtaaactcccaaattaagtgttaaatttacaacatgactgcattacttggtttagagcactgaattcccagatcaaatccagtgttgttcagatataactgcaaagtttgtacaaacgaatttgaatcaccacaatactggctcattgcattacaaagaaagagctgagtatgggaattttatttaattcatatttgtgtactcaagactcaaatgagtcagcgataaaaatattcttttcagttagttcttttgctttttatagtttcaaatatttttgtattaaggtggttttagagtaaatacagggctcaaaagtctttcattttgaggccttagacaaatcactaatactctgtagatctcaattttctcatatgtataacgtagataattgtagttcctatttaaaaggattgaaatgcacctaaaagctagacattattattaatattctacaatcaagacagatttcaaaacccagcatgagacgtagctgtatattttaaaacacagtttccattccgggatctaggactctgaattctaccaagtaaaggaaggcaaaaggcaaagctttcctcagagaccttggacagttccccagtcagggccttgctgtcacccctacaggcaaagtttatggaacgcctacaagtacaggaacaagagttgccatgggcgggaatagtttatgttagtgagtatttcttccctcaatttgcaaagaagggaactgaaactgtttctaatcactttcagagatgcagtactaatttttgcactgagtatgccaacttgggaggtagaaccagggatgagaaaactccctggcctcttgtctatgaaaatttatgaaaagctcttaaagagaagtcagaaaagcactaatactcaaagataaaaagatatcaacaattcatttatacatacacgcatacctacatacattaaaaacaaataagtagatgaaaaattgttccacctcatgcaaatcaaaagaatgtgagttagatgctgcccatatgttgttgataggaggataaattgatagagcttttttagaaagcaacttggcagcattgtcaagtgtcctaaataatatacttatcttttaactaattctgtttttagaaatctatccatgagaaagtaagtctttataattggaaacaattgaagtatccaattgtgtttcaacctaaatatttcaactataagaaagaaattggctagaacactacatgtggtgggggcgaactacaagaaaatatgccaaactgtggtttatctttatgatgaaattatgagaaatctttctgtatggcccatatattctatatggcatatgtattaactttccaatcagaggaagataaaattttgttttaaaactttaaaaagatctgcccacctttccaaaataccctgtatttccttcctggtagaaatgttttcagacagaatgtatgggggagaaagagtcgcagtgcaataccattaaaataaagcacaaaagaaaaagccacagagaacagtctgttgataaagcaaacatgaggaagataagagaaaatgatctgtttgcaccagaacaaagcataaacattgttatgttctagactctgcacatgagaccagtctgtgaagtcacacctcctcttctctgtcactctactccctcacctatctgcttataatactttgggaactgctgcaaaaaggcacacagcaaagggtaggagaagccacagcaaggtgcacatctccttccagaatgttccatccagcagggtgacttgaaactctttggtctccagaataagatatttggtgtacatctagcaattgactgctgaatattgtaggctatgaagagtctgtgaagggctacaaaccatgagccagaaaatgtctcaatcaaatgtgcattcactgatcccatccaggcagccccagcaaagtgtcatcaaatggaaaatgtgttgccctggaagccacggctgctattttaatgctcgatgatgaagaccaagctttcaatttcctggggcctcaataagtgctgataaattatttatccctattgggtgacatgatttcatttcagtctgacagtgtttatcatggaagctcattctaatggtatagtttggggcatttttctattttctctttaggacacctggtagcaccctttccccacctccaggtgaaactgttgctgtgtcagtttagtcatctttgctcctgggtaccattctgaaagataaatgaatttccttctgtctttaaatatttatgattctttatgatctaatatatcagcatggttatggaggaattttttctctctaactatagaaaatacaccatcaattacctgtcaattttgttgaataactcagctttgcaattcaggggcactgttcatacgaagctcttgaggactcttttagtctctcagtccacttcagactgtcattccgggatttataaaggtcttcattgcacagaggatattgaaacattaaggacttaagtggcatgccctttatcactcatcacactgtggaagatccaagagtagaaatgcaggcatctttgttttgttgtttgctcccagcgtggaacaatggcctctgtagaaaaccagccagtatccctggaaacaattcatcagatttttcaaaagaaatccaatttcatctggcatgatgggctcagtgttgcttcttaagataaatgataaaaatatcaacatcctaatacaaagaaatccagttcttttggtttaatctcagtgaaaagcatcacaaaccttttattgcttctgtagccttctctgatgcgtttaggtccttggttgaaggagacagtggttctgtaactgttggtctaccaaacagactctgactgagtcgtggctggttcagaacctttaagaagcacatatctggggatggggcctcaggaatctgcacttttcataggcgccccaaggtaattcttaggtaccctaaagttcaagaactgcgagtctagaaatcgcagctttcaagttccttctagctttgaaagaatcgtgagccccagattcactctcatttcatttggtaaatctcgatgcacgcatgagctcttcttgggcaattttaaaaatgtatattcttaggaagttccattaatagacaactccctccatcacctgtgcatctacaggaaacagaattagatgacatagggcatcatttcccaaaataggggccaatatcagtgagagccaggggacatgcagagctgtaggataaatattaatatgatgcttcttcctgcagcatcaagtttttcttagaaacagtgtgtttaaattacagcagatacattaaggagtagaatgcaaagttcacgtgagttttatgctaaacatgaaacttcaaaagatttactgatctggcactggggtctcacacccctggaagtggagttttatctccccttctaccaagtatttctgtctatattcagggtcaccctggaccagtgattgctatgtgtctggttctgtgatgccaaaatgaacactcgtttaaaaccactatagaaaattagccccctgtacacaaggatgctgactgatttgcttgcaggagagcttcattaacttaccaatctacaaagagcactttccatttctgccactatttagagtatattcacaaaagattattctctcccctatttttaaaagagtgtgttagttagaaaaggaggcttagcaggaggaaaagaagctaaccgtgtgaaaagacaccacaactcttcctgaccacattccccttgtaccagcaattcaataaaacaggcctgaaattatggagctcctagaatgtatttcttaccacaaagatagcttcatttccccataggaggttctttttttcaaaatgttcctgatgagaaagaaacaaattcacggccctgagtctaataatacaggatttctgagccactcatcctgctaggtctggaagattgcttcgtctccaagagttgccttgagtgcactgcctggttctgtcccctcgatcttggcaaagttacctttcacgtcagagagaagtgagtaacactcttcattttgctgacaagctgtgataagccttcctggctcagagtctgtgttgaacttgacctcctgggtaatttggagtggccatggaagtcacagcttcagagtccagtagactgagagatagcagtggcatagtattggtttaaagaatggtgagtggtcatcttctccccttcctgactcccaccttcatcttcctgctgcattgaagaatccctataatgcatatttctattacaggcacaagtcttcctccaccaaaggacagagccaggccaatggccttgccgttaagtggctctcaagtctcctctttctgctagaattgtaaccaatgccctgccagaccattctgcgtttgattgtcacagtaatcttccagaagcacaattttgaatggcacctctgctctctggaagaaggaagtcctttattggcttaactaggtctaaaatcatagcctgatgttcagaggctctaccctgtggcttcaaatgcctcatcccaggactctctgctattgctctgcactccccagtctaaccagattattcttccatgcctttgctcatgctcttccctccaactagaatttctttcctggaagccctgcctgacagaatcttaccccacaggaagtcttcctcagtcccacaccatcccctcagcatggtgcgatttctcctcctctgctattaacgcacggtactaggacctcacttatggcacacagaatattcttgtgagttgtcaagtgtccgtgaaaaaacagtcttgaacttagagtcagaaacctggggtcagatcctggcatggtcagtccctgtctttgtgatgtgggcaagccctctaacttctctgtgctttcgtctttgtatctgggaaaagggaggtgtagcccctgggtggagtgaggggtaagtggcacagtgctcgggaatgaacttggtcaacagcactggaatccttatgtctctgcttttcaggacctttcctccttgtctccgagctacttgaggaaaggggctgtgtcttgcccatccttatatactactattaattttattacattactgtcacacattagcatcattatagttctaataataataatctttatgaagcaccaccattctgagtgctttatacgtattaattaattcaactatttcaataaccccaagaggtaggtactattattaacccactttatggagcagaaaaccatgtacagtattttacaaaacctccaatgaataatgaatgaatgagggattgaatgagacaaaacctgttaacaatgccttctctccttcttcaggctatacccctacttttctttcctttctcccaaggtaaatgcaaaattagcaaaaaaatgtagaatgagctgagccacagaaaggtatgcggcctccctgggtcctcacttagacttctcctgaagagagctcccatgagctccaaaggacagagcttatggttgtcctgttctttattctgttggtggggcctagaacactgcctgctgatcaatcgttatgaagtaagtagaggaatcaatgtatagacagcgtatttgtcccctcgagacgacgttaccagtggggagccagtgagcagtgttctctcttgctttctcaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccctgggacagttttgtatgctgtatcttgtacacaggttgtaggttggtttattgccattttgttttatttctgctgtataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaa

SEQ ID NO: 272 - DNA, 231124 bp, Homo sapiens
ttccttggagcctagcggctctccccgcgtccaagatggcggcagaagcagctggtgggaaatacagaagcacagtcagcaaaagcaaagacccctcggggctgctcatctctgtgatcaggtgagggaggcaggaggcagggtctggggactgggggcagcggctcgacctccgctttggaagggagaagggttagctgggtcccaccctgctctcccctttcctccttgcctcccgcagcccctccccagggctctaacccctccccagggccccagcaattccccctccaccttttttttctggggttagctatagagagaggagccccgcctcagtcttttctttaggggcagcaccttctattacagtctcgggaccccaaagcacgctatttgggtttggtagagaaaaccaggtgtaaaggtgtgtttattgattcctaaaatgcttgtttattgtttgcctgtagcagcactcactgagaaaggcgtcttgtttcctggactttggggtgtaaggccttggagtccggagattcctgtcacgagttgcagatttgtgttttcacactctggatactttcaaccacctgtgcgtggccacagccacaaatacaagaatctgcagtgagctggtaggaggactgggtttgaaggcacacatcggttttcaattttttgccctgcctccgcattctggtccattccttaaaaaacagaaccaaaccaatttcaaattatcctccatgcactgcccctctgcacctcccagaagattagggtgggggtggagtgggagcggtggatcttttaggagcttttttttaaaaaagcgaaatatattgaggatgggggaaccctttcaagaatcttggatatgatgcaggtactgactaaaaccaatctaaataaaatttattatggcacgttttttacgttgttggcatttgaatttcaactcgtttatttttcataaacaaacactctatttttccccacctatactaaacttttgtttgagttcttgcaagttttctggaatgtattgatcatcttttcaaaacccagggcccaacattatctggtaggtactaagcacttcaatgaatgcatgtatcaaaccattagaacagcttaccactcactgacaaagacacatcttatgggtcttatttaggaggctttaagattatggcctattaaatcattactttaattttcttttgggcttaagagaaaaacatctctgtgtggaaatgcttaatatacttggtaggccatacagaggaagtgctgttgtattgtgaatctataggcccacattctcgctgtgacaatacgcaggtagtgtagatgtatctcatgatactaaaattccaataagaatgtttgttgtttcccatctgaatttcctgtggaattagaataccaggacattatttggatccttttttgaacttgtttgttttttctaccttatagtcaacatttatttaaacaataggtatttagtgccagttgacagtatggcgtctggcacgtattacatattgaataatatttgttgacttaatgagtaaatgccctgagttttgcaaagatgaagcaggcacagtgttacccttgaggagagtatagtttacctgggggataaaacatgtcagtaaaaatgatgacataagactacgagagagacatgaaatgttatggaaatccaggaggagtggctgtttctaatgaaagtgaaatgtgtcatctcatctgtgtacttttgattctccaggctgttcccatttcttttatgctatttgtattttcctcagggccagttgaatttactctaaatgtcatatttttgaaaacagcatgaaagccaacctaaagctttttttactaatgctaattcagaacatacattgcctttgcttgaccattccttaatattctccaggaggaaccccctactgcttgatggctaagattttgtggttatccatccatctcttatgccagtttattaatatatgaccttcattttatcactgtgatttaggcctaggtattttttactttgatctctgttgtgcattatattgcttttcttttcttttcttttctttttttttgagacagagtcttgctctgtccccaggctggagtgcagtggcgcgatctcggctcactgcaacctccgcctcccaggttcaagtgattcttctgcttcagcttcccgcatagctgggattataggcgtgcgccaccacacccacctaatttttgtatttttggtagatacagggtttcaccatattggccaggatggtctcgatcgcttgaccttgttgtctgcctgccttggcctcccaaaatgctgggattacaggcatgaaccaccgtgcccagccctcatttttctactttatccttgaccacctcagatcactgcataacacttttgtgatatagtttttacaagcatggtgtaagggaatgtctagacctagtatcctgggcaagtttattaaggcttgggatgcattgttatatatgaccttaagaccgaatggtgttggtgtttgtatttcaacatttctttgagtcacagggagattttggtgttggagtgaggatgttggtagctataacttcctgttatttccttcctaatatgcttttgaacatacccagtggtttaaattttataaacagtggtagtgaatgagaggacaatggaagtattactttggtgtttgggatggggaatggggggagagtcctgcgggtaagagaaccaggaatgtatgtttcttgttagtaaattgtgctgtcacttggaagttgcttcttgtatttctgttcaatttatgtcctttgtgtttcccttcttgcaacattgtattcattattcctttttttttttttgagacgtagtcctggagtctctctctgtcgcccaggctggagtgcagtggcgcaatcttggctcactgcaagctccgccttccgggttcacaccattctcctgcctcaacctcccgagtagctgggactacaggcatgcgccaccatacccgactaatgttttgtatttttagtagaggcagggtttcaccatgttagccaggatggttttgatctcctgaccttgtgatccacccgccttggcctcccaaagtgctgggattacaggcgtgagccaccgcgcctggtctgcattcattttttcttaattcctcatataaaactttgattatctcctcctatctttaacgttgttttcaaattctctcccaaaggctatagttttcctggttgctttggcaacaagccacaaaaaggaaaacccatgttaggctcgtgtttataaggtctgagcattcctaacatgtaccgggtacctgctagctcctttcatgtttccatggacttattttgtcacaaaataaattaccgacagttagagagtctactgtcttttgaaaagtttgatcagtttagctttttaaaaaatatctttttgtatcactgagtagtagtttttcttttttgaatagtgagtattaaaaatgctcctttaattctcttgctcagatgtgtaaaaatgtaatttctgtactacattatgtatcataaaattttgtattttttcaatgcttttcctaacagttggggtagcatttattgttagtcatttttaatattgtattcaaaaaactacaggtggataagggtttgacttaaggacagagtatgtgtaggcatggggaatatccgaatctcatcgctatttccagcccttgtactaaatagttaaataacgactctattttgctagtataaagtatttaaactttaaagcatttaaaagccaaaaataaagatgaagtatagtgtaattgtaatgcaagtattatatgattttttaagtgctttgagactcaaataaaaatgcttaattatttaaaaattatcgaataaaaatatttcagggcagtcagatgtttcaaagggtggacttccagggctttacagaagaggcccttaggcctgtgaggtggggcttaggtgaggggacagatagtggttgggattcagtttgtcggaggctactgccaactgcagcttttggttttaagtcttgccactggccctttaaaatggaactaaccgggggggacagaatcctgattacgtgctgatgtgtgatgtatgatttggacagttttacacacacacagacacacacctacttttctgttgacctgctgatgtacaatttggatggtttacacacacgcacacacacacacacacacgtgcacacacacaatttttctacttttctgttgatttcctttgccaaccttttgtttggtgggaagtcagaggaggcagcctctctagatgggaaataagaaagatggcattttggagatattttatttctgtgagttcttgccagatttttaattgggaaatgtgtctgccacttactgttaggtgatttgctttccaattaaatgttgtgtcactttataacttggcctgtaataaccagtttaattgggaagacaactttggttgtgacttcaggagaccttattgaaaccttggagcagagcttttgaagacacactctggttacagatgtcaaggaggtttgaaggcagtggaaggctcacattttcatcaacttttatgtcttcacagaagttgaaatttcaaaaacttagaaaatcctttactgtagacacctgttaaattcccttcctccttggagagtattttggtcagccctgtgtttaattcaaagtaaactttgttgaaggggtccaggctttgaccagggctttgaacgaacagctttgaggttcgtgacacagtttgtggcaggaaaggaaagtagtcactctgttctgagccgagtcttggaagttgggtgaggtgttaatgttctttccatcaccatctcttcttttcatttgagcccatcacataatggtgtttggtttctagctctctttgtaccctgggacatcttggccctactgatgctgtgttgtttgaaaattactactagaatacccagaaacagtgctttcaggaagtcctgggatgtctggcagcatatgtgaacgtaaggggcaacacaattaccgtactctggctcagaattagtgtcgtggacccatgtcttagtgtacctcgtgtaactgttaacactgggatttcctgaaggctttgaggcctgtagtattgatggtggtggtatggtcaggttttttcaagccattatttgtacatagatgtggtcacagcctgtggtgtgaattgctgtggttgtgtgttgtagttgaaacttgctgtattacctgtgtaaccttggaacagttacttaaaaccaccgcgtcttagtttcctcatttggaaagtgggctaatacaatctgtgtttttttggaacatcacatgagatgagggtatataaaagtgcctagcacagtttggcacacggtaggcactcatatgttcatttcctcctttctaggatctgtagcctcttctgttaagaagattcttttgatattaataaatttgccggatagcaaccaggctataatgttaattttccaccagaaataaccttgacgcgttgactggagtgattccatttgtcaggatgttgtctttgtaaccaggaaatcttgtacagctgaattaagatagtaattatttggtaatttgagagtcagctgaagaagctagatttaaatgcatgtatggttatgtgtgtatgtaaaacatgtaaaatataaacacacataaaatataaaacatttattagattaaaagactgaaaagactataaacaagcaaatcaagggcccaatactctgttgagataatccttgttgtcctttataaaaaggacaacaatattgtgtattgtacaaatttgtaaagacgagtcataggaacattgtccagcaatctcatttcccaaaatattacctgtttttcaggttttcgtatggatcttgtccatgtatatacattttttaaaatattgctatacagtgttcatagttatatatgttttttaagtggaggaattaaacatacagaacagtagggaagaaaaaatcacccatagtttaatttcttttttttttttttttttgaggcagagtcttgctttgtcacctaggctggagtgcagtggcgccatctcagctctctgcagcctccgcctcctgggttcaagcgattctcctgcctcagcctcctgagtagctgggattacaggcaccatgcccagctaattgaatgtatttttagtagagacagggtttcaccatgttggccaggctggtctcaaactcctgaccttaggtgattggcctgcctcggcctcccaaagtgttgggattacagacgtgagccaccgtccccggcccacttgtattttcttcaccagcattatccactattaatacttttgcttccagtttaagaaaaaaaaaatcactctattgttttaaaaatagtactctcatgataaataattcaaacagtgaaaatgcagaaaaccgtgaagatgaaagtaagaaaaattatttcagattttatcctcctaaagttattatcattgatattagatgaacctaatcccagacccctcccttttctatgtgaatgtatgtgtgtatatgaaatgttgatggccagaaataattttttattaaatatgggatcttactctatatactaattttatttgtcctcctttttgaggtatacatgtatatgctagagtgcacaaatcttaagtatatggcttgatgaatttttacctgtgtaaccactgtccagctggaaatacagaacacttccagcatcccagctggagatacagaacacttccagcatcctagaatgatccttctctaccagttttttccagtacttttttttttgtgtgtgtaaggatatccatttccaacaccacttgttaaaaagactatcctttctgtatttgctttcttttgcaactttgtcaaaaaccaatttactttatatgtgtgggtttatttcttgactttctagtctgttccattcatgtttatattgataacaatactgcactgtcttgattactgctttttaaagttatgaagacatagtgtaagccctttaactgtttttttttttttgtttttttgagacagagtcttgctctgtcgcccatgctggagtgcaatggcaccatcttggctcactgcaacctctgactcccgggttcaaacaattctcctgcttcagcctcctgagtagctgggattataggcgtgcgccaccacacccggctaatttttgtatttttggtagagacaggatttcaccatgttggtcaggctggtcttgaactcctgacctcaagtgacccacttgcctcggcctcccaaagtgcagggattacaggtgtgaggcaccgcgcctggcccctttaactttattctactttttcaaagtagttttgggtcttctaggttgtttgcattttcttacaaattttagaataagctagtcagtttctgcaataaaacctgctgggattttgattgggattaatatatggaattgacatcttaatattgagtcttctgatccatggatggatggtatatgtctccatttaattcttcaattgatctcagcaattgtgtgtgtgtgtgtgtatagattttagtgtctaggtttatatgtctttggtcagatttctattttaggccacttcaagttgtgctacagttcatggaatgttgatgttcattaaaaaatgcattctttttctcttggtgttttgttttatatagtttgtgttgctatgctggttcactagtcttttctgctattcctaatctcttgctaatcctatctaatattatttttatcttagattatacttttcaatctaagatacagaagcttatcttctttatctggaagtttgctttgggtctttttcatgtctctgcttacatgttttaacttttcctgtagctttgtgaacaaatggaatataggtattataacagttttaatgtccttgtgtactaattttatcatctgtgtcatttctgggtttccattgattaatttttttttccctcttcctttacatgccttgtagtttttttttttttttctttttgagacagagtctagctctcttgcccaggctggagcgcagtagtgtgatctctgctcactgcaacctctgcctcccaggctcaggtgatcctccccacttagcctcccaagttgctgagactatagttgtgtgccactgcgcccggctaattttcatatatatttttaggttttgctatgttgctcaggctggtcttgaattcctggcctcaagcaatccgcaggcctcagcctgtgagccaccacacccgggcaccttgtagtttttgagttgatgctagacattgtcagttttatcttgatggtggttggttttggatatttttgtattccactattcttgagctttgttctgagatgtggttaagttacttggaagcaatttggtcttctcaggccttgttttatgttttgctagttaggagcagagcaacatttagtctagggctaagtttgtctcactactgtgacaaaattcttttgagtattccactcagtaccctaagaattatgaaattttttcactctggcctgggggataggcactatttccagccctgtgtgagttcagatcattatttcctctaatcctttcaggttgttattttcctggccttgggtagttacctgtcacacgtgtgctgatcaatacccagctgatgaccctctacagatctgcagacttccgtgtgctgcagctctttcccatctccattactgccctgcagattctaaccaccttaatatgcagtgttttgaaacgggttttgtttatttgtttgttcgttactttgttagtccctgttgtttcttctgggcctaaagtagaagtccatcagtacttcttattttaaaaaaaatctctaaaagtactattttggattgcatcttctcagagaggaagaataagatattcagatgtgctgtttaaagcgatggcagctgggtgcagtgatatgtgcctgtagtcccaactacaggctgaggtgggaggattgcttgagctcaggagttcaagtcccattggggcagcatagtaagccatgaaataaattatgaccttggtccttatagtggccagtttttttttttttatgtgctaggggtttagctttgaaaaacataggtgtgtacagtttaacaggaagtaataagggaaaattcttgtattatatttgacactcttggtaagaaaataaaatatttcaagattcttaggagacccttttctgacttttatttattcttttaaaagtacagagtctttgtcaaaataaaatagaatataattaaagtgtttttccatttaaaacctattcattgtgctgaatattatgggagaattatactaaaaatatcacttgagagcttgttagaaatgcagaatctcaggtcctacctgacctacctgagctgaatctgcatttaaacaagattcccaggtgatttgaaagcacaataaagtttaggtagccttagaacaagaaaccccaggcttgaaatgttctcaacatatagaaatgataaatgttagtgacgatgaatatcctgaataccctgatggtttggctgtgtcctcacccaaatctcatcttgaattgtagctcccataatttccatgtgtcatgggagggacctggtaggaggtaatttaatcatgggggcaggtctttcctgtgctgttctcatgatagtgaataagtctcatgagatctgatggttttataaatgagagttcccctgcacaagctctctcttgcctgctgccatgtaaatgtgactttgctcctcattcgccttctgccatgattgtgaggcctcctcagccatgctgaactgtaagtcagttaaacctcttccctttataaattacctagtctcaggtatgtctttattggcatcttgagaacagactaatacacctgacttgatcattacacagtctgtgaatattacaaaatcacatgtgtgccataaatatgtacaaatattttgcattaattaaaagagatacaagaagccaattgtaattgttaaaatttttttttctgagataaacattatatagatatgttttttaaaaaagcattctttttttttttttttttttttttttgagacagggtctcactctgtcacccaagctggagtgcagtggtgtgatctcagctcacttcatcctctgcctcccaagctcaagcaattcttgtgcctcagcctccggagtagcgaggactacaggtgtgtgccaccatgcccagctagtttttgtattttttgtagacagggagtttcaccatgttggccaggctggtctcaaactcctggcctcaagcaatctgcctgccttggcctcccaaagtgctgggattacatgagccaccgtgcctggcctatttgacagatcttttaatttttgtacatggttgaaaattccataaaaatttatatgtgtgtgtgtgtttacatatgtatatgttggggggagggaagatggtgggaaacaggttgattgattgatgttttaatagattagtatattacagaagtgctatatattctttatgtcctcttccctctcccctagacactttaacaataacatattaaagtgtccctgatttctgcctttaagaaatctgcttcaatttgtataacccagaatttccaaaatttgaccacataacacctcttaattttttgtaaaacattgtttctgaggaactcaccagaaaagaagatcactgtggacaatgcttggagaaggatgtggggctgcaaaagaagtagaaaaagaggtagagttgggtgaagtaagagtagggggtagattttaagttgactttgtcaaccttgggctcagttttatgccttagtggggtgattttacttaatattagataatgacctttgttgcctaagagatttatagcttttggtccccagaagtgttctataactgagttaattgaactcttgaaaaactgtatgtgttgggtgtagtaattggccctaagtgctgtctgaagcaagacaccaatgaattttcaattgactttaaagcaaaaattgtttactgtcacttgatactaaatacatctctttgtattgttaggggatgttgtttttatgcatcagaaaactttttcagagggacttgtcattgtgaattgctatcaattgggatgggattatcttgtagtttgtgtgctctaataagacataattaagaaataagcaatcacaatgtataattgaatataataaaatgcgatttaaaagtgtaatgtagatttggttatgctttgagggaagccgtatcttatgtgattatatagtgatacacatcttggacatttctttaatgtgtaattttttacacattaaactcataattctgagtaactcagaattatgatgagggtctcttcttttcataattcactggaagcatttatagactatttgtcatatacaaaatgttctgcttagaataataggcttggaaaacttatttcttaacttgtttctttagtgcttatattcttaactatctcttttcctcttcagtttgtactttcactctattcatacttaggacaggcttttgtttccctgatgacataataggtatatggtactgtcagccatttctcagattggccctttagtattttaaaggcaaagagaaactgactgtcatactgtgaaattagggctgaatagatataataacttaatctaatgtcttctggttaaaagcagtttgggaaagaaaacaggatttatgttgtaaagaatcacatcagctctagactctttttttcttgcatcgggatgagtagcaacaggaatattatgttctggaaagatcagtaagctaataattacctttttttccatctcggagtgaggttctgaaactagtgaactcttcagcatttgttgagagtttatgcttagtttttgccttatgataatgtgtttgaatattttgtaactaaatcaggataaccccttctctatctagtactctttccattatgtagtttaagaaatttcactggggccaagatcgcgccactgcactccagcctgagtgacagagctagactctgtctaaaaaaaaaaaaaaattcactggaattgtcccaacaagagagaaggtagcacggattgggtggttcaggtgcttgatgagtagaaaaggcagggattcggtgacatagtttatccacttaggggcccattttgagtacttttaagaggggtcactgagatttgattcttattgtagattgtgctctgtagagctgttgcttcctgataagtgatttttggatatgtgaagctctacttgtaattagtttttctgagttgcttgaagggatttccattcattgttttgttcatctttattattcctggaggagaagtcactggatgccaacaaggaatgtctttagtagacaattaagccgattaactgttttcagaaagcatgacttaatgctaactattctgcaggtgtcgccaaaattcaggtgtattacattaaatatttcttatagccagttaattagtttagttatctggggctgtattaggcagctaattcttgtggatttgccaagaatctgtgttgcttctgactaaggagagtgactgataacatttatcttgaaaaattaaccaaccaaaatgacactgcctgtgttttaaagtttggtatattagtctgcttgggctgccataacaaaacaccaaatactaggtgactaaagcaatagaaatgtattttctcacagttctggaggctacaagttcaagatcaacctaccagggctggtttctagagaagcctctcactctgcttgtaaatggctcccttgctctgctgtcacatggcctttgctgtgtaaatgtgtggagagggcttctccttccttttcctttcttctaagcacatcagtccttttggattaaggcccacccttataacctcacttaacctttattaccttctttgtaggctgtgtatccaaatacagtaacagtgagagtcagagattcaacatttgaatttgggagggacacagttcaatttgtaacaggtggtaccctgggcactcttattattttgataaaatatcctaaactgcttctagagtgagaatctctcatcacctacagatagtcttgaggctcgggcaagagccctggtcaagctgttaatttttcacaattgtttgtcaatcttactgcatgcttttctggcttatattaaaattaataaaacataatttgatctatttagtcctgtaagttcctgaaattctagacttaaattaaaatgaattgttggaaaactttgtacctgggctgtattcagatctttcaaaatctctaggcctgaattgagttttaatgttatgttcttgaaggaacttacaagaaatggccatgtaagatttgtgactttgtctgttttcagaagattgttaaggacatcttttactatattaggtcttccatgttttttaagtgaaagatttcttttagaatttaggactagttcaaaatttgcttccttaaaggaactggagtccatattttttgagaatgagaattatatcatgtgatgtgtctccttttgcctgggctgctaggaagctcagatttagtttgggggctcacttcatattaactttgcttgcccatatgatctgcatagttgtcttttacatttatttggtggtgtttagccctgcatctctttagtcccactttctcatttgtattttactttttattgtttatattcttgcacaagccatctcacatcttttttgggaagaggtgggatataattaaaatgaaacttgaatgtagatattgttactcagtttcacaattaaatactggttgaaaggttatcaggctttggctgggtgctcttccccgagtagtttcatagaacactcagagtaaaagctcacaaagttgggcctggtctggctcccagttttctccttgattcatttcctgtcactgtcactctttctcaagtctctaaagccacattgacctccttgccattccatgttccttgagcaggctaaacacaccctgtttcagggtctgttctctctggaatcagcttcccagatagtgccctttctctctcactttctagtaagctgtattcaaatgccatctttatccgagaggccctccctggcctccttatgtgaagtagcctccttcctccttgcctgtcttggcttttgcgtagctgttacctcccagctcccctcactagaacataagcttcatgagggagggattggttttgttcattgctgttatgtatctctaggcccttagaactgtgcctggtaagtaatagatacttagtgaatatttgttgaatgaataagtgaattaaatagggtcacgagcaactatttgttcttttctacagatttttgagcatgcatttcatgtgagacaatttagttgcaattgtttcttaaggctgggaactgtcctccatgacctctctagatcctgcatcgcactgctgctcattacttagcttttactaagcacttaatgtaccaggcactgtaagaatatagagaaaaggtctgatctcagttcagaaataaatatcctcaggaactttagaaagggataggctttaggggatttgggctaacaatgttgtgattcatagattatttattttgttcccaataatatatcagacaacacttccgtcacactttatattttcaaagcacattcacacatttctccagtcctaacaatatcctggcaaggcgggtattcttattgtcttacctgttttacaaagaaaaaaacagacccagaaaagttaagtcacttaccaaaggtcaagcaacttgaaagttgcagagctccgtttgaatctgggtgttttaaaattccagagcctgtgttcctttaatgtgtatgtggatggctcttgtttgatatagttgatgaggtagtaagagactttcttggtgtattcctaatggtagtattctagatttgggtttttctttttgcatccttttattccacttgagtgatgaatcacttttggtgactgaccttattttcacaggtgtgctttttcctttatttgatctttcttttgtctttaagaacaatactgacttttatgtattttctcctgtccggactccattactctattaagaccaaagtgaaagcaaaattgctccacagaaggaaccagtgatggtgactgattattttcctttcaaaacatttgatcgtctacactgaaatacagaggctagtatgaaaatgggaaacagacaaattcagttttagatctccagttatttaccctgggttttaatgcttgtttatgggactcacttggagctcatggttgtgaatccactagaacttaataacatatttgttcctactagatgttgttaacagtagctttacatgtgtaccgtggtccttttagccctttaggtaaataaattccttcctgggaattaattagtcatggttaagatgtaattcatcatgcaaaatatcagagctgtcttaatgaaaaattcttaatgatccagaaatgtctttgtgaccagcttaactggaatctagtttattcttttatgttcctccatgaacttgacaataatttataagtcataatcattttgagaataggaatggaaaaaaaaatctagagtgattcaataacttgaatacatcttgggttggcaactttatgccatttgtcctttgatcatgtcttttatttagctcatgcttttaaatcttgcccagattcaagactgttattactaaaaaagctgcttggtgctctctttccatccctaactgtctgctgttctctttacatatgaactgtggcttgatgagagtatgtgtcctgcagctcaggagttgaaggcaggaaagataggattttgtaacatgtatagtagaaagagcatggattttggagtcaaatatacttagctttaatttcaactctgatattaactatgtgcatgtgtatattttactttacctctgtgagcctctgattccttatctgtaaaaaggctggtgataatattttattatactagactgctttgaggattgtcttagattaggtatgcaaaataaccactgtattgcctggtgtattatagatgctcagtagtttttatcctgtgtctcactttcaccttcctttccaaacatgtagaacacagggatgcatgtaaatttctgcatttagttttaaaatttcacaagtggaggatgagtgagagttgacttgtcagcacttactgtcaaagggatcttggataatttttggactatatttttaaaaatggaatgtagttttaggctatattattagaaagatagtgttcatgttgtgggatataaaacctctttctgtttggaagtatgttgtattcacttctcagcacatctgagaggcaggttagtgaagccattaagagccatatggcccaggtttgaggtcagactctgctccttaaagactgtgccttgaataaaaaactccatctctttatctctacaaagagggataagtatggtactgatatggtttggctgtgtccccatccacatctcatcttgaattttaactcccacaattcccgcgtgtcgtgggagcaactcagtaggaggtgattgaattatgggggtgggtctctcctgcgctgcactgttctcgtgatagtgaatgagtttcaccagatctgatggttttagacagggtagtccctgcacaagctctattctcttgtctgctgccacgtgagatgtgcctttcaccttctgccatgattatgaggcctccccagccatgtggaattgtaagtccagtaaacctctttcttttgtaaattgcccagtcttgggtatgtttttatcggcagcatgaaaatggattaatacaggtacctacctcataaggatgtttttgcaataaattaattattatgtgtaagccacttagattaatgcctggcacatagtaagttctatgtgagtgttacctgtttttgaggggacttcagatgaaagcaaaaaagatggtgggctgctggaagtcatggtgtggaagaaacagttgaagaaactggaggtgtttaacccaagaaagaactattgaaagtcctttaccatttaaagggaaattttatggaagaaggaatagacatttttttgtgttacagaaaaagatgagactaggatcaatgggtagaaattagaaagaggctgattttattttattttaatggaaggctttataataagtaaagctgttcaaaattgcagtgaattgctttgtcagctggtagagctctgcattacacagaggcttagaaggctgaagagaggttcatgacctggctggtggggtgagctcaatgacaagtgttgtcttctgcactgctatctgttcaggttaagggactagtgataatcccacactgaaatttgctgggatttgctagcatgtgtgagaactttctccctggaattagtcagctctttcatgctttgcttttttttttttttttgagatggagtctctctctgttgcccaggctgaagtgcagtggcacgatctcggctcactgcaacctccgcctcctgggttcaagtgattctcttgcctcagcctcccgaataactgggacaacaggcacgggccattgcgcctggctaattttttatatttttagtagagacagggtttcaccatattggccaggctggtctcgaactcctgaccttgtgatctgcccgccccggcctcccaaaatgctgggattacaggtatgaaccactgcgcctggcctctttcatgcttttatggtctatcatttattaatttttattgaatatttatctcagacaaacatttattgtctgagacattgtatttctggtctcatattgcagaaaagaaaacagaacttggaaataaatgttcaccgcctaccattgcttggcatcatgcattcaatccttgaaggaacccaatgacttagattttattattgttgggagaccattctcctcagggctcttgtgtttctgaagttcttgtgagccaagcactgattgccctaagttttaggttattttgccaaggatgtttgtttagcaaacagcgttggaagatagagatggtctctcactccagagcaaggggcagatgtgtttccagtccagtctctgagcttagattcggttttcggagctcggagttcttctccaggagctgcctatgtgggcaggcttctctttgggcccatctgcctaacccttgtgggacttgggggcaaggggaactgatgtgaacatgctgcgcttacgccgcttgctgtgctgtgagtgtgatcaagtcttttggacttgaggagctctaggagttttgtgtcttctgccagcacctgtgaaactgtggctaacctcttagctttcgagtagaataaaatctcagccttcaccattcttgacattaaggaggaataaggtgacaatcagagagtttaaacctaatgcccagagttaagtgatctagtatttgggggcggtgggattttaacttttgtcttcagagggtgtactttttattatgttatggaaaaacgctactgtctttgctgctgccattactactgttattactggaacaataatagctaacgacaacaaccaacatttgttgagtgctagtgacataccaggccttgtttgatctcatttaattctcactaacaaccctatgtggaaggtatcttagtattttcactttatagatgagcaaaatgagatgccattactaaggtcatgagtagtcagtagggtggagccacaattctaacccaggcagctttactctgcctgaagagaccccactctgtagctgttaggagtgcaatctgaaagcagaccaacctgagttttaaatccccgtactattcctaaccttcattgtgtgaggtggtgtaaattaattcaacgtctttaaatctcagctgtttcatctgtaaaaagaggggagggaataataataggacctactccaaaggcctgttatgaggattaaacatacattctataaaatgtgcaacacagctggctcctggcagctagtaagcctctctaaatattaggggctattattatttttattatccttgctgccttccttttctctaattaaaaaaaaaaagctttaatggttttgcactctgagttctataatgtaaatatttttcactaaagacaaaatattcatcctagtttacatcaagaggatacattttaaatatggggcaaagctggcacagggtatttcttacataaatattttcttgaaaaaggaaaataggaggcagaacccccagtaggcccaatttcctctctaatcttcattttagtaaccctttctattccctaaataactcctaatgatccagtaatgtgttaacagtgacagctgatgccagaaaaggtgttctctctgggcctgacattttccttaatggtaattctaactagttaaggtaaacaatgtgaaatgtttggcatattttttccacaaatggtagtggagcggaaatcatgaaaagccttgtaaagatggcaaaccgatctagtgtagctttgacaattctgtgactgctgttacaaggggaaataatagagttaaacatctaggaacccttacctttgggacagttgataaattgaaggcattttctgattgtgctttactttagattaacagtctggaagttttcagatttaaagagcaaagttgtgtatcattaaaacaacaagaagacatgatacatgctaagctgctctgtacccaaatattgcaagtaatcttggtagctctatctttgaagcccagtttcgtttacattctccactctgatttactttaatagtcaaacacttgggtggtattctctacctgcaagaaaccttggaagtagtctggtttagggtcaccagtttacagatgaggaaacaggatctctcatgtaaaggctttaaatcaagtcttgtggttcccagtagtgttcctttcctgagcatcccacgctgtcctgagtggcttttgcccttcccttcattgcctttgttcctgccatccccctacccgtattcatgatatagctgatcttttggcattcctaacacctaacaaaaagaattgtaaaattctttttggaggttagattgaagtcaaagactggcctgaatttccctataaattggaaaagaagttttatatactgtgtggctcatgaattaagatcctttgctctaaatgacagttcagagcagactattgtacagtattttgcttgcaaatatctagaagtggatatgtgattaatttgctgacagaccatctctgaaagcagttctaatgatggacttataattgatggcatccatcattgagaacctaaaatatccccctccctaaattaaaaaagataaatgaaataaactaggctgaatgtataagctgacaaatctgagggaatttaatgaaactctaaattaccacagccaacagataagaggaaaaggttcctttgttactgattataatactaaattaaaaaaaaattatccaagaaagatagtgggggaaacaaagatctgtggtccatgtatcaaacgaagttattgaaatatttttaataagtatatctatctcattccctggttattgttgattcatatcaatcttgttagtgctgttcgaagactagtaaatgcgggaaccgtcctgtaggatagcttagatgactgctgttgtaagagattttagaattaatatgaccttatttccagactgctgggggctccataccaaattcaggtcattcaaatgagcttttcggaaggtggttcctcagtgtataagtaattgtatcagttactgtgctttcagctatgtatgaaaaagaccaactgaaagtgacttaaacaatggatatttattatctcccctaacaagaagtcctgaagtaaggcagctgcagggctggctgctttggtggccaaggacatagtggtagcttggcattcctccttgtttttccttccatggttgtaacatggctgaagtgtcttaagtatcttatctttgtacagtgatacctagggttgggaaaggcaccttttcttgttactattcttgcagaaaattgttcctagtacttccttagttttgtctcattgatcagacttgtcactgataaggagaatggaacagttcactcaaatcaagagttacccagtctcttgaacagttcatgcctgcctgctgtctgattaaaatcagttctaatgccaatgacagaagagaagggccccttggataggcaactacaaatccacttagatgggctattgaaatttactgtgaaggaagttttgtgttttctgtttgtaacttatttcatttcctagttaataagatgaatgtgcttcaccttccttttgcattttactttctgcttcacctttcttttgcattttactttcaagttttacttagcttgatatactctctgccttcaccaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtattcctcctttctggtctgatggtggcagcacttcccatcactataggtgttgcagcttggagaggagccatggtagtggctaatggtccttaacaaagtgattcaaaatgccacttttcaggagttctgcaggtgtctggaaaggctggttgggaaagatcacagaaggcatcctcggctgatttctcccctcccctgtgtcttatccttggttctgccattatttctcactgcagtgtggaatgagacaagcaagatggcctccatttgcttgtgtcttacgatccatccctaacaaaccagaaggcatactggcccttgtattctccattctcattctagcagttattcttgtatttcacacatctaaacaataaagcataatattctgactgttgattcaatgcctattctgaatcttagtggctgacctattgacactcacatgaattggagggcagccagtcgaatacccttttatctgaatccaaaccacagaagcgagaatgtctcctacattgaagttggttgtgacttgcctgcatttattgtgcattcttggtattttttgtgaagtgaagaaaatttaacctacaaattatttaaacataaaatgaaatgtttatgagaacaatttttttcttttttttttttttagagttggagccttgctctgttgcctaggctggaatgcagtggtgcatcactgaagccttgaattcctgggctcaagcaatcctcctgcctgagtctcccaaagtgctgggattataggtgtgacccaccatgcctggcaaaaaaccaaaattcttgaatatcatgctttaattgtgactaatgtgtattaagttttattttgtagttttcatgttttggaacagtttttcttttatttgttatttttctctctttttctcttccttcctttcttccttcccccacgttctttctccctgtctctctcttctcctacccctcctttctcccctactttcttccttttgctgtaggtccttgagaaaactcttggttcttgggtctatgcctttagtacctaaaggataaaatgggtttgtaaggagtattttcataattggccaaaggatgaactgatcaaataagggttatgtagtataacattatagttatgtggtttttagctgtatttttgagatcactcctttaataccatttagtactactctgtgataaataacaataattgccaccacttattgaacactgattctttgcaagggatgattatgtccaatcatctcaatgaatttagaatttaaactctaatctcccagattctaaagccgttgttgctgattttcaggcatttttaaagcagcagaaacttttttttttaatgtgatattttgcagaataccagcatgtcagtcattaagagaggcagtgctctcctcttctttggttttggggtgagaggtccaaagcatcatacttggttccccccaccactgtgggactgagtgatgcatagactatggtttaaaattcactgccctgtgctatgagattggttaggggactggctggcctgtatctgcccagtaacagctgtgcatatggcatcttcatgttttgttttctgtccattagacttatattatgattttgtaagcagatacataaattatgcttctacaaatactgatgatatatgactttcagcttctaagagtttagttccagaatcagtatgctcttaaccttttggaagccatgtgttgacctctttatattttaaaattaactgggcatttttttttttttgagacggagtttaattcttgttgcccaggctggagtgcaatggcgcgatctaagctcactgcagcctccgcctcccgggttcaagcgattctcctgcctcagcctcccgagtagctgggattacaggcatgcgccaccacgcctggctataactgggcatttttgaaaggaatactataattctttgcctttacaagtgctgagttcatcctatggatttatctgtgaaactagttaaagttatagatcacttgctctagatttaaagtaaactgtagtccattttgacccaatatactaagctcaagaggggtcaatgaatgtatagagctgctgaccttctggctttgcctcaggtaataacagcaaaggtgaaggacctcatggtatttgtattttctgattagtctggttgactgaaaagactttgtcctaatctcatgggcatgggaagcaccagcagtgatttctgctttgcttcccatcattctgagtcgataacatcttagccgctaacaaagaatgttcgcctgatattgaaaaagagccttgtcttgatcatttcacatttgttttagtagccacgtttcttaccatcctcattttcagtatgccagagttttgagcaaaagaaaataacaatgaaaactttattatatctgataattgtcacgaaagtaaatgtcatattattctgggttatgaattagcttcaatattgggtagagaaataaagggtcagagctcttttcaaaagagcctttaataattgattaatgggaaaataaaaggggggagaatgaaaatgaatttgtttttgacaattttgtaccatgacagtccatttcttgtcaccaaggaaacactgatgttttctcactaatcttttcctgtcatttttggcttttaattacactttggattatatatgaaatataggtgtgtattttttttaaagtgaaaacatggatgattcagtaacgattgggctacgttatctcagagccaagcaaaatgttgagaatgtgtagatctgagttgaaattttctttctattttctgccaaaagaataaggattcatgcagcaaatatctgttgagtgcccgctatgttgctgattgtgttttaggtgctagggctgcacaaatgggaaacaccagttcctgtcctcagggagcttatgtgcaaatgagaggatagaaaacgaacaaatagataacgttgaacaacatttatgtagtctctatgtatcgagtgtctgctttgtgctgaggattgttctagattttcaggtgtagaagtgaagaaaacataaacatttctgtccttgtggagttaaattctaatcaggggagacagactacagactataagtgaatatataagtaaagtgtggtatagcagatggtaagaagtgctacacacacccccacccactcaccagggaggggagactagggacttgctgttttagctgggttggccagaaagggcttcactgagggcccatatgagccaacacctgaaggaggttaggaagagtgtcaggaagagcattccaggaagaaaggaagcaggtgcccagatcccaagtcaggggcatgattggaggtttggagcagcagcaaggtggttgatgaggctgaagcaaaatgaggcatggggagagtggcaggagagagatgagagagctagggcatgtggtgtggtgggtgggtgtagggaagtcacgtagggtcttgtaggtcactggaaagacattgattttaactatcggtataatgggagaaatgattgtaatgctttgagcacaggaataacatgatgtggctaacatcttttttttactattattatactttaagttttagggtacatgtgcacaacgtgcaggtttgttacatatgtatacatgtgccatgttggtgtgctgcacccattaactcgtcatttagcattaggtatatatcctaatgctatccctccccactccccccaccccacaacagtccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccctggtatagatgtgccacattttcttaatccagactatcattgttgggcatttgggttggttccaagtctttgctattgtgaatagtgccgcaataaacatacgtgtgcatgtgtctttatagcagcatgatttataatcctttgggtagatacccagtaatgggatggctggtcaaatggtatttctagttctagatccctgaggaatcatgatgtggctaacatcttaaaaggcccactctagctgctgtgctgggaatagatttcattggagaccaaggcagatgaagatgttcatatttgtgcattgtcaccttttaaagcttgagaccacagaactgtttatgcttgccatttgagagagggtctctctccatcacccgggctggagtgcagtagcactatcatgaatcgccatagcctcgacctcccacactcaggtgatcctcttgccttagcctcctgagtagttgggaccataggtacattccaccatgcctggctaatatttgatttttttgcagagactgggtctccctatgttacccaggatggtctcaaactcctggcctcaagtgatcctcctgccttggtctcctaaagtgctgggattataggcgtgagccgctgtgcctggcctacatgtctcattttttgacattactttcatatattgatttacattatattggtagattctatgtttttgaggataaaagtgagctgacagatggatttaactttcttccctgatggtccaagcttttttaaaaaaattaattattgatttattttagagatagggtttcactctgttgtccaggttggagtgcagtggtgccatcatagctcactgcagcctcaaactcctgggctcaagggatcctcctgcctcagcctcttgagtaggtggtattacaggcactcacaaccatgcctagctaatttaaaaaaattttttatagagacgaggtctcaacagaaggctcataggctcagccttgataccatgtacaattgatcaggtcaagtaatgtggacaataagcaaaataactgggcagttctattacttttgaatgcattgtacaattgctcaaaatgagatgttattgcattggtaaacctccagttccataggttctgccagtgtctctcataataacaactgatgggcttattgtagcagcagcaccaaaagaaatggatacgagttgatacaaattggggagttgggccaaatgaattggtatgtttctctgtggtgtactaggtgaatgagatgacctcagatttctttaaagttacaaagtagtctaatgcttatcactggaacagggtaggttgaagggagatacttggctttgttgagatgtgcacacaaacacttaacatttcatcccaattttgaccaccctattggtgctagatcaagctctgaatctcattttttttgcctataatgagaaataagggtacacgattattcaagtgaagttgttagggcttaatcattgagtaatgaaacattcattatttggtagatacctaaaataattctggcttttaaatgcgattataccttgaaaggtagaattagaacgaggaataaccttaatataaaaaaatgtcctagtagaacaacatggtttgctaggaagttatttacagcccaaatataagatgctgcttgtatgagaaagggaagaaggcctttggtttctagaaatggacatgctaaacagtgggtaataatgagatataattttaaatgcgtgcagcactctagagcacattaatgcagttgctggaaccatgaggtgatctttccattaagttcaggtgtgtgtgtatttgtgtaaaggaaggtattggaaagtgttgaggggagcctctcagaatttcagaacttagagtggcagctgaaaaaacccggggaaagaaagcacagacagtacaagtttgaaggtaatttaaagatgatttgtagttctaaaaggcttttaaacagaacaatgagtggtatttccaaggttcgttctttccaggtgctttctaactaacctgcacaatgtgcacatgtaccctaaaacttaaagtgtaataataaaaaataaataaataaataaataaaaagaaaattcaataaaatacataataaaaatgtatcattaaaagtccagaaaaaaaaaaaagactccatggaaaaaattgggttggtctcttacggcaggagaaaacctatgatagtacttatatgtagatttactttcgccaacaaaattcaacaaaaacaaagaagacatctcagtattttatacttttaaaattaagaatgatgtcgacacattaattttcatttactatccttgactcatagataactttttaggatatttctagtctgtagtttcaatgagttgtttgcacattgttgtattctattacagataatatgcatgctcagaggcatttcctcccttctttatcttttccttgatccaaattcagtacttttcttttctattttttttttttttttggaaagagtctcgctctgttgcccaagctggagggcaatgatatgatctcggcttactgcaaccttcgcctcccgggttcaagtgattctcctgcctcaccctcccaagtagctaggattataggtacccaccaccacacctggctaatatttctattttttagtagagatggggtttcaccatgttggccaggctagtcttgaactcctgacttcaggtaatctgcccaacttggcctcccaaagttctgggattacaggcgagagcgatcacgcccagacaaattcagtacttttctgattttatgacttaaaagttatggtcttccccaggcctgtgtccataagcccctctcactatatagatctctggtcttcctctcacaaatgctaaggcagttttattcaaagccccacttagcttttctcacccctttatcttttccaaaagagggctgcaaaaatttcaacttctctgccgtctgtatcatctcacatttctattcacagtagcctcttgggccctgttttctttcttttctctttttctaatagcctctagttagggtgacttgcagattttgtgaaattgtagctattgctgaataggtgattatgagcaactgtgaagttactaaaactctgagaaagcaaaggaaatttgtctctgacttgatatcatggtttgaacaaccttttcacccatttgttttaggaagaaacagagtaacataatttttcaatcttaattatacttataaattaaatagaatgaaatgaaaatactgtcatcacatttataaaagtagaacagagttttgagaaataaatgtttcagtgtaatttgatacttttctaacatttgaatgttattcattgatgggtatagccctgttcctattaaaaaaacctttttttttaatttttaaaaattgacaaataaaaattacatatgtttgtagtagagagcatgatgttttgaaatatgtatacactgtggaatggctaaaccaagctaattaacatatacttcacctcacatgcttatcagttatttgtggtgagaatacttagaatctaccttttcatcaattttcaggcatacaatacattgttattaactgtagtcaccatgttgtgcaatgggtttcttgaacttacttctcttgtctaactgaagtattgtatcctttgaccaacatcttctcaacccgtcctctcaccctgagcccctggtaactactgctctactttatgcttctatgagtttgactttcttagattctacatgtaagggagataatgccaatattcatctttctgtgtctggctgatttcacttaacataatgtcctccaggttcatatgtgttgttgcaaatgacaagagttccttttatttttgagacagggtcgcactctgttgtccaggctggagtaaatggtgcagtcggctcactgtagcctcgacttactgagctcaggcgatcctcccacctcagtctctctgctatctgggaccacagatacttttttgtggagatgggttttcaccaggttgcccaggctggtttcaaacccctgggctcaagtgatctacccacctcaggctcccaaagtggtgggattacaggtgtgagccaccatgcccaaacagatttccttctttttaaatgctgaatggtattccattgtgcttataccacattttctttatccattcgtctgttgatggacacttacgctgcagtgatcatgggagtgcagatatctttttgacatattgacttcaattccttttgatatagaccctgtagtgagattgttggatcatatggtagttctattttttaattttttgaggaaactccatactattttccacagtggctgtattttccatctttattgaggtatagtttacgtacagtaaaatgccatattttcagagtgcagtgcaatgagttttggcaaaggtatatatcactgaatgtgttaccatcaccccagagctctctcctgcctttttgcggtcagttctctctcacatcctgctccaagcaactgctgatttgaattctggcactactgattagttttccctattccggaacttcgtacattattccctcttttgtgtctagttttttttgcttgccataatgtttttgagattcttcattgtttcttcctttttgtggctgactgaccctatcccccaagttctaaaataacatttttcatgactgtgactttctaatcataaagcagaaggctcagggcaatttagtattaaaagttcctgtagtttctttggtctgtagctttgttacctcggtttagagaattttggtgtggtcattttctacacagcctgatgctaattttttatcccccacaaattctatttcgcttttccttccatgtagtaagcaaaagtgagaagtgagctgattacattgcacatatcctagtgtgaagtgacacaattgtctttttccaatcagataggagtttgccaagctttactgacaccctgtaagtttgtccctgactcttgatcaggagcctagttgggtgttgtataacataagatttatttttaactgtttccatagtaaccgttacacatagaggaaaaagctgagaactatagtagcaaggtgatataagtaggatatcagaaatcagattctaacagatttgaactaagatttaaaatggaatgatttaatagctggagtccttaactcagagactaagaactccagtggaatttaggaatggctttgagagatatgttttattttattttattttatttttttgtgagacggagtgtcgctctgtcgcccaggctggagtgcagtggcccgatctcggctcactgcaagctccgcctcctggattcatgcaattctcctgccttagcctcccgagtagctgggactacaggtgcccgccaccatgcctggctaattttatttttgtatttttagtagagatggggtttcactgtgttagccaggatagtcttgatctcctgacctcgtgatctgcttgcctcggcctcccgaggtgctgggattacaggcgtgagccaccgtgcccggcctgagagatatgtttaaaagtcaaataaagccacaaatgatgataaaagactggactctcctacctcatcctaccccggtcccagttccaacatctcagagatgctgacttttactcttttagtttttcttttttaggtatttctatttctaatagtatgcttgtgctgtgttttttattttgaatgttatatattaacttccaactatggaagatgaggacttagcccccttcccaatctctccccatcccactacatcctcttccttcatcctctctatatagttgtattctagttttggttaaatagatgatcagtgcttacctttttataactacactaatatgtacatctaagccatacagcatactgtgattatgttttgtgccattgcgttgttgttttcctggagttactgattggatagtcctgttgcctttcttctgtattgtatttcctggatcccttgtttcttctcttctgttttctcttgtagtggtggaacacattcttcagtagtttgctgagatatggtgcatataaaattgagtttttgagagcttgcaaacctgaaaatatctttattctttcctcatacttgattgatagttcttctgggaaatacttatctcttaaaattttgaaggtatatcattcctttgtcttctagcttttaatgttgctgctgagagaaatccgatgtcattctgattcacaaggctttgtataggtcctgttttttcctttttttctttgacagcttttatgattgtctctttatcccttgtgttcttacatgtcagaatagtgtgtcttggcttgggtctttttgacttccattttcttgagcacttggtgtgccttttcaatctgaaaactcatgttttggcatgttctggccttttttttctttcttcttcttttttgtttttttttttcaaaagagctggagtcttgcttttgttgtccaggctggatgcagtggcactatcatgcctctctgcagtctcaacctcctgggctccagtaatcctactgactcagcctcttgaatagttgggactacaggcatgtgccactatacccggctgattttttaatttatggtggagacagtgtctccctgtgttgccaaggttggtcttgaactcctgagctccagcagccctccaccttggcctcccaaagtactaggattatagtaagacactgcactgagcaggcagttttttaaaaaaattatttaattattttttaactatttttctctactccatttgtttcgcttttccttccttggaactcctatctggtaagtgttggaccttttggatcaatcctcttgctttgttttacctcctatctcattttttggtgttttcctgtttggagatttcctcaaggataccttctaacctttctattggagttttaaaatttctattttaatttctaatagttgtttttcatttcttgaaaatgtttatatcgtcctgtccttggttaattgatgtaatagcttctgttatttttcctaaggatgttaattatagtttaacaaaattctgtttcctgcatagtttctgttcccccgtgtcctgcttcagtaattttctctgttttgatgcctgccattccattctgcaggctttctgtgcatgtctgatgatccttggctaaccatttgtgtgtaagaggcaggcactacaaacctgattggaagctcagaacatgttatggagcttgtccataatgattgggtagggactcagcagtttcttcagtgaaacctcaaatgtcactatctgtataggtcttcacttggaccagttcactttcccaagggagaagccatatgtctcttgtgttggggtgaaaagtcaagctgtcagtgttttggagcctaactattgacggagaccgagggtccatgggggctttggatcgtactgtttaatatgtcccactttgacttcatcctcctgttttctgtgcagtgtctcatgcctccctctcaaccatgcctggcatttccttgtctagatcctgtccaattcagttgctcccaatttggccaatgctgtgggggaggaaattacccatgtgtgtggcttgatggggatttggggctcagaatactcctatagaaacttttaactcagtacccctgccattagtatacttggtgcctcctttttggtgttagtaaatcctactccaggctaaggttttcagatttctctggcctgctaatttagttgcctactgtccatcttcttgctagcttccacagttttgttaccatcccttatttgctgttcttcctctctgttctctctttatgcttcaaaaaatttctttggtattaccttggtgggattgcaggaaggagtagaaataattggaatcatcttcatcagatttacaaagaggtctatgaccccccaaattaataatcagtctattatatatatatatatgtatatttttttttgagacggagtcttgctctgtcgcccaggctggagtgcagtggcacgatctcggctcactgcaagctctgcctcccaggttcatgccattcttctgcttcagcctcccaagtagctgggactataggcacccgccaccatgcccagctaattttctgtgttttgtttagtagagagagggtttcaccgtgttagccaggatggtctcgatctcctgacctcgtgatccacccgcctcggcctcccaaagtgctgggattacaggcatgagccactgcgcctggcctactatacttattaagagaggttacaaggtcttcttattaaagacttttttttaacatgggagactttcatagaagcatgatttaggtgttgtcatgaagtcgtaggaagggattagatgctttctcaagaaatcttttaatcttagcattttgtcctcatattttccgtacttgttggatgaatgttgaaatttagttttgtaatcaccggaggcatagtgtcagtgaatattttcatcaccacaccaagtcttgtagaagaacaatacagattttcagttaccaaaaatacggtagactctttgcactgatggacatgtcccatgtattgatgaaggtttggattatacaggtgggcgcatttgccaaaacttaccacgtggtacacttgagatgcattcatgggtaaattttacctcaaacagaagccagaaacaaaactgtaaagaaatattaaactcaaatttaaataaaaatacatgtgaggactatcaaaaatatatgaaagtagttctgtgaattttgaaagatcatggtttttaaaatttttccatgttgaaaaaatggaaaattttcaattaggggagcaaataaaaacttattcctatcacatgcatcacagctacctcctccattcttctcctctcccttttattttgtcatgttttgcctatgctagtcactatactatgcagatctacaggtggtggagattgtcttatttaatatctaatattcagaatgcaaggcaaaaaagccttggtatgtccttttattttcagattatctctggatgtgcctactttcttttggaagctggggttacttttattttagttaggttgagcactctgtttcttggttttaaactttagctggagttctagagctagaagcttggaccaagtgacctatcagctggataggaaatttgcaagcattggggaaggtataatagcatggactctcacattgatcattctccttttagatatattaatatttatgaggtacttcatattttcagagtgctttctctttagtaatgttttctagattcactcaaaggtaggttgggagtagttttctcatttcatgggagtgaaattagagagaggtggagatgtgcccaagtgagtctatgtcagaaccaggattagaattttggaggcagaccaaggagaataagtggcagtgggaattaggaactgctgcatacagtagtaccagtgaagactactaaccagattataggtttagactggcaagactttggactgacccaagaccgaatctgttttattgtaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtaagagaacagcctgtgctaagggtcatttttgttaagatgtaaaagcactctcttttattctctctgaatcctgtaatgcatgtagcacattacaaactgccctcttgggattcatgagcccttgaaggtgaagcctgggtatttctctaattccagtgtttgaaatggtaggtaattattatttatgtattatctgtctttgtaacaatggcaagaaatataatagtaagaaaccagtacttaaatcaggttagaatggtaatgagaggtgttttttagcttcagaggaagatagttaatgaatcccattttaaacaatgaaatctacatgagacagaacttctgaagatttatagactagtgttccacacattttttgaaggaatttttacattagggctttgttcttttccttgaaattgataagaaataaaattttgggagactaatactggaagcaactttattgaccaagagtactccacaatctagcctttagcctccatcttagtccattgtgtgtgctcctttttgaattgctgaaagttcccagaaggatgcaattggtggttcatgtggctgagcgtcaagaagatgaataaaaagtagaaatacagagtttgctccctaataatcctctttcccaaggcctgtggctcttagagagggctgctctttctcccttcccttttacccacccagtcccacttccatctcattcagagttggttaaggaagctctctataggagctctgagcagcagatgggctgtatttgaattgttgttttttccttccccacagtaggtgaaagtcctttacctttgtttcaccaaattagattggctttaacactggaaaaaacactgaggggaattggtagggacacagattaaatgctctaagtggttctaattcattcagacttccaagaagaattttgctaaaagtccttcataagaagctttttaaaggaaatttggtaaccaaggagtgagaagtgccatgatattctatcagatattaaaacctggttatgtgataagactgaatggtcaatttccacagtggaaggagattaataatggttggcccttggctgggagtttaaggctgcagtgagtcatgatcaggtcactgtactccagcctgggcgatagagcaagactctgtctcaaaaagaaccccaataaacaacaaaaaaagattgactcttgggaatgacaaaagaattggttattttcagcatcttattcaaagtggcagcttctttaataataatgactatagggtgtctgatagaaaaaaattacttttcacctttagtgttgatttatgcattatgaatgcatacttgtcctatattctcaagattcagcaatcagaatagataagcaagtatacatttgtgtagcaaatatacatctatttgaatcatgattttttggagtgggcttgcttttaagtaagtgccacagattaaaataggttgttagaatttatttctgtgttaattatgttcatattaggatttcagatttttgtgttacggtctttgttcttaagggctaatttatttacttaagggctaatcaataatgaatactgtccctttttttctgacatattttcctcaagactcattaaataacttctttaaattcttggttgtaagttacagaaattcaactctagctagcttaagtaaaaataattgtttgactcatgtaaccagtctgccaaaggaataggcatgtatgtggaatgtcacctgtgtgttttctctgcatgccctcttcattgttctgctgaagactggtctcttcatgtgtgagggaggaggttgggtattgagggaaaacagggggcataggctatgtctacatctttccacctttacagaagaaaataatctttttttttttcataattcagaaatctagggttaggagctagattgagccaggttgggtatgataatcatcaataaaactatctggttggggcagggggcgtggtatagggaggaagaacagtcatgtccagaaaagagtgagtttgtaagacacattttccggaggttttgtttcgttttctgtttggttgtttatatattctagatattaattcttcttgtctgttagatatcttctcccaattggggatttgtctttttcctttgtttatagtgtctttgttataaagaaattaaaaatcgtaatgcaaaacaatttctcaatttctcagtattttttgttatgtgattttttttttttttttttgagacaggctcactctgttttccaggctggagtgcagtggtgtgatctcagctcaccacaacctttgcctcctaggttcaagtgagtctcctgcctcagcctcccaagtacctgggattacaggtgtgtgccaccacacctggctaatttttgcatttttagtagagatgggttttcaccatgttgggtcaggctggtctggaattcctgacctcaagtgatctgcctgccttggcctcccaaagtgctgggattacagccgtgagctactctgcccggcctgttatgtgatttttgatgcaagaaaattttttttccatcccagtgttctaagagaatctcctatgttttcttctttaacccgtcgaaagtccatttttatatatggtattaactgaggatctaattttatctttcttctatatagtctgttggctcaggctgtttattgaatcctttttctactgattcatgatgctattttggtcacacagcaacttatcacatatgcatggatctgtttctgagctctttattttgttttaatggtgttatttgtacctgcacccaaaccatgctgttttaactcctgtaactttataatacatcttgataggaggtgaagagattctctcatcttgctattcaaaattgtctttgtggccaggcatggtggcccacgcctgtaatcccagcactttgggaggctgaggtgggcagatcacgtgaggtcaggagattgacaccatcctggccaacatggtgaaactccatctctactaaaaatacaaaattagatgggtgtggtggtgcatgcctgtaatcccagctagctcagaggctgaggctggagaatcacttgaaccttcaatagctaattgattgaatttaagagaattatctttgcaatgttgtgttcttatctgtgaacctaatattcctttcatttattaaaatcttcatttgtgtcctttgataatgcttagcaatatatatagtccttagaggtatcatatgtattttgttagatttatttctgggtatttcatttttttgttgttgtcttttaaaacagtagctatttatttattaaggtttctagttactggttgctggtgcataaggatgtgatgtatttttcttttttaattgaccttgtatttccctgaactgattcccaatactgtctgcctggaaagtgatgacttcttttttaagacctggctcaaatttcatcaactctctgaatgtcccagatattcagatagctaggtgcttttctttatgtttccataagctcatatgtttcattttaatataattccttttgtttgtgtggtaggtcattgaggatagtggttgtgtcttacctatttttgtctgccctgttcccagcatagtgtagctcatacagtcagagttcacaaatcattagctaaatgggtgactatgtggaagactgtaataccactacagagagaaaaaggtatttcttttgtgggagctttgttctgttttttcttctctggttatttatttgtttatttatttcttaatggcaaggttctctagtgtctaaccttcccttttcgtagtaattaaatgaatgacaatgataacaatagctaatatgtattgagcacttactatgtcctggtactatttgaaatatgttacatttgttagcttatttctttcaacaactccacttctgatattaccattttataactttgcatgttctgaggagttggcatatcccaataaacaatgatttgtatatcccaatatgcaaaaatttcgtggaggtaggatttaaagtgcacttaaaaggttggagatatcttcaacttggtcttttgtatataagattgagtagtaagctctataattgctctttcattggacttcacatgaaaaacaatcacattttctttctccatggttatgtactgttagaagtaaaatctaaggcatctcaagggtccaaatcgaaatctttgctaaaagacatcagaggaaagtgaagacaaaacaatctagtccttcaaaaccccctgatttccttggatttgtttgtcagaagattttgcatttctattttaaggcagatgcagatgcttagtaatttaatccctactcagaatagattaataaatccagagtaaataactccatggtgacccattgctcttggcagctcctgctattcctactgcaccatcagactggtctggtagctataggcttggcttttaggtgagatatttgtttcttcttttgatatgataaccgagtattgcataaaataattaaattgtcatgacagggaatgtctgcaaataggtctggccttttgtttctttcttcaaggtaaacagctgctgttggcttatgaaaagctaaaaatgatccaacaagaagcctgtatccgtcacattgaaatcagagacttgattaatattgtagcctgtagctttgtgatatgtacggtttaaattagacctttgcagtcattgtgctgggttgatgcaagcacattaatgacataatttctggttgcagcatcacatttctgcagtctgtcctttgtattccactcacattaattgaagtaattttgccagtgaagcgtgtttcaaacctctgcatttaaattgaaattttaattcccttattgtcttgaaaagacggctgaagatgccttgttacaggtttcattatcactcaaaacactccagctgctggttctaatgtacaaagagtgattaattctgggaagaattattaatataagaatagcagcttcttcccagtggcatgagccaaccaggaaggtatttcatgatagttaatattttcataaactttttttaagggaaaatgtgtgtagaagtctgcatcaaactaaaattgcacagatgagctttgaaaaccacttacacaagttctgatttatcatcccatagaagtcaattcataattgcattcaatcagtggaaaccaagccagtgcaaatagttttgaagcactttagctgacagtcacaaggcttgtgactaaaataatttcatttctaagccttcctgagattgtagagattttgaatgtctcttaatcattttgtctgtctttatttatatgccttttaaaaagaatccatagctgtatagtcagataagggttattatgataattataataacaacttatatttatatatctgccttcttcccagaggatcccagagtgctttgctgagagaatggtgtaatgaaattatttcacttacactgtgtaaatgtggccatatctgggataaagaaattagggcagctatttaattgaatagttttctaagatcttatgtaataaaataaatatatttgtagtatttttagttaacaagatcctttggaattggataacatggtgggttgtgaatgtcagcatgggtcttaatttgggttaggtcgtctgatgcttgaatcccagctttgactcttagtagctggatgacttatggttagtaaattatctttgctgaaagctggagttaagaataatatgtatctccaagggttgtcgaatggattaagtgagatattaaactgtgtacataaagtatatgcagtataaagtttttgaaatgttatttataatcgataaattttactgatattgtaggaaatgatatgatgattgcttccatgttataatctcaaaaactgcctttgaggtggacttcttttgagctagtaaaagttgaagtagggttggattaagcagttttgattccttttcttcttggcctaacatggatgtacctaaatgaaaaaccagcccaccttttttaaaggtaaaggaactcttgtgggtggatagggtttttctcagaaagcaattctagtcttctctaacaattctgtgttacatttctaggatttggcatggacaaatttcagattatgtgttatcaattacttactcggcttacattaaaaatatgttcatagggtacccattgattgtataattctgagcaatgtaatttgttggtaaagtatccaagatgagcttgtaaaatctacttttaggtaagtaaatatgttaatccactgggtatcatcactagataaaagccagatcagtactggaagatgtttgtcgtcagaacattttagtgttagaagagttggtgttaagctgttgtttctgtgagtgcttagatagcaggaccagtggaccagtgaggttgcttctatttgtgtcagtaaagctgtgtcattagcaaatagactgatcttattttctcttctttatgcgcaaggaatgggtgatcatgcatccactgagaaatgattaatgtgcaagcaagaaaaaagggagccaaaacatacatacatcccttttatctggcttgaaagtttctgagatctcacagaactgttttttcttattactctgggaaaagtatcgatgtgaaagctctgtagataacaggagctggaatattctagtgagcttattggactaaacctgaaagtggttcagtgactgtaaaacaatgttccagtattccgtatggattttccacaacatgataaaaatatatcagtgatcaataatgaaatagccattactaaaacccatctgttcctagtgtagaagagcagcttgaaagactgaggccaatattctaagctaataatttatcaggaaagaatctggcacatattttgataaagagacaaatgattgggtctttaacatgtgataatgccattgttgataacttctgttgtttgtatgtgtatgtgtgaaggtggccttaaccttggaggatattacttgctagtgggaagagacagatggtgaacaaatagtgtctctcatattatgttaagtactatggagaaagctacaataagacagggagactgggagtattgggatttggggtagggatagtgtggtttgctatttaaataggggtggtcagctgtagctgcttttagccgcatttgagaccccccttcattcttctcttgccttcaaaaagatttaggaaaagctgaaaacaaaatgagtaattttgtttttttatatctacaattaagtgagtaggtttgtgacagttttatttttctcttatagagtagaagtgcaggggtttgtggtagctgtttttcatgctgctcaaggccctttttatttatatttgtttttgaaggctggggtttttagaaactagattgtttgataggcacctggttattgtattagttttcctttttttttaaattttgcttttttatctgctattcatttgcctcttttaaagccaatggaaattctgttttattgcactaaagcctacgaggttcagcaatttccatttggcttgcttggctatggggcagtgattcccacactgcacattaggggatcttgcaagaattctaaattcaggtcacatcccagaccggttaaataaaagtctctaggggtgggccactgacttcagttattgacattctccaggtaatgccaatatgcaggcaacattggaactattggtgtagggtatagcttgttctgtggaattcagcaaaacttattgtccttgtcttcatttagcaacagtggtaagtagttggaaaccaagtatttatgtaagacacacatcacatggtgatactcacatttatgtagaagtttattgtttgaagttgctttgtggccatactttattgtagttttgggatacagctaatgagtatttggcttttattctgattttatagtctgattatttggtcaaatcggtttagtagttaaatgagatgatttagtagttaactcacttagtttttaaatgagatgattctccatgtttggactgacttgcactctttagaactgtcattttgttgctctgatttgtgcatctttgctgtgggtcctgatatgacctactgcagggatttaatggattgaaattagagaatatgtttattaatttacaagtggtgactatgtatagtgtgtcatagtggaaacaaagtggatttaaaagcaagaagttcttaattctagtcctgattcaacaacttaccagttccttgagcttagataaataaattacattatctctctgttttagtatccttatctgtagaacagataaacagatacttacctgtctactttatagaatggttatgagaataaaagtgaaatatagtacaggaaaagtgctttgtaggatataaagcagtataaaaatttaaaatggtgtaggtatcatcgtcgtcatttccccatgccaggtaaaaagaaaatgcaggagtctgggcttgtttacactgagcagcatttctattctggtgctaccatcattaatgcataccggttttaatcagataaaccaagtgtgactgtgtttgcacacttgagtgtacaggaagaatgctctaagtcgagaataatacctaagtcgtttgctgccatcctccatcatatttctggtttcaacctcacatacgacctttcttgaacagatttttgattggtcagtctgtggccagatgggaactagatgtttgtgtaaattgcagctgatgacaacccatgttgttgataggggacttcagtctgaacttgatgatggtctgagaatgctaatgagtagcttttgcttggcttgacaagataggaggagcttgttaaagaagtctattttctctgagattcatcccaatactaattacttgtggttgcctagctcttgaaatgaaaaacgccatattcctctatcattcctttgtgggattttaatagttcacgttagtaaagagctgtgtaagtgctgagcatttctaatggatttggggctcttgcagagtgtgggcgaaattgtcttgattgaagtgcgagcctgaagtgattctgagacctcctttgccaactcttaaaaagagagttgttctgtaactttttcttgtcccagagtaacaaataacatgacatggtgagtgactttaggacgcttgttaaaagagaatggcttttctagtggtctcttctattggattttgtagtagaaacctaggttttaatgctctcttacagagcactgatgggaactgggaattgaagggaccatgaggttaggaacaaaagaggttttttttctaagctttcctatgagcagtttacaattatctttctcttaccgtgttacgtatagtttaatttcttcaggaaggtaattgtgaacagatctgttacaaggccttttagaagaaataaggctctcaatgtggaattatgcatcagaacccctagaactatgcatagcttaggacttgagatctacttctagaattttattttaaagaaagaattaagaattataactgttttgtgttacaaatatgtatacaaggatacttatcacagtaagatctatgaaagtaaaaagattagcaatgacttaaatatggggaattggtttaagtcattgtatagtcatactcatggactagtatgaaaatactaaatataatgtttagggataggcacatgctcccagtgtattgccaaatggaaaaaacatgtttaaaaacaagtatttttgcaaacactttgcatggaaaaatgattggaaagaactaggttaaaatattatatattattgcatcagatgagtgacaatatgatgatatttttcttttgtaattttctatgtttttcaagttttcttggttgagtaggtattatttttgtaatttgggagaaatgccaagcttaagaaaaaaataccattctaggcctgacttttttttaatctgtgaaattagggtgggaccccagtcttgaaaacctttaaaggtctctttcaatagaaagttcttagttttcatctctcagatactgccgttctgtgaggctcaggctgatagggtatgttagaagacttggctgttgctactttaggaggggaaaaaaaagattactttcgctttaataaaatatgggaattatttgtggcagaatgcactgatgtttaagggggaaaaacaaaaaactaacaacaaaagagggaaccctgaagaatgcttaagaatagcttaataaaatggtatgcttttagaacaagtccgcatttcatggtagtaatagggtgaaatctttcatgaaggaagaagtcacatttgatcctgttttcgagttttattttccgagatagatctgaagatactttaaagaataaattcacaagtaaagggccttttctttgacagcactttatcttgcaggcccccctcccttcattcacttatcaataacttcatctaatttgccttatcctgtaaattccattatctccctggcagtctattgcattaagcccttagtacctaatatcgcctcatttacattgacatatgcttgacctcagtccttctcctctctttgttaatgcaccaacaagcactgatatctctctggagcattatcatttgctgttagctcaactaataacaacccctcatttgagctgatgaaggtttattaaataaaaacatgcagtaaccctggcagtaatgaagggagaagggaggtagacaacatcctttttttaatggtgagagtacaccaagtctgctttataggtattgggtttcctaagggagatagggcacctgaatgggtctgatcaatattattttatcagggtgatttaagaatgggcatttttgattgtcttacttgatcactgttgattagcatataggctgaggagttaggagaaaaaagtattcttgctccaggcacttggccttgctcctgatgcagctgtctttggaactctgtcttcagtaccagactgtcaataaccctgcagctttcaggcagtggcaaagcttggccatagggagccagacacatcatcttagtcttctccagtgaaactgaaatcagaggttgtttttcccatagatcccgcaagagtccctgaaatcttcacaatagccctgacccttgaatgaatcccctttattttccctttcacgtcccatactcttattcccccgaccaccatttgtacatgaagtccggtctactggtgtcatgctgtaaacaaaagttacgtggatgctgttattaggtttgtattaacagttgggaattttgggttcacttgcttgcacatttatgtcacatacatatatattgtggtatattctactagtaaaattgttcctagtttatctgatgcagttaaatacatagagttctataaaggctacaatgtactgcaaagagtgctgtgatgtcccagatctatcaaagctttcagacttgctgctacagctgttaggttggaccataggaaataaccaatatttgatcatttttaacttgtaaaaacagtattttcttatggttcaagttaataatatgatagataccattttttttttctaagcttcattgtttgttttactagtttctgtctgataaagataaaaatttccgacttgggaaaaataagatgtagcaatgtagaaatagttggtgaatgaatgatctgggattcttggctcctgtgtgataaatatcttcgctgcttgcttagacgtgagtcggaatcattccacattcactgggagacctggaggcttcttgtgcccacccaggactccctgatcctgaaggtggacacttgagggtggagggccctctaggggagcaggccctaaaaccgctggaggttgccttccagcagtgcaggggcaggcagcggcaggtaggtgacctgggcactaagtaaatctaggcttcagggcatgtttcttttgttcatacagagattttgtgatgttcttatttattgaatagttgagactgctcaaaaagtttgtttaactgtgtcttatgtatatgtaggaagggggaaggtatcaattctctggagtagcctaattttatatctttttactgcaactccaaggtagaccatggcaacattttcagaatggttatgttgtcttgctagaaaaatgcttccttaagggagatttactgacctagtgaaaagtgataaaacattttagaaccatataattttcagagtcctcaaagaaatatttgttttggattcaacaatggcaatacatttgctttccttagggaacagtgttgccaaaataagcattttcgttagctaccagatggtttagttatcagttttgttttttgtttatacagcagtttttcttctttttttggcttgaaccttatttctattcacaaacagttactgatgtcgtttatctttgtgtgtcttactcacctcaactagaaaaataaaaagatcaatagtttcttttacaacatttcttcaacaaagcagctgctgagaatggccaagtttagtgttcctccaaaatatttacagtggttcatgtcagaacacaaaactagatctttttacatgataagcgtgattaagattggctaaagacaagcattaactaggaaataattatttcctgtattttacactaaaatgaagttgagaaatagacattgggaaagaaaatttaagggtatggtggttcctaattgcaaagattttcctttgttgtagacttatatctcaactcaggcaaatttttttgaattcttgattatatacattttaactgtgtgttcaagctattcttttagttatagaaacattttttagaatttttgttttcatacatggataggtttctaatagcaaaacatgctttcctgttcaatatcatgtgataaaacatttggaaaaggtttgcttatcttcataatcctaaaggaaatatttattttcaattctaaaacagatttctattgtctatctgagcagtttccaactgtgttgactagaacattaatattctgttagatggtaataggtgttcggtgaaaaaattcactggtagtcatatctgttttcctccaaaatgcatttaaaaatacttatatctgtctatatatatgaagaattctaaatacatttaggtgactcattattatatagtaatctaacttaaagaaactgtgagatatacctgataattctaggaggtcatattagagatcatttggcacatgaatgcgtggtgtttgatttgtgaataggggaatagacagcatttaccaattcactgtactgtggatgttgtctgtttagtctttcatctgctatgttttatcctgtaattttaatatatatttgtgacattattcagtgttgcgtgtcacacttatgaacctgtttttttttataatttcttatagcagctacctaccctgtgagactgtcttgttgctgtctgcattaatccaactgtgtctctttaatttctgttaatctttcatcagtgtgttatttaaaatgtactctgtagtcattacatttggaaaagtgcagtaatttatacaatgaccacttcccatacattaaaacaatctttttatcattaattatgcacattcctaaatacagacgattattttattatttctagtaaatctcaaatcttagtaaatacctggaaaccgtacctccccagtacaacagaattgactgtcagcggtagtctgttgggttgactgctgcctcactaacttttcctttgtgtgtaaaatttatgtttcaaactccttaaaaccagataagattaatgttagggctgggcgcagtggctcatgcctgtaatcccagcactttgagaggccaaggtgggtggatcacaaggtcaggagtttgagaccagcctggccaacatggtgaaactctgtctttactaaagatacaaaaaattagctgggcatgggggcaggcatctgtaatcccagctcctcgggaggctgaggcaggagaatcgcttgaacttaggaggtggaggttgcagtgagccatgattgtgccattgcactctagcctgggcaacacggcaagactccatctcaaaaaaacaaaaaaaagataaatgttaggtttctaaacatatattctagagagcaaatgttgcattgacaactattttctttaaattggtttgagtaccacttagtatggttagagtaagggaagacagtggccttgtccagcttccataattatagctttataaatagactatgaataagtgaaggccagaaaataaaacacagtgttttcttatagaaataagagactattctctttcctcttttgtggtaaggttttcaaatttttgaagttctgagactacctttgataatatatgttattatgttatcttgtattttgggtcaaggaaatatattcaaagtttgtcatttaaacagttacaatggctcaaagaaggaaggaacacttactgaaattgcttcactaaaacatgttgggaatactctctgaggtttctttactcatggaataaataggtactgttaaaaataatttcagtgagcactcaggagctgccaggcactgcgctaagtgttttacctgaatttttacttttaatttaattaggtgactttgaaagttgacacttgtcataaaattctgtatttggaacatgtactgtttgggttaaaaatcttcatgtacattcctacaaacaaatcaagtgtggatgtgcagtgggtggtttttaagcttaaatatctcagctggatttaattaccttaagggataaggctacgtgatgggccagtggtttaccaaattatttttcattttctggatctcagtgtcactgaaagttaatgcatcctctttctctgctagagacctgagttaaaatccattttagggcataagtataaatgaatttgttgttgttttttcctccttggggacactgtggtcattttgtgaggctgcctttccatttggaattgctggcagcttgctctgggcccaggggctctcatagcaggggcagttgcaagtcagcgtgaaaatgaactggtaggcttcagagggcagagctggcccagggcttgtcactctcccattccttgattctttcttggttaacttaaggaaacttatttgctactgacatttgattatagcacatcacaaaacaagtgatgtggttgtggataagccatcacattttctttaccatttcaggctggtttatatttggcagctacaaaggtttctctgttcactgtccacagactcctagatgactccttagactgctgtagttgtgtgatcaacatttttgatcaccaatgtgtttcatggctttaattacctattgttttagtgtaaatggttcattctttaggagcgtgtttgtatccataattacatttaagggttttaccctgaagtattattagttatttcctttatctgtacctattaggaatatttagtataaccaaagcagggaataatacgcatagcatttcatccctgagggagctcacttgtgttctttccctctaagctcatcctgtcatttctattttctctcaaagaatagcacctagagtatgctctttaagttttctttgaaaagatacaagatctttacacataaaaacaaacataattttgtgtacatgaataaatgggatcatatcatgcatgctgtcttttttttttttttcctttgcagatgtcactttgagtttcaaagtgagttggttgctccaggttccctgaatccttcatgttctccatttattgtaggcattcctataccagtttgatttatccagtccttttgtcttgaaaatctcccaaaccactttgcaccgggagtatcttcctcttcatgttttgtcttccagtcaccattcatatcccgtttcttctatcaaactgaatcaggacaaggagaggtgatgactactattgtccatttgtagcattcatgtaaaaaaatgtatttacctctgtgtgatgtgtatttgaaaaagagtgagagagagcccgactcttggtaagcacaaagagtcatgattgctgtgagaacaagttctttttaaaacatttatatagtgtgcttttttttaaagccttagtttaaaaaagctaactttgagtaaaagttgattaaaccattagtacatgggattcttgtgagaatgtgaatgatagtatcatttaaatagggaggtctttttacacgtgtccattgacagatgtgtgtgggcataaatagtttgctatggtggtgtgtatgctttcatgtttatctttgtctagattgttttatcattacctaaggtgagaaaaactctcccctagccacattatactctacgaagtcttttatatgctgataaagttctcgtaagctccctttgttagtatctttttaagacgtctttcttatttataatattgccaggttattaagttgtacttaattgtctttcatttttttctcttttcaggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcaggttaaagaggctctttgctataagtgtcttgtggcagtgtaggattggaaggaatattttttgtttcccagaatgttgttgtaatttattttacttttcctttaatggactgtctctgaaacttgaagatggttttataatagcaaatactccatgttctgagaggctgacatttgaagtttgttcattcattcattctacatttattatggtccttttctgtaaggatatataagaagcatttactgtgggtctcatattctgaatcagagacattggtacatctcagaaggaagtagaaaaattcttaaattggactgtgaagtcagcctaattaagaaatgtagatatattggctgggtgcagtggcttatgcttgtaatcccagcactatgagaggctgaggtggaaggattgcatgagcccaagagttcaagaccagcatggacaacagagcaagactctgtctctacaaaaaaagggccaaaattagctgggtatagtggtgtgcacctgtaatctcaactactccagaggctgagatgacaggatggcttgagcccaggagtttgagcttcagtgagctatgatttctccactgtactctagcctgagcaacagcgaggagacctggtctcttaaaaaaaaaaaagacaaaaagaaatatagatgtattgactgaatgataagattctttattacttagggttatgttcagctttaggttgtcctttttctggaatagtttaggaaaggttcagagagaacacttttattccttggttggttgtagcatagccctatatttaatggcctgggtagtctcaagaaattcattaggttagtagaggcctggtagggaataagactagatcttaagatggtagaatattggaatttttaacatatgttagatagctgtgcatagtacatgtccttccaatattcctttagaatagacagatcttttcagagggcatttcagcactatctactgaaatatacatgttcatgcttcttcattcagatatagacaagaagagcactggaagcagtgcacgctgggaatgaagtctttcaagtcttatcctgtttgaacaaaaaacgccaaatttgcttgtgatgcttcagtttaatcagagatcctgacagagaaagagaggtttctacctcttttcagcagataggcactagaaaaacttctgccaggcacacagatttgatatgtacctgagacataacttcaagactagctctgaatagggtatctgtcagtacctcagcagagagtgaagtggtgaataggggaagtgctaaggcattctttcgacaatgcctgctgataaatagcagatctgaagagatttcttcccatacaaggttaagtaataaaatcactatggtcctgtgaaaatattctgtattataagggaaaatgagcattatttgaggtctcagaggaagaacatttattttaaaaaaatttctgtaaagcaagcaagaaacatttaagagacttaagctcaaggtttctcaaaaaatacaagaaacacgatgtagtagattattcagaataatcactcatttcccttctacttttgtgggagaggagtatttcctacgctttttgttggggccttggcttttgccatcattagggtacatgacacaagcaggggcttcaaacgtgcttatgctgttgagtgtggcctttcgtgccactgccattgccttgctggcggtcccaggagaagggtaagagacacatggaactgactgaagatcagcagacctgcctagcctgcatcaaccaaccaccaaaatgtatgcttattgttgaacattattgagattttgtggttgtatacagtaagcgcatagcttccatgaaaacagtaaccgggagctacaagaacagagtgaggagagatgctaacagagctaactaaaacatgaataaaatgtaaggaaaccaaaatgaagtagagaaatttaagtctttaaagcttcagagagaagatctgaatcactgatgtggagggaaaaacttttcttgatgaagaggaaaaagacaagatgccaaaaggaagaggataaatatgaaagatgaacagtggtcaatccagtgattttaggggttccagagaatcacactaaaatgatagtgtttggggctgaattatgttccccctaaaattcatatattgaaaccctaatccctggtacctcagattatgactgtatttggaaatagggtcttttagaaagtgactaagttgaaatgaggtcatttgtgtgggctctaatccagtaggactgatgtccttataaaaaggaaatttgacacacttggagggaagaccatgtgaagacacagggagaagatggtcacctacaagcgaaggagagaggtctcagaagaaaccaactacgcccacaccttgatcacagacttccagcctgcagaactgtgagaaagtaaatttctgttgtctaagctatccagtctgtgttactttattatggcagtgggagggaactcagacagaggggatcagaagcaataattagagtataaataaaaaaacctacttaaacaggaaaacaagaccttggtctgcaagttgaaagaatttaaggtaaaatgaataaaaaaaagttactcttagatataatctggaaatttttatgattttcaaaaacaaattttataaataccaggaagaaatattatgtgatctgaagtgatagagataattatttgcccacccaatgtccattcttcccttcatttttaatgacaatctttatttcgttcctggtggctataggcccagctaaaaggctgcattttccatcttcccatatagctagagggtgtttagtgggacttcattttgcaagctgttgaatggggaggtcattaattttttaaagataccaattaaactggtatgctcactcttttacccttcatttgcctttctttactttctatctgggacatagattggtgccatcgagccgtcctagacacaaggtgaccttgaggatagaagccacatctgaaactccatgatcaccttgaacttcttttctagccctgggtggggtgcctctttaatgtgagaggaagtctttgttttactcagaccactattatttggtcttctttttatacacttaaaaccaggtcagttacacagaaaggagcaaaaatcaggctcaccaggatttgctgaatactaaatgccagaagacaatagaacaaaatctataaagttgaatggagaagagttgggaccaaagacttttctagccagccaaggggacattgatatgcataggtggccaagagatattctcagatatgaatttataataaaaaaaattagtattctttttccgagcaaaattctcagagataaactgtgagacgtacaaccagagaacaataaagttgtaggtagtttgaaacaactttgaggaccacataccattaaataggtacatgtatatatatatgtaagtaactgacaaatatgtttttacaagattgagaatatcagctaaaaaccattgtggaaaaaaaggtcagccgggcgtggaggctcacgcctgtaatcccagcactttgggaagccgaggtgggaggatcatttgaggtcaggagtttgagaccagcctggtcaacgtggtaaaaccccatctctactgaaagtgtaaaagttagccaggcatggtggtacgtgcctgtagtcccagctactcaggaggctgtggcaggagactcacttgaacccaggaagtgaaagttgcagtgagccgagatcacaccactgcattccagcctgggtgacagaacaagactccatctcaaaaaacaaacaaacaaaaaaggctatgtagtcaaggagtactctctaacagtaaacagaatttatatccctttttactcagttaatagtgactaggaaatttggataggtaggagaaaggaatgctgaattcttgcttaagatgagtgtgaagttttgttttcgactttaataattagagaaaatgtttaattttgtttttactaatctagatatgtatatttaaaaatcaatagagaagacaaaaatattctctattacaaaggatattgtactgcagccctcctttgtcagcaggggatatgttccaagacccacagtaggtacctgaaactgcagatagtgctgaaccctgaatctacctgcacagtaaatcctcacttaatgccctcaataggcacttggaaactgtgactttaagtgaaatgaagctgtaacttcaagtgaaatgacatacagaaggtcctagaataacattgtgtccttcaaggtcctctgctgatgagagaaaaaaaattcgtttcattatatgccaagattcttgattgcaaatagaggaaatcagtctgggtaactaaaacaggaaaagaatttattggaaagttatcaggttgttcacagaatctatgggaagtctgtataatcaggctctaaagcccagtaggaaccaacggagattaagcagctgagcacacacagtcttagacaagccacaggaagggtctgtttgggttgctatttttgctggcaccatgcccacaatagctggattttaaactcctctgtaaatgatctctaaatgtccctgcatctttcctttatctcgtcaagattcaaacttctggactcaggcatccagtttgctgagcctgggtaatgcctggactccttcagcttccatagtaggaagtggggccttctttttgctttgatgcagtcagtggggatggactgttcagatgtttggtacccaagacaaacacccaacaaatttctactgcaagagaaaacaaaggaaatcacatgaaggcacttacgtataaagaagaccagatgtttttgaagtagaagataggcagtagaattgacaaatgaaagaaaggtacatgctcacatacaaaaaataataaaaattttacttggaggaaatgaaacaaataaatggtgagactgtccttgttcttagctcatgaagatgtcagttccagttgaaaattttgaaactgtcaaatgaaatctaaagttcacatggatgaatacatgcgtaagaattgtttaaaagaattgtgaagggaggttatgaggggggcatttcttatgtgatatcaaagcatattgtaaagctgttttagtcaaaacagtacagacatgcaaaaataaatttttttaaagaaaacagtgcagacatgaagtagaaaatcagatgggtgagacaaaatagagttgagaaatagaccccaggatctatagactttagtattttgaacaatagttcagctggggggtaatgaaggctatttaatatatagtgttcagacaattgactgttgatttgaagaaaataaatttaggtgtctacctcttatgtacaaatgattcagccagatttaaaaatcacatagcactgtattagcattaggaaaacgtgtaggaggatatgtgtggaggagcctttttcaagcatatcagaagacataaagaaatatattaaatggtttaaccattaaaaaacccaaaacttatcttcaggaaaacagagtcaaaggataaactatactctgaggaaatatatgtatgtcatataacgctttaatatctaaagcatgcagatatttgtaagctcagtaaagcgggatatagactgttcatagattaaaaatacaaatggctaataaatataagattgttcaatatcatgagtagtcagagaaatacacatttgaaaaattaaatgcagttttttgttcataagatgatcaaaatcaaagacattgatagcatgttatgatagcaaagatggcggaaatgcgtagctttctcttgatggtggaataaccaatatgcctttttggaaaataaatttgcatattctttgtccagagaattttgtttctaggtctacatcctacaaaaacagtaccagttcataaaaatatatgtaacaagatattcattgtgacattgttggtaagaagaacaaaaatattcagcttaaatgttcatcaagaggagtatggtatattggtaccatgtaattacagaatttcagtgataatgatctctatgtgctgatatagaaaggtttctaaggtgcatttttgggtcccaaaagcaagttgaaaaatagcatagatagtatgaacctatttgtgaaagattgaaaggatagaaacttaaatatgtatactttatatattggtataaatatttgtatgtgtatagaaaatgtcagacagataatgtcaaaacactgataaaaggaattacttgtgagaaatggaaatgtgaggtggggaatagggaggtagaaattcttttatttcctgtgtacatcatgagcatgttttttaaaaataataatacaattactgatgatccttttgaagatttttaaaaatgaaatgggaaaatgtttagattatacccttgaagggaaaaactagaattcagatctatgcaggatgatcaaagaatgttgaaaaaggagcatgcgtgccatttttgtgttgtgtgacgtggggggtggatggacagacactcatttttaaattttttttcaagcagtccttgtacctcagcctcctaagtaactggcataccactgtgcttggccttgatgctcctttctgtaagatgttttggaaggcagtataccaaaatgatgtgaatggattattttttttttaagtattttcaagaaagaatttacacctttataatcggataaaattagtaaaaagttgtttaaaaataattcttttatttattgcatgatcctggataatactcggtttaaccttgcttcctcagccatcctgggacatcgtctagctcatggaagagaaaatttggtgtccatatttgtctctgggcatgtaaagaatgttcttcactgcattgtattcattccctaactattttgtcttttaaagattttttttctgtttacatatgttggttttctttttatctttcagttcttgttttttttttttttccctcttggcttagattttaaatttttagcctcactttattttctgttaccatgtcttcacccttggtctgtcatttgaaacgatggctcttttttacttttataccctttaaatcattcttattctttctgagtgttccaacagatcttagaactattgagaattattatgccagccattcctgtttcattatttggtgaagtcttactaagggcacgttatctttgacagatatttcttagctcagtttgatttaacaaaattttatgagcacttgctctttgacaagtactgtgccagctgttctggctatataagtgaatatatcagttattcgatttacaacttaaagttcaactcacctctgtcagtttttagtttcacaaaattagccaaatgagttgcagttgtaaattttggacatagttgaacccatttattgtgaagtgaaggaacagaaatatgttataattaaaaagtagatgtttaataagctgtcagcacttctaacccctcttaaaaaactgttttcgtatcatgaaatcttgaaatctaacatttagaagcagagctttactagttggatgttggttaatggccaggaagtccttgaggttacagtggcagtggttgttgcttgttttgggtttaatttgttgtatacttttcctgtcctctaccatgttgctattggcaaaatgcattcagtcacaatatataattggtaattttggggggaccattttatactagcagggattactgtacatcagctgtcttttgatctcagctatgaatgattctgaatggatttaaaataaaaatttgtaatcatgtatttaaaatgaaaaataactgtcagtatttccaaaataacgttataatttttattttattttttgttttcaaaaaatgctttctctgagggattaaaaacccgttgaaggtattaattaatcaatcccttctcagctttatctctgatatgtggtgagaagaggtctttttttctgttgtgaaatggaaactgaggtccatattacttaatgcaatattctacaatagcacctaccttatgctgagcttcattcatgtctgtagtcacaaagtgagtgggtgtgccccctttctctggaacttttgagactaagtcctttcataaaacagcaggagaaaaactaaagtcatttccagagttacttgcctttgggttagtgctcaccaaggagaaaattgaagcttaagggaaaattttagagagagagatgagtgtatgaaaatagttttgcagtaaattgactttctaaaagtttattgatggagtttgagggcccttctggctctgataataaaatcagcaggttatatttttcagagttgaaatggcaagctgtttatcaccctaaatttaactgaaatatgtttttaggttaaaactgagaaaataattgtaggatttaatctagagtgatgtgcatgtacatctgtgttcatagaagtgtgtactatgataaatacacatataaaaatatcagtgtgcacacacatagtaacaactgtttcatcattaggtgtggcaggcagtattccagctatataattgaattttcctgctgattgataccttaatttatctgtactttaaaagtaattcctccactttgttctagaaatatttaaatatttagacaatgtattatatttttcctgtcatttaaagttgaagttttttttactctgtagcagtaccataaacctgtgtctttttttacaattaaaacatttttattttactttattcatttgtccattgaagcattttatttgtaaatatgtattacatccatagatgaagaaccccaggattttctctcctgtgtgtttttgtgttgcttcttcatggtccatgatgtgagctgagtcagtacaatgaaaccaaactggtgggatgggagcagattagtctgtgatttttctagatttttctagatctttgagttggacatcaaatctggggctgatcacacttgctcacaacaacttgttcacactgtgaggttcccaataattttcccagctctgtgatcatcagtgatttcaaattcgctcatgtgcccatgctttgtcatcacagttgatgaagacactagacagtgactttggagcaaggtctaataagaaccaggtgtttgcctctcttttcggtattgtcgatgctctggaaagcagcaaacaggacatttatgcacaccattagggtggcacggaaagatggtggaaagagctctttgtgtctttgggcatctgtatccagggcctagggggacctgtgaagtgttttgtaattgtgagtaaaatgcaggtgaaagaggatgacgtcattgagaggaaaaaaatgagaagacaaaagaagtcataaaacatgaaagaatggacaaatctattatctaatttattttataaatagataaaccattatgaaaagttattggatttgaggactgttggattttcttaagatagtttaggctaggaacttacaggtttacattggtagaaaagagttgttgggaggatgccagttcaattcctggtaaatgctttctgttactttaatatcttatactccacttttcacattagcctgtgagtgattttaacaattggaaatatgctgtttggtttagttcatatcttagtcatactcacattcttagcactgagcacagtgccaagcacataatggatgctgaagaattgttcgagtaatgattccctgtttccctgtaacaagtcaaaagggagacgttaatgactgtcatagtgatcctcaaggcctaggacagtggctcctacattatttgtactcagtgaaaagaataaaaccttatgtgataatttcactctttaacacagtgtgaaattatcacttgaacccgaattatcacttaacaaactttatttttcaaagatctctgaaaaaacatgtttgttttttattggattataaatacacacatacctagcacatttgttccaaaaggagtgtgtgaaggagatggggatatattgctgtggtgggggcagatgttgttcccaattgcacacatccttccttccttccttccatttgaagaaatctttcctataggcgtggtctcttctctgcttcccctttgcctgctctagccactgctactgatgatgtatttcagtactaaaaagtgagaattatggcttccacttccctacccttggatttggcttcgaggggctcttctgttgtagatagtgtgcgagatgattccatttcttgagagcagggcatagggtttagttggcttggcatagcctgcattctttcacttaacaggtattttgagatgggaattaattggaaattttgttttttatagttttcatgatttaaaattaatgtgtttattttgaaggaagttgatttatgcgtttatttaaagtttattagtttatttaaagttaatcattaagatgaggggcttggccttcttaggaaaggtgaaatgggtaaatactgaattaacctgtttgagatccttaaatcattttaattgttgtgattgtccacgtcatgaaatttatgagtctcttttaaagaaaactgaatgtagtaaacttccggcatatgtcaaaaactatagcctgaaaaacacaagtaaacactagttaaacctttattcagtatcatggcatgttgtcatttgatctttctttgttgataaattaatatttaatacagatacaaaggaggacagtgaaattgcctggcatagtgttattacaaggtggttatccagttgatccagaatacactacactaattttttaaacagcattgaatgaaatgacaaaataaaaatttaagtacttggaacccttacaatacatttttatacccctgtctgtgacagtcacctctttattggaaatatactggggagatccagtatagtatatactggggagatccagttccagtgtaaagagggctcatgacaaaaacaaaagtggtaagggtggggctgtagtgggaggactttagttggttttgaagaaagtggtaactagtgcttcttttcccgttcagctccctcgtgaaagatgcttctgttcctctgattgatgttacaaacctccctactcctcgaaaattccttgatacctctcactattctactgctggaagctcaagtggtaagtatttaattcttcagccactaagctttttagtatgtcttagttcctaggtagatatctggaggagctttttgggggctgagctaggttgggctgggctaggtgggcctgagctaggtgtgttggaacctgtgatgagccctttgcaaccttcagagcaaataagatgtacagtgatttattgggctgttgcattatcagggttgaaaagtggcagctgaacctggcctgcctgctgaatccagctgcatctgtgttttgtttgaccagcactgtttttctttctttctttctttctttttttttgagacggagtctcgctctgttgcccaggctggagtgtagtggcacgattttggctctctgcaacctctgcctcctgggttcaagggattctcctgccttggcctcaagagaagctgggattacaggtgcctgccaccatgcccagctaatttttgtatttttagtagagacagggtttcaccatgttggccaggctggtctcaaactcctgacctcccaaagtgttggcattacaggcgtgagccaccacacccgggcgaccagcactgtttttctaaagttgagtttggatgctttttgatagagcatatgctttccattgtgctataatctttactactcctagtagcttttacttatttatctcatgtattgcattcagtgtctggtcctgggagcttctgagtgtgtgacctctgtcctatgccctctccacttctaaatgtgcatgcatccacgtgtgcactcatagtcgtacctgtaacacactttgaggaaatatctacaaacttatcttttcttctttggagatatccaatatcctattgaataagacaaagccattttggggttatgtttaaggttgagggcaggagggtatactttggatgcaaagatttaggggaatcttgtggattgccttaggcttgcctttgcagagggttcagctcaactgggcttggagagcttctgggcctctgcagagagtttctctgcttttgtaactgggttggggaagaagactcgatgtcttttgtgggatgcctcgcaggtgccttcttgtggcagccaaaatcttcattgccttttaacgaaattgtaatgtttattatcattgtcttttcagataaaaattagttcttatagttcttattagtgctgtagagcttgaaataatgaaaaggtagaaaaaaatagaaaaacaatttggattcaatcagtacattttgtgtaactaattggaaatgtttctgttgagagcttaatatattgttggggcatattttgttaccttaaaatgccacttaaaattgttttaggattatttaggcttggaatcttcaagtttattactttaactacaggaaagtatagaatttgataatagattttcctttgtttaattagtagccaagttttaaaaaattgcagtcatttatttttattatgatactttacaatagtttgtactccagcctcttcttggagctagaaaggttttgttttctccctctttctgatgtaatgttgcttttgagttttaacactgctctgaggggttgtagactgtggaattatgaaacaaaatatatttgtacctttgatatgtattttatctctgccttttatggaaattaccagttgttacatctttgcttttttgtaatgtgaatcattactgcttagcctggttatattaatttatgtaaatgttgccaagtcagtggccaagtgaaataaaaaatttaattatttatgaagaaatgacagggcaggctttgcaaatgagtgttgtataaatataaaataagctgaaatatgccagttacggcaaatttcagtggaagctaattttgctacatctattattcttactatgataggccttactttttgataggcactttatctgtcagcttctggagtttgcattcattacttagtggagttcatggtgacactctgattttggtattattaggaattactgttgaagaactgcttggtagttgactggggctaggagcattatggagactgcttgtagagatatgtataaaccttttatttatttatttatttatttgagacggtgtttcactcttgtggcccgagctggagtgcagtggtgcgatctcggcccactgcaacctcctccttctgggctcatgcgattctcctgcctcagcctcccaagtagctgggattacaggcgtgcaccaccacacccagctaatttttgtagaaacagggtttcactatgtcagctgggctggtctcaaactcctgacctcaggtaattgtccgccttggcctcccaaagtgtttggattacagtcatgagctaccatgcctggccagacgtttctttttagatgggttcatttccttgactattttgaagacttgatcgtgtgctttttttttttttttttttttgtgcgtgaccaaaaaagaaggtaaaaatattattgattaaagtcaataatagcagaggttaatatgtgtttagtgcctaccatatggtaaagcaatgtcttaagtgctttacatgaattaactcatttagtccctcaacaattttataacaatttattatcagtcccattttacagatgagaaaactgaggcacagggaggttaataattgataaaagtttacacagttgacaagtggttgtgatttcagcttagagccaggttcgactatgctcttctaaccagtttgttttgctgaaaacaagctaggtgtcctctttgtattaattttctactcacacaaacttagtggcttaaacaacataaatttattatcttacagttttgtaggtgagaagtctaacacaaatctgatagcagtaaaatcaaggtgttggcagggctgtgttcctttttggaggctctaggggaaaatctgttttcttgcctttctggctcctggaggccaccatattccttggttcattcatggtttccttcctccatcttcaaaaccagcaatggtgggtcacattcttctcatgttgcctctctctgacccactcttctgtgcctctttcctctttttaaggactcgtgattagattgattccacctggataattctggctaatcttcccatctcaaggtccttaactttaattacatctgcagtctcctttgccatgtgactaatcacaggttctagggattaggacatgaatatctttgggcaaccataattctgcttaccacactctacgctgcccattttgtgacttaagttatctttaggagcaagtgtaaaaaatttgactttcttcaaattatgtagcgaaatctttttaagtcattgcagtgtagtctttaggactctattaatctggatcacattattaaagggaattgtataaatgaggaagatgtaaattatgtagagaactgcacaaaatgttactaagtacatataaaagtatggggctgatgaaatatactataataaaaagcaggaattttgtcttattcttaataataaactggaagtcctaagagtctatttgtgaagtgctctgcaagtcagcctagaaagtaatagccgttttcagctgggaatttaacataggctcttaaagctcctctctcattttgtgaaacagtaagattgagggtgtaatccattagaattgacacttttatagaggaagttccattagggaatccctggggagtatggctctcccattgggataccataaattaagattggaggtgattcctgagaactttcaggttattttaattaaataagaattttgattgcttttaaacaagttgtttttcacgtgtcctattttgaggtagagttgtgggtgactttttttttttaaattatactttaagttctgtggtacatgtgcagaatgtatagttttgttacataggtatacacgtgccatggtttgctgcacccataaacacatcatctatattaggtatttctcctaatgctatccctcccctagccccgccctgaccgaaaggcccaggtgtgtgatgttcctctcctgtgtccatatgttctcattgttcaactcccacttatgagtgagaacatgaggtgtttggttttctgttcttgtgttagaggacatgaactcatccttttttatggctgcatagtattccatggtgtatatgtgccacattttctttatccagtctatcattgatggacatttgggttggttccaagtctttgctattgtgtatagtgccataataaacatacatgtgcatgtgctttatagtaaaacgatttataatctttgggtatatacccagtaatgggattgcagggtcaaacggtatttttggttccagatccttgaggaattgccacactgtcttccacaatggtttaactaatttacactcccaccaacagtgtaaaagtgttcctatttctccacaccctctccagcatctgtcgtttcctgactttttaatgatcaccattctaactggtgtgagatggtatctcattgtggttttgatttgcatttctctgatgaccagtgatgatgagcattttcattatgttggctgcataaatgtcttcttttgagaagtgtctgttcatatccttcacccactttttgatggggttgtttgtttttttcttgtacatttgtttaagttctttgtagattctggatattagccctttgtcagatggatagattgcaaaaattgtctcccattctgtaggttgcgtgttcactctgatgatagtttcttttgctgtgcagaagctctttagtttaattagatcccatttgtcaattttggcttttgttgccattgcttttggtgttttagacaaagtctttgcccattcctatgtcctgaatggtattgcccaggttttcttctagggtttttatggttttaggtcttacgtttaagtctttaatacaccttgagttaatttttatataaggtgtaaggaaagggtccagtttcagttttctgcatatggctagtgagttttcccaacaccatttattacatagggaatcctttccccattgcttgtttttgtcagatttgtgaaaggtcagatggttgtagatgtgtggtgttatttctgaggcttctgttctgttccattcttctgtatatctgttttgttaccaataccatgctgttttggttactgtcgccttctagtatagtttgaagtcaggtagtgtgatgcctccagctttgttctgtttgcttaggattatcttggctatgcaggctcttttttggttccatatgaaatttaaagtagtttttttccaattctgtgaagaaagtcaatggtagcttgatggggatagtatcgaatctgtaaattactttgggcagtatggccattttcacgacattgattcttcctatccatgagcatggaatgtttttccgtttgtgtcctctcttatttccttgagcagtggtttgtagttctccttgaagaggtccttcacatcctttgtaagttgtatccctaagtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagatcttgggctgagacagtggggttttctaaatatacaatcatgtcatctgcaaacagagacaattggacttcctcttttcctaattgaataccctttatttccttctcttgcctgattgccctggccagaacttccaatagtatgttgaataggagtggtgagagagggcatcgttttcttgtgctggttttcaaagggaatgcttccagtttttgcccattcagtatgatattggctgtgggtttgtcataaatagctcttactattttgagatatgttccatcaatacctagtttatcgagagtttttagcgtaaaggggtgttgaattttgtcaaaggcctttctggatctattgagatactcatgtggtttttgtctttggttctgtttatatgctggattatgtttattgatttgtgtatgttgaaccagccttgcatcccagggatgaagcccacttgatcatggtggataagctttttgatgtgctgctggattcggtttgccaatattttattgaggatttttgcatcaagttcatcagggatattggtctaaaattctctttttttgttgcgcctctgtcaggctttggtatcaggatgatgctggcctcataaaatgagttagggaggattccctctttttctgttgattggaatagtttcagaaggaatggtaccagctcctccttgtacctctggtagaatttggctgtgaatccatctgatcctggacttttttttcgttggtaagctattaattattgcctcaatttcagagcctgttattggtctattcagagattcaacttcttcctggtttagtcttgggagggtgtatgtgtcaaggaatttatccatttcttctagattttctagtttatttgcatagaggtgtttatagtattctctgatggtagtttgtatttctgtgggatcagtggtgatatcccctttgtcattttttattgcgtctgtttgattcttctctctttttttctttattagtcttgctagtggtctatcaattttgttggtcttttcaaaaaatcagctcctggattcattgatttttgaagggtttttttggtctctcttttcttcagttctgctctgatcttagttatttcttgccttctgctagcttttgaatgtgtttgttcttgcttctctagttcttttaattgtgttgttagggtgtcaattttagatctttcctgctttctcttgtgggcatttagtgctatacatttccctctacacactgctttaaatgtgtcccagatattctggtatgttgtgtctttgttctcattggtttcgaagaacatctttatttctgccttcattttgttatgtacccagtagtattcaggagcaggttgttcagtttccatgtagttgtgtgattttgagtgagtttcttaatcctgagttctaattcgattgcactgttgtctgagagacagtttgttgtgatttctgttcttttacaattgctgaggagtgctttacttcctactatggggtcaattttggaataagtgtgatgtggtgctgagaagaatgcatattctgttgatttgtggtggagagttctgtagaggtctattaggtctgcttggtgcagagctgagttcaattcctgtatatccttgttaactttctgtcttgttgatctgtctaatgttgacagtggggtgttaaagtctcccattattattgtgtgggagtctaagcctctttgtaggtctctaaggacttgctttatgaatctgggtgctcctgtattgggtggatatatgtttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccctctattttgagcctatgtgtgtctctgcacgtgagatgggtctcctgaatacagcacactgatgggtcttgactcttcatccaatttgtcagtctgtttcttttcattggagcatttagcccatttacattcaagggtgatattgttatgtgtgaatttggtcctgtcattatgatgttagctggttattttgcttgttagttgatgcagttgcttcctagcattgatggtctttacagtttggcatgtttttgcagcagctggtactggttgttcctttccatgtttagtgcttccttcaggagctcttgtaaggcaggcctggtggtgacagaatctctcagcatttgcttgtctgtaaaggattttatttctccttcacttttgaagcttagtttggctggatatgaaattctgggctgaaaattcttttctttaagaatgttgtatattggcccccactctcttctggcttgtagagtttctgccgagagatccgctgttagtctgatgggcttccctttgtgggtaacccgacctttctctctggctgcccttaatattttttcccttcattccaactttggtgaatctgacaattatttgccttggagttgctcttcttgaggattatctttgtggcattctctgtatttcctgaatttgaatgtgggcctgccttgctaggttggggaagttctcctgtataatttcctgcagagtgttttccaacttggttccattctccctgtcgctttcaggtacaccaatcagacatagatttggtcttttcacatagtcccatatttcttggaggctttgttcgtttctttttactcttttttctctaaacttctcttcttgcttcatttcattcatttgatcttcattcactgatacctcttcttccagttgatcaaatcggctactgaagcttgtgcattcgtcacgtagttctcacgccatgtttttcagctccatcaggtcatttaaggacttctctacattggttattctagttagccattcgtctaatctttttttaaggtttttaacttctttgcaatgggttcgaacttcctcctttagctcagagaagtttgatcgtctgaagccttctctaaactcgtcaaagtcattctccatccagctttgttccgttgctggcgaggagctgcgttcctttggagggggagaggcgctctgatttttagaattttcagctttctgctctgttttttccccatctttgtggttttatctgcctttggtctttgatgatggtgacgtacagatggggttttggtgtggatgtcctttctgtttgttagttttccttctaagagtcaggaccctgagctgcaggtctattggagtttgccggaggtctactccagaccctgtttgcctgggtatcagcagcagaggctgcagaacagtgaatattgctgaacagcaaatgttgctgactgatcgttcctctggaagcttcgtctcagaggggcagccggctgtgtgaggtgtcattctgcccctactggatggtgcctcccagttaggctactcgggggtcagggacccacttgagggggcagtctgtccgttctcagatctcaaattccgtgctgggagaaccactacaaacttcaaagctgtcagacagggacatttaagtctgcagaggtttctgctgcctttcgttcggctatgccctgcccccagaggtgcagtctacaaaggtaggcaggcctccttgagctgtggtgggctccacccagttcgagcttcctggcccctttgtttacctactcaaggctcagcaatggcaggcgccccttccccagccttgctgctgccttgcaggtcaatctcagactgctgtgctagcaatgagtgaggctccatgggcgtgggactctccaagccaggcgtgggatataatctcccggtgtgccatttgctaagactgttggaaaagcgcagtattagggtgggagtgtcctgattttccaggtgccatccatcactgcttcctttggctaggaaagggaattctctgaccccttgtgcttcccgagtgaggcgatgcttcgccctgcttcagctcacgcttggtgggctgcgcacccactgtcctgcccccactgtccgacaagccccagtgagatgaacccagtacctcagttggaaatgcagaaatcacccgtcttctgcgtcactcatgctgtgggctgtagactggagctgttcttgttcggctatcttggaaccacccctattttgttaaacttttccaaaaaccagctcctggattcattgattttttttgaagggtttttttgtgcctgtatctccttcatttctgctctgatcttagttatttcttgtcttctgctagcttttgaatttgtttgctcttgcttctcttgttctttcaattgtgatgttagagtgtcagttttagatctttcctgctttctcttgtgggcatttagtgctataaatttccctccaaacactgctttaaatgtgtcccagagattttgttgcattgtgtctttgttctcattggtttcaaggaatatctttatttctgccttcattttgttatttacccagtagttattcaggagcaggttgttcagtttccatgtagttgtgtgattttgagtgagtttcttaatcctgagttctaatttgattgcactgtggtctgagatactgtttgttatgatttccgttcttttgcatttgctgaggagtgtttacttccaattgtgtggtcacttttagaataagtgctatgaggtgctgagaagaatgtatattctgttgatttgtggtggagagttctgtagaggtctattaggtctgcttgttccagagctgagttcaagtcctgaatatccttgttaattttctgtctcgttgatctgtctaatatttacagtggggtgttaaaaagtctccaactattattgtgtgggagtctaagtctcttcctaagaacttgctttatgaatctgagtgcttctgtattgggtctgtatatatttaggatagttagctcttcttgttgaattgatccctttaccaatatgtactggccttgtctcttttgatctttgttggtttaaagtctgttttatctgagactaggattgcaacccctgttttttttttgctttccatttgcttggtaaatattcctgcatccttttatttgagcctatgtgtgtctttgcacgtgagatgggtttcctgaatacagcacactgctgggtcttgactttttatccaatttgccagtttgtgccttttaattggggcatttagcctgtttaaatttaaggttaatattgttatgtgtgaatttgatcctgtcattagtatgctagttggttattttgcctgttgatgcagttttttcatagtgtcaatggtctttacagtttggtatgtttttgcagtggttggtactggttattcctttccattttagtgcttcctctggacttttgtaaggcaggcctggtggtgacagaatctctcagcatttgcttgtgtgtaaaggattttatttctccttcgtttatgaaacttagtttggctggatatgaaatcctaggttgaaaattcttttctttaagaatgttgaatattggccctcactgtcttcttgcttatagggttttgcagagatctgctgttagtttgatgggcttcccattgtgggtaacccagcctttctctcgggctgcccataacattttttctttaatttcagccttggtgaatctgatggttatatgtcttggggttgctcttcttgaggagtatttttgtggtgttctctgtatttcctgaatttgaatgttggcctgtcttgctaggttggggaagttctcctggataatatcctgaagaatgttttctaacttggttccattctccctgtcactttcaggtacaccaatcaaatgtagatttggtcttttcacatggttccatatttcttggaggctttgttcatttcttttcactcttttccctccaatcttgtcttcttgctttatttcattaatttgatcttcaatcactgatatcatttcttccacttgatcaaatcagctattgaagcttgtgtatgcttcacaaagttcttgtactgtggttttcagctccatcaggtcatttaagctcttctctatactggttcttctagttagccatttgtctaaccctttttcaaggcttttagcttccttgtgatgggttagaacatgttcctttaacttggagaagtttgttattaccgaccttctgaagcctacttttgtcaactcattcatcaaactcattctccatccagttttgttcccttgctgctgaggagttgtgatccttaggagaagaggcattctagtttttggaattttcagccattttgcattggtttcaccccatcttcgtggatttatctacctttggtctttgaagtcggtgaccttcagatggggtctctgagtggccatcctttttgttgatgttgatactatttctttctatgtgttagttttccttctaacagtcaggaccctctgctgtaggtctgctggagtttgctggaggtacactccagattttgtttgcctgggtatcaccagcagaggctacagaacagcaaagattgctgcctgttccttcctctggaagcttcatctcagaggggcaccagccagatgccagccagagctctcctttatgaggtgtctgtcggcccctactgggaggtgtctcctagtcaggaggcatgggggtcagggacccacttgaggcaatctgacccttagcagagctcaaatgctgtgctgggagatctgttgctctcttcagagccgtcaggcagggacgtttaagtctgctgaagctgtgcccacagctgccccttcccctaggtgctctgttacagggaggtgggggtttcatctgtaagcccctgactggggctgctgccttttttcagagatgccctgcccagagaggaggaatctagagaggcaatctggccacagcggccttgctgagctgtggtgcactctgcccagttggaactttgcagtggcattgtttactctgtgagggtaaaacctcctattcaagcctcagcaatggcagacgcccctccccccaccaagctcaagtgtcccaggtcaatctcagactgctgctatgctggcaccgagaatttcaaaccactagatcttaagttacctatgctccgtgggggtgggacccactgagccagaacttcgctccctggcttcagcacccctttccaggggagtgaacggttctgtcttgctggtgttccaagcatccctggggtttggaaataaaaactgcagctagctcagtgtctgcccaaatggttgcccagttttgtgcttgaaatccagggccctggtggtgtaggcactggagggaatctcctggtctgtgggttgcaaagactgtgagaaaagttcagtatctagtccggagtgcactgttcctcacggcacggcacagtccctcacagtccctcacagtccctcacagtccctcacagcttctgttgggtagggggagagaattccttgtgcttcctgggtgaggcaacatcccatcttgctttggctcgcccttggtgggctgcacccactgtccaaccagtcccagtgagatgaaccgggtacctcagttggaaatgcagaaatcccccttcttctgcgtcgatctcactgggagctgcaaaccggagctgttcctattcggccatcttgccagcaatctgtgggtgacttttctgtgagaggtttttttttttttaaataatagtttataagttatagtttgcaaaatatatcatttaaatgatgcaacaggcctatgacgtagttagggcaggtactatgtgattactgttacaattattatatttagatcattaaatttaagtgcgatcagatataaaacatttacttataaaatgcaaagtcaaggcacaggttggcaaaagcaagaatccattaaaagaaaaatgattagcatccgcttagctttcctacatattaatgaagaaaagaaatgacataataaagaactgagcaaataatttgcaattcacagacaagtccctgtccgtggaaaaattggcatttatctgatggagattaagtatctagaatatgtaaagaatctctataaatcaataaaacaagctaatagagtaataggcaaaattatgaacagtttgcataaggggaatccaatgctaagaaatatatgaaaaactacttatattctggttaatcaggtattatcttctttcttttttctttttttttttttttttttttttgagatggagtctcgctgtcgcccaggctggagtgcagtggcgcaatctcggctcactgcaggctccgccccctggggttcatgccattctcctgcctcagcctccccagtagctgggactacaggcgcccgccacctcgcccggctaattttttgtatttttagtagagacggggtttcaccgtgttagccaggatggtctctatctcctgaccttgtgatccgcccgcctcggcctcccaaagtgaggtattatctttacaatcactttacagatacggaagctgaatgcaggaaggttgagtggttggtccaggttcaaccaagatgataattgttggagcctggcctcatgctgttcccagtctaaatatgtagggcatgtattttgcaagcctttctcttattctcctcagtcacagtattttgtaatgcacagagaaactaatgtctaatttagatgtagtagttcaactataacttaggtagaaggatgggagaagtgtggagaaaagccaataattgtagtaaaatgttggtttaagcttttggactcccagtatgtcttttcatttggcaaactgcctttggaacattttgactgagtagttactcccagggaacacaggcatttcatttgtggcctctttattcattttattcatgcttctgctgggatttcgtgaatatgactataatgaaactggacttcttagttcttttcttttgggtacaagcataggttaagcagtaaaaacctaaagagaacacaaattaaatgatttttatgctgctattttcttgatgtgcattttattccataaagtgttgctctgagactttatatatatcttaagaatttggaggccgggcacagtggctcatgcctgtaatcccagcactttgagaggccaaggtgggcagatcacgaggtcaggagatcgagaccatcctggccaacatggtgaccaaaatacaaaaattagctgggcatggtggtgcgtgcctgtaattccagctactcaggaggctgaggcaggagaatctcttgaacttgggaggcagaggttgcagtgaggtgagatcttgtatctaccaattttgttgcattattttcaaaattctaatagaatatttgaaaaaatatatttgtatattttcctggattttgtatgtaaacagtcagtgtctgcagttaaggcagtgttgtctcctttttgtaaagattcaacagttatttgccctctttttgtttatttgtttttaatttttgcatagctgggaacctatcatataacttgaatggtagaggcaatagtgtgagtcttgcccttaatggaaatggttctaaaatgtcatcaagtatgatatttccttttcatttttgactggttatttacccttctgggtgggaagttatagattatatttttgttcttttagattttaaccttaatttttagcacctactttgctacagagctattttaaagttatcaaatgtctatttttctttaatatttcaagtgcagtacacattccaaggtatgattattattcttgcctatagcaattatcaggcgttggccaaatcatgattttctttttctgtcattcttttttcatttactaatagaattctactgtgatgaagagctgtgtcttcttcatgtatttctatattcattaattgtttaaatcagtaaaaatttatggatatttactttgttctatgacttgtaatcaggtactgtcattatttatcttattgctcaaattgtcccaaatttggccactggtagctccttcaggttggttcctaggttgttttaacatgtccccatccattgttgaaaacttccttacattctggtaccacaagacatttcagactcatcttgtacttcccctccctttgccttggaattaaccatttctctaaggagatctggttttttttttattggagagtgatattttgaaacctagatttgtattctagttgaacacattgctgctggtgtaatgttgctgtagtccctcttagctgacagagctaggagatatgtatgtgcatgcttatgtatattacatgtgtatatgtgtgtacaccatacacatgtatagacagaaacatatacatctatatgtatctatttctgtatgtatttctacatagatctgtatctatttatttctgtatctgtttatttctaaccatgtgtatatatgagtaaaacatgagttcaactccaaatccatgtcaaccactgcagttcagctgagccttctttccttatttctagctcttttcaatagtgagaaacctggttcttgtaacaagcaactcatttttgtaatcccagtatatacatgaaatcattttacaattgctaaccaatgaaaaacaattcacggcagtgaaaaacaaatctataaacttgagtacaatgtttgtgtgcagttcaatttgcatattagaaggcttataatatttagtcaaaatagtcaaaatccagttacttaggttagttcttttcgaccccaacccactcacttatggttatgttatttatttgcaatacttttaggttcatttgttactgtttttatttcatttgagttctcctagatctcagttgattttaattatttattgtgggggtacatcggaagcattatcatgttgtaagcatctgaactataacacaaagcactcaggcaatgtcacttttccatctctatcttttatcccattcccagtttccttcctattttttccgtctatccctataggtcatcagtcacattcatttctgctttatccttcctgtaattctttttgcaaaagcaaggagttaaatatatcttttcttaaatcctttctctcttccatgaagggtaaggatactatagatactcctttatactttgctgtttcactctacaatatatcctggaaatcattctgtattagttcatggagattctgcttattcttcaatgttctttttatatctgcatagtactctgttgggttgatttatcataggtcaaccactctctgttgttgctcttttttatactctaagttcaggggtacatgtgcaggtttgttacataggtaaatgtgtgtcatgggggtttgttgtatagattatttcatcactcaggtattgagcctagtacccactagttattttttctgattctctccctcctcccaccctccaccctccactctccaccctccaatgggccccagtgtgcattgttcccctctatatgtccatgtgttctcatcatttagttcctactcattagttgagaacatgtgttgtttgattttctgttcctgcgttagtttgctatggataatggcctccagctccatccatgtccctgcaaaaggacatgatctcgttctttttcggtgatgtagtattcatgttgtatatgtactacattttctttatctggtctgtcatcgttgggaatttaggttgatttcatgtctttgctattgtaaccactctcttttgtgtgagtatttagattgttttcagtattttgccatcaggcaatggtggaataaataacatgcacgtgcattttcatgttgttggaggtgtatcgttaaatttctagaagagggatagctcaatcaaaaggtaagcccatatgtatgggatctttttgtttatagcttaaaaattttttttaatgttttaaaaaactcataaaatttactgtgtcaaccatttctaagtagacagttcagtggtgttaagtatattcacactgttgtgcagccaatctccagaaatatctcatcttgcaaagctggaactgtgtgcccattaaacaactcctctttgtccacctccaccaacccctggcggcccccattctactttctgtttctattaatttgactactgtggatacctcatataagtggaatcatatagtatttgtcttttgtgactagttatttcacttagcataatattttcagcatttgtccatgttgtaccctataccagaatttccttccttttcaaggctgaataatactccattgtatatatactatattttgtttatccattcatgtgtcaatggacatttggctattgtgatagtggtgctgtgaacatgagtgtgccgatatttccttgagatcctgctttcaattcttcttaatatatacctagaattgaaattgccagatcatatggtaattctatatttaattttctggggatctgccatgctgttttcacagcaggtataccattttatattctcaccaacagtgtgtaagggttctacttctctctatcctcatcaacacttgccattttctgtattttttttcttttgatagtagctatcctaatgggtatgaggatatatctgattattgttttgatttgcatttctgtaatgattagtgatgctggacatcttttcatgtgcttgttgctcatttttaggtcatctttggagaaatacctactcaagtcctttgcccatttcaaaattggattatttgtttttgtttccgttgagtggcagaggctctttatatattctgtatattaacacattttcagatgtgtgattttcaaatattttcttccatttcataggttgccttttagctctgttgactatgtccattgatgcacagaagttttgaattttcgtgtagtctagttttacttttgttgtctgtgctttttctgtcatatcctggaaatccttgccaaatccaatgttgtgaggcctacccccctgtgttttcttctgagagttttatagttttaggccttatgtttaggtcttgatccattttgggttactttttgtgtatggtataaggtcagggtctatgctcatatatagttttattacatcttgccaaattctccccccaaagagaaagtagtaccagtctgcattcccaccaccagtacatcacagtgcctgtttccccacagccttcccaacagaatgtgttttcattttacaattcttgccaatctgagaagtaaaaaatgttatcagtgttgtttaattttcatttctataattatgtataaaatttgaacaatttctggtatgtttaaggtttatttttagttattttggtgaattatgtatttttttcaatttttctgttttgtttcatttttattttatttattttattttattttattttattttattttatttattttattttattttattttacttagagatggagtcttgctctgtcgccaggctggagtgcagtggcaccatcttggctcactgcaacctccgcctcccgggttcaagcaattctccagcctcagcctccagagtagctgggactacaggcacacgccaccatgcctagctaatttttgtgttttttagtagagacggggtttcactatgttgggcaggattgtcttgatctcctgacctcgtgatccaccctcctcagcctcccaaagtgttgggattacaggtgtgagccaccactcctggccatgttttatttttaaatgtatcaatatgctatattaatagatttcttagtatttagacaatttttcactcttgaaataaatctctcttgactgtggtgtattgttttgtcaatgttgtgttgaattctatttgttaatattttatttagtatttttgcattgatgtttacaagtgatattatatgaatgatattgtgtagtctaaaccttaccacattttggtttcagtgtaataatttgctttataaaagcaagtagaaagtttccttcattttcaagacttggaacaatttatggagcattgggactatttggagtctgggaatttttctgtgaaaccatttgtgtttggtactgttcaacattttcactttttttcttataattttttctgtgttttttcctatacaaaattggtctttttaagcatttttgtctctagtgagatgtaattaacatctgtatttccttaggaaattactcatttcatctaatttttcaattttatttatatagagatctacaaagcattttcttatggctttaaaatttttcttgtatttcctttttgtcatttcttattttattttccttccttccttccctttttttttttttttttttggagtcttgctctgtcgcccaggctggagtacagtggcgcgatcttggcttactgcagtctcaaccttccaggcttagttgatcctcccacctcagcctcccaagtagctgggactaggtgtgtgccatcatgcttggctaatttttgcattttttatagaaacagggtctccttatatttcctaggctggtctcaaactcctggattcaagtaatccacctgccttggcttcccaaagtgctgggtttacagcattgagccaccatgctgagcccatttcttattttctatgtttgtattatctctctttgtgaaagtagctagcagtttgtctattttgttaggttttctttcttttttttttttttaaggaaataactaggattttgatttattgatcagttctactagttttctgttctctgtctcattactttctgcttttatcattatttctgtctttatgctttcttttggtttgttactcttaaaaaatttcgagctagatatttaaatcatgtatttaattctttcattttactggtaaaaatgtttagtgatacaaagttttcattcatcactgctttgaatatacctcatatacactaatatgtagttttcattatcattttatttttaaaaattttttatttcagccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgccagagcgagactccgtctcaaaaaaaaaaaaaaaaaaaaaaaatttttatttcattagtttttggggaacaggtggtatttgattacatgtataaattttttagtggtgatttctgagattttggtgcacccacaggagcagtgtacacggtacccaatggtgtagtcttttttttttttttttttttttcagacagagttttgctctcgttgcccaggctggagtgcaatggggcgatctcagctcactgcaacctctgcttcccggttcaagtgattctcctgcctcagcctcctgagtatctgggatcacaggcatgcaccaccatgcctggctaattttgtatttttattagggactgggtttctccatgttggtcaggctggtctcgaactccagacctcaggtcatccgccctccttgccctcccaaagtgctgggattacaggcgtgagccactgtgcccagcccattatatcattcttatgcttttacatctttatagcttagctcccacttataagtgagaacatatgatgtttggttttccattcttgtgttacttcacttagaataatggatcccaactccatccaggttgctgtgaatgccattattttgttcctttttatggctgattagtattccatggttttgtgtgtgtgtgtgttgttgaatagggtgtcctttctctgctttatgtttttgtttgctttgtcaaagatcagttggttgtaagtatttgggtttatttctgggttctctagtctgttccattggtcaatgtgcctgtttttatatcagtaccatgctgttttggtgactatggctttacagtatagtttgaaatcaggtaatgtaatgcctccagatttgttctttttgtatagtattgctttggctacgtgggttccatttttggtgccacgtgaattttaagattgttttttctagttctgtgaagaatgatggtggtattttgatgggaattgcattgaatttgtagatcacttttgccatatggtcattttcacaatattgattctgcttatccatgagcgtgggatgtgtttccatttgtttgtgttgcctatgacttctttcagcagtgttttgtagttttccttgtagaggtctttcacctccttggttaggtatatttctaagcattttattttatttttgcagttattgtaaaacaggttgagttcttgatttgattgtcagcttggtcacagttggcatatagcagtgctactgatttgtgtacattgattttgtactctgaaacttcactgaatttatcagatataggagctttttggatgaatctttggggttttctaggtatgtgatcatcatatcattggtgaacacggacagtttcacttcctctttactaatttggatgccctttatttctttttcttgtctaattgctctggctaggacttccaggagtatgttgaacagaagacgtgaaactggatatccttgtcttgttccagttctcagggggagtgctttcaactttttcccattcagaattatgttggctgtgggtttgtcatagatggcttttattacattaaggcatttcctttgtatgctgattttgcagagagttttaatcataaagtgatgctggatttcgtccaatgttttttctgcatctattgaaatgatcctgtgatttttgtttttaattctgttcatgtggtgtatcacatttattgtcttttggatgttaaactatccaagcatcccttctgtgaagcccacttgatcacgctggattatctttttgatatgctgttggaattcagttagctagtatttttcttttttttttttttttgaggatttttgtatctgtgttcattggggatattggtatgtacttttctttttctgttaggccctttcctggttttggtaatagggtgatactggcttcatagaatgatttagggaggattctctctttttctatcttgtggattagtgtcaataggattggtaccaattcttctttgaatgtctgatagaattcagctgtgaatctgtctagtcctggacttttttttgttggcaattttttaattaccatttcagtctcactgcttgttattggtttgttgtgagttttcatttctttctggtttaatctaggagggttgtatatttccaggaacttatccatctcctgtaggttttctagttaatgctcataaaggtgttcatagccttgaatgatcttttgtatttctttggtattggttgtaatatctcccatttcgtgtctaattcagtttatttggatctccttcttttcttgattaatcttgctaatggtctataaattttttctatcttttcaaagaaccagctttttgttttattaatttttttgtattttatttatttttgttgttgtttgtttcaattttatttagttctgcactgatcttggttgttttctgcagctgggtttgggtttggtttgttcttgattcactgcttccttaaggtgtgaccttagattgtctatttgtgctctttcagactttttgatgtaggtgttcaacgctatgaaatttgctcttagcaccacttttgctatattgcagaagttttgataggttgtatcactgtcactgttcagttcaaagaattttcagatttccatcttgatttccttgttgatgcaaagaccattcaggagcaggttatttaatttccatgtatttgtagtgttttgagggttccttttggagttgatttccagttttattccactgtggtctgagagagtacttgatataatttcgattttcttaaacttgttgagactggttttgtggcctatcataaggtctgtcttggagaattttccacgtaccagtgaatagaatgtatattctgcagttgttggatagaatgagaacataaatatctgttatgtccatttgttctatggtatggttaagtccattgtttctttgttgagtttctgtcttgatgacctgtctagtgctgtcagtggagtattgaagtccaccactcttatcgtgttgctgtctatctcatttcttaagtctagaagtaaatattttataaatttgggagctccagggttaggtatatataatttaggattgtggtattttcctgttggattagtccttttatcattatctaatgtccctctttgtctgttttagctgctgttgctttaaagtttgttttgtctgatatagaaatagctattcttgctcacatttcctgtccacatgcatggaatatttttttctacccctttaccttagatttatgtgagttcttatgtgtcaggtgagtctcttgaagacagcagatacttggttgatgagttcttacccattctgccattctgtatcttttacgtggagcgtttaggccatttacattcaacattaatattgagatgtgaggtactgttctattcatcatgctatttgttgcctgaataccttggtttttttttttcattgtgttattgttttataggccctgtgaaatttatgatttaaggaggttctgttttgttgtattttcagtatttgttccaagatttagagctcctgttagcagttcttgtggtggcttagtagtggcgaattctcttagcatttgtttgtctggaaaagactgtatctttccttcatttatgaagcttagttttgctggatacgaaattgttggctgataattgttttgtttaaggaggctaaatatagtacctcaatcccttccagcttgtaggtttctgtttagaaatctcctgttaatctgataggttacctgatgcttttgcctcacagctgttaagattctttcctttgtcttgactttagataacctaatgactatatgcccaagcggtgatctctttgctatgaatttactgtgtgttctttgagcttcttttatttggatgtctagatctctagcaaggccagggaaattttccttgattattccctcaagtaagttttccaaacttttagatttttcttcttcctcaggaacaccaattaattttaggtttggttgtttaacgtaattccaaatctcttggaagctttgttcatttttttttttgattctttgtctttgtcagattgggttaatttgaaagccttgtctttgagctctgaagttctttcttctacttgtttatttctattgttgaaactttccagtgtattttgcatatctctgagtgtgtcttttatttccagaggttgtgattgattgttttttatttgtggtatctatttctctcaagatttttccatccatagcttgtattaatttttaaatttaagttgtttgtcaccttttgctggtgcctccttgagtagcttaataattgaccttctgaattctttttctgtcaattcagtgatttctgcttggtttggatccattgctagtgagctactgtgatcttttggggtgttacagaaccttgttttgtcatattaccagaattgtttttctggtttcttctcatttggatagactatgtcagagaaaggatctgggactcaagggctgctgtttaaattttttttggcccccagcatgatcccttgatgtggtgctctccccattcccctatggttggggcttcctgagagctggactgctgtgattgttattgctcttctgggtctggccacccagcagagctactaggctatgggctggtacttgggggtttctgcaaagagtcttgggatgtgatctgtcttcaggtctctcagctggtctctcagccagcacttgctccagttaccaccaccacacctggctaatttttgtattttttgtagaaatggggtctccctatgttgcctaagctgaatttgacctcctgggctcaagcgatcatcccacctcagcctcccaatgtgacaggattacagacatgagccacgcactcgacttaatcttgtcttttagttccgttttttttttttctgagtttcatcactttcttctcactcgttcatgttttttgtccgtgtcttttcttagttttggaatttctggctcaaggtggcttttcgcatccctcatcctgcctatttctttatctgtattttattctctattttggtgtcttgtatttcctcagtgcttcctatgaattattcatttgagcccctctcttgggcatttaataatttattatttatctttgagatttttttttttttggttatccaggctggagagcagtggtgcaatcatacctctctgcagccttgaaccctaggctcaaagggatcctgctgcctcagcctcccagatagcactacagacgtgagcaaccacatttggccaacttttttatttttgtttttttgtagagatggggtctcactatgttgcccagaatggtctcaaactcctggcttcaagaagttctcctattttggcctcccaatatactgggattacaggcatgagccagagcacctggcctaattttgtcattttcttccatttcttttctgagggtcatcattttctcttcacactttcctgttttttgtccatatcttttcttagtttttgaatttctggctcaaggtagcttttcctatcccaaattcttgtttgagtatattggttccatctggaatgttgccttctagttttcttgtgcttcatggttgttttgttgaagggaatttacctctgttgctgtgtgttggatattctgtctttttaaaataatacttcagtatgagtctgttcatcatttttttgtttgtttttatgatattggggtgttttataggatttttagctcattggctccctcttctgtcactatagcaaagtccagatctttgttttggtagcatcggaaggtttgtggtctctgaattttagctgtcttgtcatcgggtaggattccaaattttcccttttttcctgtttctcttttagccatccaatagccaaagggcatttctctctactttttgtttccttttttatttcccagaagctacgtgtttcaaaaactggtcaagattgtgtctgcttttacatcccatccctatagtcagctctgtgatctgtctagatacctttttagtattttgaaacttagggttgactttgtctttcctctgatggttttagatcaaccttaagttcatcactaattcccttctctctttgttatagtttttcacattctacctttgtttgcaataaggccttctggcagatcagggacagaggaggagcatgagatatcacttgctgggattaggtgtctttttcttatttttatttacagttgttttggattttggtcagttcagttttcaagtgatcccgaggacatggtttttgtgtagttttgctgcttatttttcttgtcctctattgcttctggaggaaatattgaaagatggagacataagcaaccacctttgtcagcctgagagtttccaaagctgaatgttttaaaagtgcatttttaactatttttcttcattttgagttttgatgttacattttgtcacattatctcattaaatttgcacatctctgagctacacatactatctccatttcatgaatgaagaaatcaaggtccagcaagattaaatgactcaagggagatcacacaaccagaaactgatagagattctaatcaactctaaaattgtatgatgccaagctcttgttctttccactacatcttgccatctccctgagtaactgaacttagaaagcccatgcattaattaaatactgcaacctaaaacattttagtgattataaatgtaaactgtcagtttattcatctgttccttgtccctcctgttatcttgcagtcctgttatatttttagtagcctcttctccactggcttctactccttgaccttctaaggtacattttctttcctgtaaacgagatcatgtacattaagtgctatctcttgaaaaaaatgattcaacagatgtcaattttgtttatttatttattttcctaatagaggtttttactctatctccccttatagcagacctaccatcatttccctcttggcccactttcacgtacgggaggacccgtgcacactcaccttgctttcaaaactcactgccctccctgcgcaaactcctcacttcatggaaatgatagccccaagtagcagttggcaacaacttttggctcctcctttctggagtgggtgttgtattgtctgtagttttctttaaagtaatttaatctgcaccttaggggtgcttagttaacatttttgaagtaccttaatcatgaatctacactccaggggtagttagttaacatttgaaagaccctaatcaaaattctatactccagaggcaaccagtgcctcagatattgctctcaacctgtaccagtgggtgcattaattagaataaaagatgtaagaagtaatttttcacggtgaaggaaatgctatttaagatatgtagttggccagtttcctacacagagataagacatgagtggaggctgaggatacagatttggcaagggcaacagtcttccaacctaggtaggcccttgatttggtcctgtgcttgctgcttttagtggaggatttggtttggttggctcacctggcctgtggagcgcattaagtctttattaccctgcatgggccaaatccagcctgcttctgtctgcttctccatccagcgctcattggaactgtactccggctcctctccatgtttgcatttcttgtccacagagatgttattctcaatcttgagtcagatgatttctttttaatttcttaatttacatttttaaatttaattatattttgagcatattggatatgttaagagtgtgaatttatagtgccattttgatcagaagcactcacattatttttaaatggtaactttcttactattttctacttgagaatattgtcagtattctcaggccaggttctcatctgtggggcttctagataagtaacttgtttgatattctagtggtctaattaggctgggtgatgtttttgaacattcctttttatatttaattctattcaatagtgacagttctcatgtgatagagggataatattcttgaatacatgtgatttaagttacgtagattgaaatcatatacgtgatttttgtgtaatttgtgtatcatgcgtagtataaggaatgacatctaccaagagtttctatagtaaacattactattgtcctatatcttagttaacatgtacaaatataaatgaaataatgcagtttatgaagtaaaatactgaagtatatcaccagggcccttattttctggggtttggtgacgtgtatgtgtggtatggcatatattactgatcttgtcccatcaaatatactgagcaaaggaagcagtcatgatgaactggtggtctagattgctttctgtactcactaggacacgaagtaattttttaaataaaatatttaactgtataaatagtctatttagcttttttatatgttattttttaagtgagccatctataatataggtatacatgtaagtagctgtaggctgtgtaatcaaggatatatagacgtaaactatactttttttttttttttgtgaggcagagttttgctctcttgcccaggctagagtgcagtggtgcgatcttggctcactgcaacctccgcctcctgggttcaagcaattctcctgcctcaacctcccgagtagctgggactacaggcgtgtgccaccacacccagctaatttttgtatttttagtagagatggggtttcaccatgttggccaggatggtctcgatctcttgacctcttgatccgcctgcctcagcctcccaaagtgctgggattacaggcgtgagccaccacacccagcctgtaaactatacttagtggaatcatggaattgtagcgaatgaaaggaccatagatattatctagtcaatcttttcatgagtcccagagagttttagctaagccctcctttcatgattccattcttagcttcaatcacagagatgatttatagccatttagacatacataccaatatatccatatctatacatacaatgtgtgtgtgtgtgtagggggctgtgatcacaagcacttggggccaatagaattttagtagaaataattggttaaagggcattaaaatcttttaatatttagcattatcagtctgtgaaagtcttcgaaactaggtttgagaaatctttactcattaagaccctcagagcagaaaaatcaagggtaagagaactgggaaaggaagttaagtatttctaattttaaagtgttctaaaacctacacgttgagtacatattgtagcaatatagatactagggaatgatttggagttcagtagtttggaaatacgtatattttgttataattctgatgtgagactttactgaattcctgttaaattatttttgtgcagggcttttttcataaagcaccaataattctacctgacctcacagggttttgtgatattagactagtcatggttgattatattatccttttaaattgccttttaattttcagctgatgtaagtgaaatagataatataaattaattaatattggatctgttcagtgtttatgctctaggagatttcaggagacaaacagaaagagaaggttctaaacaagtgccgtttggggctgtgtcattttattattcatacctggcttatttgttgttctttaatgggctatctatcatattagtgtgtatgtaagtggctacatgtgacataatctcaagtcttattgatttaaactgcatttacctcatcactaatcactcttgtggcaggtagctgcagtgttcagggggcactttgtatgtgtcacgtttgtgactcatacgtgcttttttgtgaagagcattttgtctcacctaaattcctattactttttggtcctacctgaagctctgcttacaattttgcgtatttctacccgcagtccccaaacatgctgaatttagttggcttgttggccgctaaatacttttctctccttgctgtggggttggttttgctggatggagtacttctctttcctgaagtatctagcttcttcatgtgtaaaacaaaaccagtaactgaaatgtcaaatttggaaatataaatgactttttttgatctgccttcagagttgcgttgtcatctttataagcttaagacttcctggttttattccaagttttactaatattcaaaaagtttatttgttaaatcccatatcatcaaatgcactccacattgcaagtaaaaccaaatgaatctggtcattatacctctttctactcatggatttcagggatctaatgagcttagtaagatttgcatcatggataaatagaggacttattcttataagaataaaaattgtgtaagtgattatatcatgtatgtaattaaaatggttttgattcagatttaaatgttttttttttttattgtggtaacgtcacataccataaagcctaccattttaaccattttggaatgtacagtcctgcagtgttaaatacattgatagtgttgtgcaaccatcaccaccatctatttccattactcttttcattcttgtaaaactgaaactctgtactcattaaagaccaattccccatacccctcttctcccagctcttggcaaccaccattctactttctgtttctataaatttgactaagtacggcatataagtagaaacatacagtatttgtctttcttttgactgagttatttcatttagcataatgtactcaaggttcatccatgttgtagcatgtgtcagaatttccttcctttttaaagctgaataatattccattgtatgtatatatcacattttgcttatccattcgtgtgttgatggactcttgagttgcttccacattttagtgattgtgaataatgctgctatgaaaatgagtgtactcttcaagaccctgatatctcttcaagaccctgcctgcaattctttaagtgtatactcaattagaattgctggatatatagtaatttcatttttaattttttgaggaaccgcaatatgggttttcatagtggctgtaccattttacattcccaacagcagtgcacaagcgttccaatttctccacatccttgccaactcttgctatttcctgtttttttttggggggggtgatattaatagtagccatcccaatgagtgtagggtggcatctcattttagctttgatttgcattttcctaatgattagtgatgttaggcatcatttcaagtgcatattggccatttgtatatcttctttgaaaaaatgtctattcaagtcccttgcacatattcaagttgacttttttgttgaatttaggagtgctctatatattttgtatattaataccttatccgatatgtgattttgaattttttgtcctattctgttggttgcctttttactttgttcttagtgtcttttggtgcacaaaaattttaaaattttcatgcagtccaatttgattttttcttttattgcttgtgtttttggtatcatatccaaaaaaatcattaccaaatccaatgtcataaagcttttgccctgtgttttcttctgagagttttattgttttaggtcttacatttaggactgtgatctattttgagttaatttttgtatatggtgttagataaggatccaacttcattttttgtatgtagatattgtttccctgtacagcatttgttgaaaggccgtcctttccccattgaatggtcttggtattctcgccaaaaatcatttgactgtgtatgtgaggttttttcccctagggtctcttttctgttccattggtctatatatttgtctttgtgccagcaccacagtgttttgattactgtaacttctaagtaagtttgaaattaggaagtaagttttgaaatgaagtatgagtcttctagatttgttcttctttttcaagatggtattggctattctggatcccttgagattctgtatgaatttcaggatggtctctctctgcaaaaaatgtcattgggattttgatggggcagttgcattgactttgtaaactgctttaggtataatagtattggcatcttaacagtagtaagtcttccagtccgtgcacatgggatgcgtttccattcatttatttgtttccattaattataattttttaatttagcaacaatttcatagctttcattatatagcttatatatattatagctttcattatataaagctttcattacataagtttttcatctttttcgttaattcctgattattctttttaatgtaaactgaattatttttataatttccttttgagattgttcactgttagtgtatagaaatgcaatggacttgatcatagtgtatagtcctataagtatgctgctgaattcagtttgttagtgttttgttgaggatttttacatctgtgttcataagtgatattggtttgtagttttattatactgcttttatctggctttggtatcagggcaatgctggcctcatagaataacttaggaagttttattcctttttctagaattttttggaaaagtttggttttctttaaatgtttggtagaattgaccagtgaagccatcaggtctagtgcttttctttgttggaagattttagactacttatttaatctccttactagttatagatctatttggattttctatttctttgtgatttagtgttgataggttttatgtttccaggaaattgtacatttcatctatgttatataacttggtgttgtacgattattcacagtactctgtttaatttatttctctagaatcaatggtaatgtaacttccatttatgaatttagtcatttgagtcgtctctatttttttcttagttcacctggctaaagatttgttatttttgatgatgttttcaaagaaccaactttgatttaatcagtttttggtattgtttttctattctctattttatctctgctctaatctttatatttacttttttctgctagctttggttagtttgttctgttttcagattccttaagctgtaaaattaagctgttgttttgagatcttttttgttttttaccgtaagcatttataactataaatttctccttttttgctgtttttcctgcatcctgtaaattgtatttcatatgttgtgttttcattttcattaatctctaagtaattttctaatttcctttgaggtttcttctttgatacattggtttttaaagagtgtgttaattgacataagtttgtgtattttccctttttaactttgttattgatttctaactttatccctatttagttagagaagatactttgtgtgatactttctacttaaatctattgagacttaattggcagcctaatatatggtttgtcctggaaaatgtcccatgtgtacttgagaagagtgtgtgtgttgctgttttggggtagagtgttctgtatgtgtctgttagatctagttggttgattgtgttaagtcttctgtttccttatttctgtctggttgttctatcaattatcgagagtagggtattgaagtcttcaactgttgtagaactgcgtatttctgccttcaattctgtcagtttttgcttcatatattttgatagtcattaggtgtataaatgtttataatggttatatcttcttactgtgttgagcctttattaatatataatgtccttctttgtctcttgtaatctttttttgatttaaagtctattttttctgctcttgttttgctgctgttttcatggaatatctttttccagccttttactttcagcctatttgtgcctttgaatcgatttgtgcctttgtagacagcatataattggatcatgaatttttattcattctaccagtctctgtcttttggttggacagtttaacccatttacatttaaaataattactgataaggaatgacttatttcagacattttgctatttttttctatatgcattattttttttacccctcatgttctacattactgtattattttgtgtttagttgactttttatagtgaaatgtttaaattcctttctcatttcccgatggtatgcattctgtagcatttttctttgtgcttaccataggaattacatttaacattctaaagttataactctctaacttgaatttataccagtttaacttcaataaaatacaaaacctccactcctttaatggctctgtccctaccacttttggttgttgatgtcacagaattatatctttatacattgtgtgctcaaaaacataaactagtaattcttttaaatgcattagcctcttaaatgatgtaaaaaacaaaatgtggatttataaaccaaagttaacagtaatactagcttttagactaataattgtgttttaaaaatcttttaatattttaaattatgtagaaaacaatagttagaaataattgtcttgttgtaacactactaatttttataattgcctagacgtttatctttattgagatatttatttcttcatatgccttctagttactgtctaatgtcctttcattttaacgtgcaggactttataaagcatttcttgcatggcagtcctgatggtactgaaatcctgtagcttttgtttacttggcaatgtcttaatttttcccaatcacttttgaaggacagttttgtgtgatacagaattcttggttgacagtttttttatttgtttgtttgtttgttttggcactttgaattaatccactgccttctggcctcggaaatttctgatgagaaatctgtggataatcttattggggatcctgtatatgatgagtaacttcgctcactactttcaagattctctctttgtattttgaaaatttgattttaatgtgtcatggtgtaggtctctttgagttcctctcacttggagttttttgagcttcttggatgtttatattcatgtatttcatcaaatttgagacactttcttctattatttctttaaatattctctgctcttttctctctttcttctcctttcagagctcccacaatgtctaaattgtatcctgtgggctgtcttcacttctcttcaatcttttttcattctgttcttagatgataatttccattgtcctatcttgacgtttgctgattttttttcttctccctgctcacatctgcctttgaatccctctagtgcatttttcattccaagtatacttttcagctcaagaatttcttattctttttatttttttagttcttatatctctttattgatattgccagtttgtttatacattattttcttgactttctctttattttttgttatttgagcatctttaaaacagttaaaactttaaaaaaaactttttaaaagttttttttcttaatatatctaccattaagtctttttcagggacagtttctgttgatttattttttttcctttgaatgggccatatttgcctctctatttctatgctttgtgattttttgttgttgttgaaaactgggcatttgagtttaatgatgtggtgactccagaaatcacattctccctcttttcccgggttctctgggttttgatgttgttattgttttgttttataaattattgtagtcagtgtctatcctaaggatcagcctgggtgttaatttaagatctcctcaaataaagcttttctaagcctgcacctttacatgggcatgcacagtcaccttataattttttcaatacatgcatttgtttttgaatgtcctagtcctaatgtttggctttaaaacggggagcaagagaaaaataaaggcagtaggggaaggctactggctgtttaacttccctggaatttacttcagcaagagtaggaggggcttgaaaaattggaggaggtgcaacaacaattgtcacgtgcctctttgtacctctgtgattagaggaagcaatcagcgatcagagcatagattcttgatacttggcaggcagggttctttttgcccaccctgtcttcccaccaggtgtgtgcaaggtactccaggaacaggtacagggatgtctgccacagtgctaggtagctactttggtaagagctgtaattgaaatcgaccacaatttaccatccaagtgttcccttggaagttgcaagccttccatagactccagagttacaaaatagttacatcagacagattctgccagtacaatcgtgtaggtggggagattcctggtgcctcctactctgcagtcttcccagaatcctccttaagagcgttttataagctgggaacccccaaaatagggactgaggagaatgccctacagtggatttcacatcatctgaagtagaggttttatggactttgtgtagcagttacaagaactcattccatatactgggatgttttctttcttccctagtagatttcagtaccattctagtagtgctgaataacttagaatggcttgtagtctgagtttaaatctactaaggaagaatgtattcattctttcaggatattgcagatttttaaaatcttgcatttgttttgagagatggaggacagaggtggatggggaaaacttttgactattaggctccatcttcagctctgtactcacttttgcttttgtatatcttaatccagccatttgtaaaatgaggcagttacttttaagtcagagatttgtaacgtcctgttttttttggcagttgcgaaacccggaattcctatgtgaagttttgcatatgtatattcatactttggagagcaaggcctgtggctttcagtagataacagagatctcctatcagcagttctcccctctctccaacttgccacaggggttaaaaactaaagttttggttatttcttccatttcagtgccaaattgtttgaaagaatgctgtattctaaagatctacagaggcttttgacatataacattacttctcagaagcctttcatggattattagcaagatctgtctcctatagataattatgttgtagcagacatatgtttaaagaaaaataggttgttcttttgtatttatgaaatacctcttcgttaccctatttcctcaaagtcttgtctcacttgtatgtattgttttcccttaatctttttaaaaaatttattataattttaatttatttatcactcttccccctgtgtgtattcatgatgtctttttctccagcgacttaccacttttaactaacaaatacaaacctgaggctaggatccagctcttcagaattctcttgcagcgccacatatggcattttataaacagcgagtgcctaataaatgtcatgagccagtggactcatggcagaagtagtagtctgtggaaaacttcccatggtgatttgtttactaatttttattgcatctgcctcttattactaactgatgggtatgatttgaggaatataaatgttattttgtgacttttggatggttactgtgcaaatataatttaattgaaaaatcctctttaattctttaagagagtaatcaaggcagtgatttcgtttattagactgctctgttttggggtttttgagtggagtctgtatctattattgttattatttaatttttcagtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggtaggtgggagtgtattttgtatttttgacaactctatttattgcacattttctagggtggggcgtaagtaacttaccttctgttgatgttgttttcttgaacttaggatactatagcccatacaggccaggcgcagtggctcacgcctgttatcccagcactttgggaggctgaggcaggcagatcacttgaggtcagaagtttgagaccagcctgtactagtagtgaaaccctgtctctactaaaaatacagaaattagctgggcatggtagtgcatgcctgtaatcccagctgttctggaggctgaggcaggagaactgcttgaacgcaggaggcggaggttgcagtgagccgagattgcaccattgctctccggcctaggtgacagagcgagactccgtcttaaaaaataaaaaggatactatagcccatacaaactttgattggtaaaacagcttgactaggcataattcagctgtctgttttttaatgttgttgaaaaattcaaagcatattgtcactcaatgaaaaatatggacatatttatagtagagattgtcgatatttaaacatttaaagaataaattgaatcaaataatgtagcagctattgtacacatactaagtactcagcaatgttcaaggcaatttatgtatattatctcacttaattatcactacaactgtatgacctagttattagtatccacatattgcagttaggagaactggagctcagagattgaataattagcaagctcttagaaaaagtcttggtgttgaatactagtccatttgattctaaaatccatggtctttcctgtgtctcatgctttcttctttaatgtgtaatgatatttccaatagacaaatcagtctcaggaatttttaaaacaataagatttgaatttcataattcttatttcatatggagagtacggaaattgaattcagattctaactttgtgactatcatatactaacagatcatgtgtgacaaacaagaagaaatcataatcttgtagatacgttgttaaggaaatatctactgtttatacctagggctcaaagtttttttaaaagaagataaaattaaggagaaataataactcatttagtatagagttctctatagacttatttaaattttttggaaaaattaatactgtatttctgtgttcttttgcatatgtaaataacattgatttcaattatactttaacatttcaaaaattaatttccttgtaaacttgattcaaaagtactatgtttggtgaatggaactaccctttatccttctcctgccacagaatgtttcaaagtaaatatttggccaggcacagtggctcatgcctataatcccagcactttgggaggctgaggtgggcagattgcttgaggtcaggagttcgagagcagcctggccaacatagtgaaacgccaactctactaaaaatacaaaaattagctgggcatggtggtgcatgcctgtagtcccagctacttgggagtctgaggcacaagaattgcttgaaccggggaggcgaaggttgcagtgagccgagcacactactgcactccagcctggttgacagagtgaaacttcatctcaaacaaacaaacaaacaaacaccccaaaaaaccaaaaccaaacaaacaaaaacaccaaaagtaaatatttgatgggttttggagaacagacctgactttgtatccccactttgtgatttgcaaaaattaacctgtcttacagtgttgcttgctttagatgaggttatatggttgtggtgcttagtggaatagcaccagtaagtactataacatgcatgcctgcttgtataaaatgcgtgtgtatatgaatatatgtttattatcggtgccttccccaaattccatgttctatgatcacttacatcatgatccagagaagctggagaatggttctttgaacttttgcctttcttctttctttgcctggcacctggattttcgtgaagaccttttgactccttactgatgaatactctaaaattctggtttgctctttgcctgttgctgcaagttcctagatgaatacagtgaactttcctagggaaataacattgctgtagtatatattggaaataaaagggcatggattaataacttttctgcagatctcattatagtacctttaaaagcactgtgtctttcataggagtttcatctttttttttttccccttgcctaaaccccttccagaattcacgagtggaaattatagcactagaagtataatagaaattcagcacactgccctgggaaatactaaatgtttctctatgaggaatgagtcagcagcaggatttttttccctgttaagtgtctttcgtttgtccgtattttagaaagcttttgtaggcaggatatattggacactaacaagtgaatgagctgtttgccttggctgtatgtataaacataatcccattttataaaacatacaaattcaagatttgggacccaaactgtttattatgagacaaaatagtacagagaaagcaagtatttagagtaaaccactttgttagaagatcaaagattaaattttggggctgggattccaaaggactgataattttgagctagtctctagtggttatgtgctgtcaaatgctttaaaactttcaaggaattaattctcttgaattaagcagagtcattcaaaaatgatcagcattgttgcttctagaggattggaattttagaagcaatattgtcaaattatcatttgaagcttgtggtgcttttgtgcattgactcttacttaggaaggtattagtggcatttatttcagagagaagtaaaatcacaatacttggcattatttattattgtttaccattcaaggaattttatggctaaagatatatgaatttatttttttaaagaaagttggaacagagaccaaaaaatccatgaatcctgtttcccaacatgaaaattttctcccccaccctccagtgaaatatcctgttccaaaacattagttattctgagacaagatacccatactgtaattttccctaaaagtttcatcatcttattaaatatattctggttgtgatgcattgcaggcttgttttcatttgtctttatataaagagaattaatgttgtgtgctattttgctagaaatgtagaaggaaacaaactagtgaattctttcttgcttttaattcctacagagccaggatactttcccagccagttttttaaaaaatcactttggtgacctacttattattttattttattttgtttttgatctcccaaactatctgttgtctatttataggagaaatattttgtcttttctgttcattcataatctatcagtgtctttaagcctccacttactattaaatgaaaatattcaaccacaattattgccaacttgataaacattagggtaacatgtgccttgctaatttaccagaaccacctgctacccattatttctctagaaagacaggcagcgtcttcaacttcagatggtgactgtggcctgaagcctctgcatttcagaatcaatttcttcaactcctgctgcctaattgttgattctttcccaaaatctgattcatgagtatttttatattatttttatttgaaagaagctggaaggagttctgtacttaacaaataagaaaagcataaggaagagatggaagaaaaacttctcaaagatgtggtatcttgtcaagaatatggaagaaaagaatgtgggaaaagagaatggttggtatgtgtgagggaaatggacctgtttaaatgcaaaggcaaaaattcattgcaggaagggatggtggaggtcagcttcacttaggtagagctgtaggtcctagagagtgcagaaggcgttgagtgagttggagccgttgcttccagggagacctttctctcttttggaaggaaaccattttaaaaggttcattgacttctgttatgaagaaaaagattaaatgtcagatgtgaaaagcagagaactttgtgggttttgggcttgttgtaatattgaagaaagcttcatggaaaacatgggaaagaaatatactttaatgctaaaagtagttgtgtttggttagtagggttgtagtctttgctttttcatctctgttttgcacctcaagttatagtgaaaataattcattgtcaaaaaattaaattattactcaggttattttaatcacaagaaattattagaaataaaaatgcctgtgggggtatgaatgttcataaaactaaattttaatattgaaaaatataatacctgtttttaaaccaacttgacatcattcattaattttattatatatgtgtatctttatatatatttggttatttattggctgcctctagaatggaagagaagagagcactagtttgtcttgttcagtactggtgtatctccagaatctagcacagtgcccacctgacccataataaatatttgttgattgcaagaataaattccacatttatgaaatatctgccatggaccagacattgggtaaaatgcccaacaaattatatgtggtccctgtcctcatggagtttaaagcaggaaggaaggcgttactcaaagaacgctaagatgtgagaatgaaagcagccagattcttgatatgccattttcactgtttttgcttacctctgtattgattaaattttttcttttttttggagacggagtcttgctctgttgcccaggctgaagtgcagtggtgtgatcttggctcactgcaagctccgcctcctgggttcacaccattctcctgcctcagcctcccaagtaactgggactacaggtgcctgccaccacgcccggctaattttttgtattttttgtagagacggggtttcaccgtgttagccaggatggtctccatctcctgaccttgtgatctgcctgcctcggcctcccgagtgttgattaaattttaactgttgccaactgtgctttgcttagagatgataccaatttttcatgtaatggataatgtttgagagttcctatatccccttgccaacagattgtattatcaaatacttttatccttgccaatctgagaggtaaaaaatggtatttttggatttgcatttttattgtaaggttacacttcttttcgtttgtataaaagtaacttgtcatgatatctgggttatatatggatgtattacttcaaaataaaatgagttgcaaatgagtgaagatatagatacaataagccatgaaatgatactgaagcagggtgataggtacaaggtggttcattatcctattatcttcacttttttaatgtttgaaattttcaacagtacaatgtttaaagtgtttatttccttttcaatgaattatttttctaacatgtttgtctcattgatttgtaggaactctttacatatataggaaatttgttctttgggatttattttgtaattttctgccagtttctttctcttttgacttcatgatgtttctgggcatgtagacatttgttttaattttttatgagggtatatttatcaggttttatagcttctgggttttgtgtcatacttagagcttccctactcttagattataataaaattttcaacacttttctagtacttatatagtctcattcttaatatttatatctttgatacatctgggatctgaaggagtgaccaaacgacttttgagcacacctgacacatactatactgtattgtaaggggttgtacacccttttcttttctgtcatccatgtgtctgtcatgtaattgtccatgttagctgcataattgctgaataattctaacgctgagtcgtttatcatatggtgatggttcttctcaaggttggtatttgccacattttctaaaactctttttttcctcctggtttctcagtctgtgaagactatagattttcagaaatacgttgaattattgctctaaaattggaaaaatatacttttgaaatattttttataatttggaggccagaattcagaatgagggcatactgctgtaatagaactttcttataaaatggttttatctgtgaggaagactaaaggctcaggcctcaaggatagttttatagtatgaatacaatgtttatggaaggagaaataaatgaaatattgctcatgattttttttagacctgtggctagattcaggcatgagtttctatttcacataaatagcatttcgttttatctcttctttctatattagttacccttcttctaagtatccgaaatgcaggacatggtggaattggtcattttattttacagaaaagtcattcaagagcagctttgaagcaaggtcaggcattttccttgtggcttcttatagccattcccaggcaccgcatgtagcacctggacatgcttggaatcaggaagggcctccgtgtaatttagatgagtagttaattcgaatcaaagcaagcgggaagcaagtaaatttaacttcagtgattatgattccatttgattaaatctctacttttgattacacatatcatgagaacatgctttaaatatacccaactatttaatattgaaggggatgaataggatgaaccagggacatatagaagaaattccactattcttcaactaggatatgtcccctgcagcttaactgaaatatttttagaacaaatgaaaggataattttttttacatatgggacttgttactccaattgttaactaaaatatataactcattaccatgaaaggtcccaagtctatatactttctagtaagacttaaataaattaatggataatagctccatcacatatacagtgtctgagaaatgtcaataatgttcatagttcttttgtaaacatgagtttggacagctatcattctggttgtgtattgtcctttggttatagtcattagagaaaggcttcttggctgaataggccagagatgttactcaatattacatttcttaaacctttgtgttttatgtggcaaagttaaaaaaaaaaaaaaaaaaaacctactctcgatttctcttgttttacatattatagtaggttcaaattaaagatctgaccagtcaaagaaatagagacaatctgtttcatggactgtaataactttatttagatggcagccatcatgctgtatcaaggccacttctctgtttgctagagtgggagctgccttaggttttgtcatttttgtgcacttgctattgttataataggaaaggcactccaagttcaaaataatactggatcttttcattgcaaaaatgaactaacaaacctatgtcaaaagaaattcttacgttgatgatgtgtaggggtggtgtcatatatgattaaagcaccttcatgtgtctctcaggctgtatttcaaattgtctgggtcttctagctcctgccccatcctcttgctatagtctctaatcagattggactgtgagtttataaggggaggtaactttgtgtttgcagcctgatttagggctgggcacatacgaaatgcctacaagtttatttttatggagatgtggtctcactctgtcgctgaggctggaatgtagaggcccaatcatcatggctcactgtagccttgaccccccctgggctcaagagatcctcctgctttagcctcctgagtagttgggactacagttatatgacacgatgcctagctatttaaagtattttttttttttttttaagagatagtgtctcacagtgattgcccaggctggccttgaactcccggtctcaagagtctttccactttagcctcccaaaatactgggattacaggtgtgagccaccatgcctggccagttttaatgaatgaatgaataagaaaaagatgcaaataaggtcatttagtggaagttattattattattttcagcactactcacagtgggtctatggacccacatcaccagtgtcactagagagttggaaatgcaaatttccccaagaagcagtggttattaaattggaatgtttggatgcagggcccacaggactctatgccttagttgattcttatgcacactgaagtttgagaacactctttagataacatcacaaacatcatagaattttgcagttttgtagtattcacgctttgcaaagccatctgccatctggtatctcacctgagtgagcctcaccacttgcctcctcacaggcaggggcattattattaatcccagatttacccagagaaatgtgaaagctgaaataatttgacagttcacaaagcttgttcgtggtgcaattaagattagaagtagtctttttccaccatgtaagtttgctttctggcttatataaacatgatgtttccaacccatgtcatgggcctgattttgtttgtcctcagaaggacgatatctgtactaaatatccattttcctgcccatacctcacactgtggtcagtggcaggcctcagagatagctggacatgttgagaagcgtgaaaagcagccacagagtgcctggattttaattaggtcacttgagaatcaaattttattatctaaacaattcctctaggggcattcttgtactaggaacaatatagtactaagaacaacaaagcacttgtactaagaacaacaaagcactaagaatatgcacctaaaatcttaacttttgttatccctgggaagtggatttatggatcatttttctaatattccactatgatgaaatgttatttttggaatgggggaaaggatttcaaaagaatgatactgatactttaattcaaagaaatagggcctgggtttattttctaattttagccacaaatttggcatacatcaggattagacgtttgaggtcatctctccagaactcagaaacctgacttgacaaggagggagtaacacaggaaggaagtgactagcaccaggccccacttcagtattcttgttatttttactgtgtttcattctatattactactaattttttcttgctcttttcatagagcagatggagaattagtcagcactctttaaatagtaacccctttttacatgaagacttattaataagtggtaaaacgtatttctatcccttagaagtaggtattagataaccttgaagattaaatgggctccatgtcctatttgaaatgaaaaatagtagctcagccaggcttattaaggaaatgtgtatgagagatatgggcaggtaaaacaaagaccatttttatctaattatacgtttctttttataaaattataaagtttttatataaagtctacgctctgagttcactactttcttaccttttagagcataatcgtagggaaataaacattctatggttattgcttttgtcagtggggaaaagcataaccctgatattaaagtctcagcagacaagtaatagaacagaactaattcttctatcttgtgtgtgtctttgcttcgtgaccaagtaaggcagcttcttggctgcaaacgtgggttttccagccaaatgactaattcaaggttccctggatgttaaatttagattcagatagtcttatctcaccttaaatattgagcatttttcacagcttgatgatgtagctttacactgttgatgcttcttgccttctgcaactgtgactgttccttaatatgtgcctcttcttagccttctgccttttttcatggtagcacttgaagatgagatacctagggatcacttggggctggaagttaatagatgatctgggagaataagtaacattttacttctctaggaagtctggttttaaaacctgctgggtaattagaagtgtgtttaaagaataaacactttcttcatcctgttacttttctgttttttaaatataaaatagattttattgccatattattaaagttggctcttaaagtttgtatctttcagttcgtaactgtacttcatgttctcatgtttagcttggtaaggttacctttttgagagcatggttttgtgtgaaatattttttattgtgggcttctaaaatcaggaggttataatctataacacttactttcttaccacctcttatctgtaatcaggcctctctcccattttgctggagcccactttttcattcctttatcaacaaatatttattgcctatcatatgctattttgccaatcagtgtcatgccaaatattggaatacagtaataaatcagaaactcatacccacagtgagcttacagtagaggggaagaggaaaggactggagggaaggagagactagtttgaagacagttttaataatcctggcaaaaggcaacatggccggcatgagcaaggtaaccgtggcaatggagtgaaggaggcctatttgagagagagtaaagaggtagcagtaaagagacttggtgatggcttgggtatgagggaggaggggaggtaaggattttttgctggggcaagcattaccatttactgatgtagagaacatgaagaagtagatttggggaagaatatgatgagttccatttaagtcatattaagttagcggtctacagctcaggggagtaatctggctaagggatatgtgtgtgagttgatagcaggtagataattgaagattaggggcaaatgagctcagctagagagagtatgagggggttgagaagagtttaccgcatttaaggaacaggctgaggatgaggttcctgagaaggaataactggagaggtggcaggaaagcagaagagtggagggttgtggagccagtggaagacagtgtttcaaggaggcacaagtgggcagtagaaacaagtgccgcggctatttgattagaggccaaagtgggtttcttggatggagcaaaataattatttgggacttttagcaacagctgttttagtagggtcccaggggtgaaaacctgtttgcagtgagaaggaagaggcagtacagacagttctgttggctctctttctagccttggcttccctagcattatagagtactaatatcactttggcctctcttctaaaatactttccctgttttctaacgcccctaaaaagggacagtctccagaactgtgtcctttgttctcttatctttgaacttcagtttccttgtctataaaatggcgataaagtagtaccttccttatagggctgccctaaggatgaaatgagataatccaagtaaagtacttaacacagtgctcggcatgttgtgagtaattaggaaagagtggctgttatgaccatagttctcctttttgttgctgtcatgatttcattgtcattgtcactgatacttcatttcagtcttactttcttagggatctcctccattatgacaggtagctaactacctgccccttgtagaagaaggaccccagatcatcatctttcatcccagacttctgcttatattgccatcctgcattgctcattcttttactcatgaactcgtttgccctcaaaatttgactgttttctccattctggacattggtccatgtgttgtaggagagatgtgtttacaaagaaccataaaatagggattctgcctacactttctggcccaggaggccatgcatacctgttttgtcacttctctcagttcattgtaatagtttgtttggagggactgtagaatcacagaggaaagagagaattggttcttactctgtggattaggcctcttttggttataagtgccaggaattgaaatcacctaacttaatcaaagaggggctttttattagaatgatacagaattattattatggaatataagcaggactttactaatcaagctgtaagaaggagagagatgcagctgggccttaggaacatccagagtatctattatctcctttccttccctctagatggtaaatgttaaagatacaggaattaattcattgttacttttaatttgcttttttttaagtgttacattcatatatatttttgtatgtagctctcacagtcaatttctgaggaacgtgaaatttggagaagtctatgatgtcttgaaagtcccatgtctatttaatagagagctggtattcaagtccaggtttctaactggtatttataccacattgccatctaggattaatattttctttcactaactgtgatgctgcattgagtattactacatactgttttgtggctttagaaataacttgtgagagaggggtatgtgtgttatttttttctgaagggtagaaattgcaattaattgaaattaaaatctctaaagttcttgggcctttactaattcaattcagcttaaggaatcctgaggtaatttaatgatcttgcctgctcttttgtcttttttagatcagtggtgaaaacctttatcctagcagtatgtaagcaactgagctagctgcaacataatgttttatttcttttatttaatattttctgttgggagttgggcagggaatgatttcactggggcattgtgttttcatccttagtgtgtctgcagctaaaggcaaacaactctttctcaatcttgtgttgtgggcagtcagagagtgtatataaatattaacaacatatttcagtttatttctggtagctttaaattgggacaagctagtgcagatttacatcctgtttatgtgaatgattcctaatctcttattctttgctgcatcagaggagcgtcgtcttcctttctccttttctttttaaaggagtgtacgtgctggtgagggacaacatatgattgactttggtttctttttccttattagtcattcactgcttatcccactactgagttccactcaatgatccactgaaacccttcttgtcaaggtcactggggaccttaagttgtaaatttctctctcttagccttaccatagcctttgactctgctggtattctcttctctttggtcctctgcaatgttccctggcttccttcttcctctctagttactttctaaccatctttttaatgatactctttcctggagtgttggtcctggacctcacttgcttttcttattctgcatattatccccgagtgatctcatctcctcaaatatttatcacttttaaaatttccagtatcattctctctgctgagctccagacttgcatatctgactccctaaggatataacaccttaaacttaacatatccagataaaaacccagcatctctccttctactagatttcctttttttttttttttttttttttgagacggagtttcgctcttattgcccaggctggagtgcaatggcgcaatttggctcacccaacctttgcctgccgggttcaagcgattcttctgcctcagcctcccgagtagctgggattacaggcatgcaccatgacgcccagctaattttgtacttttagtagagatggggtttctccatgttggtcaggctcccgacctcaggtgatccgccacctcggcctcccgaagtgctgggattacaggcgtgagccactgtgcctggcctccttccagatttctaatttcactttaattctctctcccccccgcccaccctcccccccaaaagcataaaccaaagagtatctgagacaggtctcaatcagtttaggaagtttattttgccaaggttaaggacgcagccatgacatagcctcaggtccttacgaaatgtgcccaaggtggtcagggcacagctagttttttaattttaattttaatttttatatttttattttatacattttagggaggcatgagacatcaaccagtatgtgtaaaatatacattggtttcgtccggaaaggtggggcaagtcaagcgaggaggggcttctgggtcatagatagatagagacaaacagttgcattcttttgagtttctgattagcctttccaaaggaagcaatcagatacaaattaatctcagtgaccagagggatgacgttgagttctgtctgttctttgtccatgaggaatttccgtgtggacaaaatgtgagggaggtatgtagctttttaaaaaaatcttggtagctacttttttaaggactagaatgggaggcaggtttgcactaagcagttcccagcttgacttttccctttggcttagtgattttggggtcgcaagatttattttcctttcacacaggaaaggtaaccattctcctcagtgttgctcaagccagaaatttagacgaaggaaacttgaacctttccctgtctttagaattgtaccattacctcagctagttctgtgcatttcctaattcgatttttccagcagtgttgtgagtctcttagaacagttattaattaatactttcactttgcagacggggacacttggagaagttgggagaatttttttcataacgaaagatgtaggcagtgtcagtgctgggaaagaatggaaatctattgtttcttacatgttacttaagaaagagaaagaaaaaaccaagtgaactaaaagagaaaagttgatgtcctcctggtagtaagaatgtaaaggaatcagctttcacaacacctcgctttttgagatgccaggtttcatttttcactgtttcatgtatttcctcttcagtgctagagaggtgttggatcttcactctccccactcagagccatagctgctgttcttttaacagctaattgaggtataattcactgctgcacgattcacctattgaaagtatacaattcattggtttttagtacattcatagagttttgcacccgtcaccactacctggttccagcacgtttatgtcctccctaaaacaaatcccgtatacttatcagtcagttcccacccacccccagcctaagtaaccactaatatattttgtgtctctataaatttgcctatcctgaatattttatataactataatcatatagtatatggtcttctgtgaccttttttcacttaccatagtaatttcaaggttaattccagttgtaccatgtatcagtacttcattcctttttgtggccaaataatattctattgtatgaatataccgcattttatccatttatcagttgatggatatttggattgtttccacctttgggttgttgcgcataacactgctaaggacatttgtgtacaagtttttgtgtgcacgtatgttttcatttctcttgggcatatagctaggaatggaatcactggctccatatggtaactatgtttaatgtcttgaggaactgccaaactgttttccaaagcggctgcaccattttacattcccactggcactgtttgagagttccaatttctctgcatccttactgatactttttattgcttttgtttttgattgtaaccatcctagtggaccgaaattctagctcattgtgattttgatttgcatatctctgatggctaaagatgttaagcatctttttgtttgcttattggccattcatatattttctttggagcaatggatatttaaatcctttgtccatttttaagttcagttgtctttttattatgagtgtaagattttagatttgtcttttatcagattaatgatttacaaatattttctctcattttatgtattgcctttttactttcttgatgatatcatttgaagcacaaacattttaaattttggtgtcagagctgtgggttttattaaataatatgacaccgttgtgcttcggtaaggcggaagagagctttcctctcgttaaaatggctggaggtctcaaaaaaggtagagctgcaagttcctagctactattacacctcctttccttcctccctgtgtagcctgtcctgtggctatgatggccacactataggaacaggcctgttttggctttgagcctccaggagtggcagaaactggaactgtgtcagcattttattaagagattgctatttccaagatgttaatagatactgtgaatctcatcttacacctctattctctactggttttttttttctctaaatgtagcgctgttcctggctgctgagcagctcttgtccttgactgacaggcaaggtatgcagttgtggcactcattggccctggagataaccagataacagcacccctaacaagaggagccacttttctgttaaaactttgctgctggttcacaatcctgtatctagaacttcatgccattgggacattagacaccagtgtgcctcaggcatctgaatgtcatggatcaatatggtttcaaaccatattttgaataccccaatatttaccttaacatacattaagttttaattttctccggtaaggacatttggcaacataactgccattcatggcagaaaataactaagattttcctatcaagagagtacaaaagatataatgttaaataaatttacctttgtgaagagtcaatatattattcatactttgctatctaccactcaaaaacatattacagtctgtagattcatatttgagaactacagtcttacatacctaggataaatctttgttggaaaaggagaaccttcacttaatcaggtatttactgattaagttactgatctgtatgatgccagataccagttttataccgattatttccctgcaccacattaagtgtttcagttggtatgtttagacacatgtttctgtattttgtatgtatctttgctaatatttgagtagttcttcagtaacacagatgagaaagaagaattattttagatatatgtgagtataaatatgaatttgacctttaaggattaaaaagaatcatcaatcaaaaggtagaatggcttctatttataaatacaatgtgtaacttctggattatatatgtatagtctaggctgggagtactacataaattctattgattttgtctcatctgaattacaatgtcaaatagatactagggttttaccataagatagttatgggctgtctcattgtcacattaattacaataattaggcagtaaagaagccataggaatagataatatgttgtatgtttggatgagattgtagttataaccccttatttatggtaataaaaccttgttaattgacactgctgacaagctcttttgctttccttttcaactttccaagttggtttatcagtctatttaggaattacaagctgagagccacaaaatatacaataaagctcacattgcaagattttctgtacttgttcatgctatacacattaaattcattcagcagtatttgctaattattgttctaagtgctcttaagtattcagagatgtataaagcagtgcctactctgaaagattaataatggagaagtgaggtaaagtatctatatataaagaaatatgactgacatttattgagcagcatatgtgaggctcatgtgataagttccttaaaagcagacaaaagagtatacaagttcagaggaagaaaagatgattccaggcctgtgtgatcattgaaactataagtctcagtggtagaggaattattttgcatctatgccataaatctttgagctatctattctagagctgtagtgaaaggtaggtggctaaatgtactgacatggaaatcaacttttgttctaggcttagctgcactgcaaccttattttgtgtccttgagtatataaaattgatgtaataatatgtgtccagcatatctcactgtgatgaatgagataatgtggatgcctgagcttctccctgtggtgaaagtcagattgcttggcaggtgtatgttttttttttcaggcaactcaggctgtacatttggatggtagtaagcatagctttccatgactaaatggattaatatccttatcaaagtgcctaatttattgctagggaatagcatattctgtgtaacatctgagctgttgtctgaaaaaattacatgaattccttggagaagctgcctgtatgaatacatagtagtagtattgtaatccgtgaactatgttaaaacggcaacatatgtttattgagatgctattgctggtttaggggctttacaattgcttttaaaattcttacatcatttacatgttatagcagaggaaactgaggcttagataagtttttaaaagttgcttagataatacagttgtttgaattcacatctgctgaaatctaacgttaatgctgtttacattgtagaatgctactttagtttgatgtttttcttgcaggtcactgtaagccatttatctgcgtgtacgtatgtgtaaatgttatttatttgtttatgccactaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacaggtaagagccttttacaaagggtgtcatcttgattcagagtaacagtttagaataacaacaacaacagcaacaacaagccacctaaaacactatcttaagagtcataaacagggtgagaaagtaatgcttgcatttgaatgtgatgttgctgatggcattaacttctactatcttcaaaaaactttttaacaggctgtgtgcagtggctcattcctgtaatcccagtactttgggaggccaaggcgggtggatcacctgaggtcaggagtctgagaccagtctggccaacatggtgaaaccttgtctctactaaaaatacaaaaattagctgggcgtggtggcgggcgcctgtaatctcagttacctgggaggctgaggcaggagagttgcttgaactcgggaggcagagtttgcagtgagccattgtaccactgcactccagcctgggtaacagagtgagactccgtctaaacaaaaaaaaccttttaacagacttcttttttttttggcagactttaaaaatagaagcatattctcaatatgtatagtgtctggctttctgtcgtagtatactttacttgactggaattagtcatatattaaggtaaaaaacattaaaatattcttaagcattattttataaacatgtacatagcttaattttgttgactatttccttacagtcaacttttgcatatattgggttatatgacagaacaagagcttattttgagagatgagaatagatctgtgaggtataaatgtatcactttgcttgatttgttgaagattagaggaataatattattctttggtatgatgctgctgaaatgatatttagaaattgtattatactttttctccatatgtgagcaaaatatatttgatttagccagatggaaattagaaatataattaagagttagctgaagcaagctttgacataactaaatagaagtaacttagttagatagtttctgctaatatgaaaaaaattaagtatatgtggggaattggaaaatggaactgtgtaggaatgaaattacttgcatggcaaataagagtctttgcagaaaaaagtaaatcatgaatgtaaattatagtcattttttagaatgtagacatgctcttggtggattgaatggattgattcctggtttttcattcattagacaacttttggtacagtgtatatgctttactggtggttcagtagaaataatattggttgaaactttttactgctttgtcaattgccatgcctgtagtacatgcttggtgaatatttttgtattgaataaaatatctttatgggttggaggctggttatttaacattttgcatgttgatatgtttatccgtcttatgtaaataatgtgtgcctttcgtatccatgtttaagtatgaaataatagattctaaagctagataaaaaataattagaaatagggacttctgtttctcatcttgatgaagttaccctttgctgtaagcaacttaggtagtcagcacagtcagctgagaaaaaagaacacactaggtgagctttaccttcatccctgcatcttcctcgtgaatactttccaaactattagccctttggtcagatatgaagctgtgtacaccacaaggcttggcaggaaacaactactgtgggactgtgagctgaatgaagatttcagaagttggaaacttctcagcagtgttggagctcagaccagccagtgtggggaaagcttgctgaacatactgtgctttcagctgtgacctcagaaaggtcacaccttatgagtagggctattctaggagtagaagacaggctactatagatctcatacagcaaagccccaaaccaagcctctattttatcatcttgatccacctgtaaatttattgtctgatagaacaaaactctctctaaagtaagacaacataattcagtttctcaataacaaagcacctgcaatgtctagcatagaattattatgcttgttaaaaagcaggaaaatgtgactcttaaccagaatgaaaaagttgatagaaataaatatctaaaatgaaaaatccaccagggagtggtggctcacgcctgtaatctcagcactttgggaggctgaggtaggtggatcatttgagggcaggagttcaagaccagcctgaccaaaatggtgaaaccctgtctctactaaaaatacaaaaaaattagctgggcgtggtggcaggcacctgtaatcccagctactcaggaagctgaggcagcagaattgcttgaacctaggaggtggaggttgcagtgagccaagattgtgcctctgcactgcagcctgggtgacagtgtgagactcaatctcaaataaataaataaataaataaataaaatgaaaaattcaccagatggatttagctgcagataacatactgtggaagaaaggatcagtgaatttgaggatagatcaatgtaaaccatccaaatcaaagcacagagaaaaaatagacaaaaggaaaatgaacaaagctataatatcttcaaggatattatgcagcttaacaattatgtggtttacaggtacagaaggagagaggacagagagattggggtagaaaaatatcaggagaaatggtgaccaaaaagttttgaaatttgttgagaaacataaacccacagatgcaagaaacgtaacaaatcccaagcaagataaacacaaagaaaatcaacacatacgcacattatgaaaaccaaagaaaaaattcttaaaaatagccagaggaagaaagacacattgcctacaagcaaacagtgataaaaattatcagtgacatctcatcagaaacaatgcaagccagaaatcaatgtatgtcaatctaagaatgctgaaaagaaacaaaaattgtcaatctagaattttgtgttaccgaaaatattctttaaaatgaagctgaaatagagacattttcaaatgaactaaaacttaaagaatttgtcaccactagactttcacttaaagaaatgttatagaaagtttttcagccatgcgcgatggctcatgcctgtaatgccagcactttgggaacccgaggcgggtggatcacgaggtcaggagttcaagaccagcctggccaagatggtgaaaccctgtctctatgaaaaatacaaaagaattaactgggtgtggtgtctggcgcctgtaatcccagctactccggaagctgaggcagagaattgcttgaactggggaggtggaggttgtagtgagctgcgatcgcgccactgcactccagcctgggcggcagagtgagactccatctcaaaaaaaaaaaaaaaagagtttttcaggctgaaggaaaataataccagatggtaacttagatctacagaaaaaagtaaatagggccagaaatggtgaatatgtggacaaaaaaaaaaaatgcttttcccccccacatttcttgatttatttttattaaaagaatttttaaaatttctaagtcaaaaacaatcatagtgtatgtgggttttataatatattttggaaggcaatatatgacaataattagacaaaagatgggagtagggtaaatgatactatgctgttgtgaatttcttatataattcatgaagaggtataatgtttagggtagcctatgataagttaaggatgcatatttcaatccctagagcaaacattaaaattctaagatagatacgtagctgagaagccagttgaggggataaaattgaacagtgaataaatatttgattaatccagaagaaaggaaaggaggaaaaagaacaaggaagaaagaaacaataaaaaacaaagataggatgaatagaacccaaaagcaagatgatagacttagcaccaaccatatcaataattacattagacataaatcgaccagatactccagttgaaagacagagatcatactggatttaaaaaaaaccaagacccaaccatgctgtttcaagagatgcattttatgatattttattactttaaaaatttttaaataattttaaaattgtagaaaagttgtgagaataagaatagtacaaagagccatatacctctttatttggattcagctgttcttaacgttttaccacttttttcctgttttctctctgtatatatggacacacacatgcatttttctttgaaaaatgggcagcaagttatctactctgctgtctatattcttgttttgttaactgacccagtaatgttctatatagcagtatttttgcccctccagtagagaaaccagtttagaatcaggtgtttcatttagttgtctttaaacttgaacatttatagtcttttttttctcttttctgatagtggcacttttgaaaaatatgtatctctccccttttaatacaagtttgtcattttgggtttaaaagatacactttaaacataaaattaaatgtatgagaatggaaagagataaccatgaaatactaataaaaatagctagtattacacaaatacatcagacatttttagaatatataaatgtaattatttgtattatactactatgacatttagaacttgaatacatcaaggcctagatagtatgttatggactatgtaattttacttatggcaaggtcataaaatactttgtgaataagtttttatgacccccccccatctttggcttttacttatgttctgaactgaaaacaattattaaatctgttaggatcctatttagaatactaccatgaggaattagttatgataataaacaaagtaagatatcatgtcttccctaactctgcttactttgtaattgtcagatgtatataattcctgtacggctgaaaacgaaacccattatttcataataaagatgattgtaatgaactaagcaactttaaattccatcagttattaacaggtgaaatttacagattaaaaataggtttttctggcatattaaatgagttatacgtttcatacatgtagtttcaaatgagtgatttggccacatgttctcactcataggtgggaattgaacaatgagaacacttgttcacaggaaggggaacatcacacaccagagcctgttgtggggtggggggatgggggagggatagcattaggagatatacctaatgtaaatgacgagttaatgggtgcagcacaccaacatgtcacatgtatacatatgtaacaaacctgcacgttgtgcacatgtaccctagaacttaaagtataataaaaataaaataaaataaaataaaataaaataaaataaaataaaataaaataaaatgagtgatttggggattctgtctttaagttacggaatgagttgtttaaacagctttattgaaatataatttacatgctataaagtttacctatttaaagtatagatttcagtggttttttaattatatttatggagttgtacaaccatcacaatcatatcattttagaacattttcatctatgccaaaagaaaccttgtatctattagcagtcactcctcatatcccactccctttacctctaggcctagcctgttaggtactgatctactttttggaaatgacttatttttatcatagatctatgatctttatttttttatttttctaaaatatgggtccttggaaattttatagtttaagagaaagtagacaagatgaatttaagacactaaaagaggtatcaattatgtgttatatctctcagaaacttgtagtctccacattaattatacacttggcagtgctgttgctgttccacgttaatgcatacatgtaccaatggcataagctatttgacagagaaagaacatagaactgaaaccgttctaatgaaaggtgagaggtctgacatagaaataacattttatttcatgtattttgtttaattgctctgaggccaagatatggcagtgttctttgcatttttgcttgctttctctttccgcacttttcttcgcctcttaactatctacctttctgcccttatcttttttcttaagcatgttgtggaagaatggccttagtcatgagttgagttaatctgttgattgtttcttaactatgtattctactcatctttattattgccctataaatttgagcatagagcatttttgaataagaggttcatataaatattttaatttgtaattgctatgcaataaaaattgttatataacttttaaattatttttagatttccatgttttctagttctctcagaattctttcaggttatacagtactgagtattaagctatatacccatcaataacctagatggctaatggcacagacacacagacagactaatgttgctgaatgtaagaagagtagtagatgtaatatgtaatgttattattctgagacatgttgaatggcccaagaaaggttttggagattgatgatgagttgatccttggaggatttgtagaggtagaggagatgggaaatggcactccaggcagatggaaaggctcatgagatagtatttgcaagtggcaaaaaaggaatgaatagacaaggatattcagggataggtaagaagaagagtttagcataaatgaaggtttattttgtggatctgatgaaaagcttggataggtagatttgggtgcaggttgtgaaaacctgttagggttatctaagtggtttgtgatttatctttacagtaatagtttctgaacctggttacacatttgacttatctagggattgattcttagctccatcttacaccttatgacagtcactgtggataaggactacattctgtttttcagctcctaaggtgattctgatatatttgtttaggatcttgtatttggaagtctttgtgttgggtaagtggttctcaatgtatacctcttggaccatcatcagcattatgtgggaacatattaaaaaatgcagatttgtatccccacctttgattgactgaaacaagaactctgggggcgggaccttcaggtgattcttatgcacactgaagtttgaggacctttgctgtaggtaatatgggaactttggagatttatattggagtgtgatgagatgaaggaagattaatgtggtagcaatgaaaaggactgagtagagagggtagagactaagacaggcaaactattttgtaggctagtggagagtctatgcatatattacttgaggtattgtttagtagagaagtaaacaagacaggctttggtgtatgctaaaggaatacaaagaagggagaagaagatttctaaaccttttcagagtcttttagaaaatctgtaagatgatatggtccatctgccagcctagtttccagtatgacagatattttaatgatggtttagtgttaaattattgggaccaactatgtactgagtactggggaatagaaaaaaatacatgaacaccagagacccctggctgggaaatatttaatgttcatttatatggagggtttaggatgaagatttttggttaagtttctatgtacagttttacacatggggctgatttagttttcatgtacttgttggaggagtgttctttaggttagaaatcattcctggagaacaaaataattcaacagaatactagaagcctttagttaaatatgtaacagcatgaatgaagatgatgggatattatgatgaatagagttataagtgtttagagttcaaatttctgtatttctttgaatggaaaacatttcctgctgaaaagttgaaatgttccttgtatattaaattctttgtatagtaaattaattcttggaagagagaatactttttgatcttttaatgacttcagcagtttttttccactgcaacttgggctttccctggcagccagaacccatcctttagttggaaggctcatttgtctcagcgtgtttttgtctggagacagacagtgaggagacaaggctatagctatcatagtaacggggtgttatagtttttccctggtgtcagccctgtgaccacacaccattgcactcctttttcagttttcactctttttgaaactgtgataatagaaatacatgtttttgcccttttgagcagcggcagtaccttccaaaatgacacctacttggtgacaagtgtgtcatattgttggctgtgtgttttcaagtgtataaaagactgaggtacactagaaatacaaaatattcaatcttgttgaattctgcatagcaaaggaagaggatcactttgaacaaacccatcctccagacgttatgattctgtaaaaaatctaaatttttttcacatctcatttcaaaacacaactgtcgatttagccattgttgacttaaatgtgtaactccttggcatgctaagcagtgtctacagatggggacagtgggttctgattatactgtttaccactagcagtgacacctagaacaagtcactttactttttttagtgccttgatttcttttttctggagattaatggagacagaatgtaaaatcgttttacttttgttaactgccatataaatgtttagtgataaaattaacctcttgcagagagagcttgaagtttgctgtcaggtaagagaatccacaaaattattagtactgatccttgacctggaggggattttcaaggagacagatgtaatttctattttgaattcaggtctgaaactaggttattcttaggttctgtcgactttgatattttggttacctgaggattctataccttaaagtaaaacaaacctattttagtatttcaggccagaaaacgtatgagagtattctcgcagaaatagtttttcgtcatttctcagcctataaaactttttgataacctctattttgcgtggcatcgtgaagtcatgttgttggccaggccattgaatctccacaaaagtgcttgctcctagaatgtttcttctgtctcgtcagtggataatatgctgccaaatgaacagaatataattaacatttacaagttaaattaaaaatcttctaaattcgagtttgtttctgtagcaccaggactctccctgtgttgttttatgttcactactaattcttcaagcaggaactgatgagcagccagggagattcctctggcttctagtacagacgtagcaaatgcccaaatcagagtgctagggtgtctaatgcatagtgaagtgtgatgtcaatgtcatggacatctgaatacattgcggcaaactttagaaaatagtagcttggcaggggataccccagaataggttgatctggtaggaaggctgttctccttaaattttcacatacctaggatgggcctgctcgggcctcattacgtcttggcctagagaacacaggtgtagaaatggcaggtcttccttctccctcactgcctccaaagcttatctctgtctggttttgtctgatattttagagggtgaactgttaaaagccaagtgtccgtcagactcatgctgctaccgctcctttaagtgtgctcatcaagatttggtgcacctgggccaaggcaagaatgttgctaggatccaagaggccataataagttgtggtgattaatagcatgaagtgaaatagtgtgatgtagaaagtgtcattctgtgatttgagtgaaattaaagctactggcatgaccttcactgacatattgctcttgcctacttgagaaggttttagagcaaaggtaattacattttcctgaattggtcttttttttttttttaagcgtatttaaaaaaaaaaaacgttttctgattgtggaagcaatgagtatgtctgaatccttgagtatagcgatagttcttctgatttttttttttttctgtatgccaaattcttcagaaacttggtggcttaagacatcaaccattttatttctcatagttttgtgagtcaggaattcatgaaggctccaatgcacagtgcttctacttgacatggcattggctgagaacattcacttggccacgcatctgcagcatggactggttagaaggtccaagaagactttattatgtatctggcaccatcacgcttctccacgtggcttctgtttcaccatatgaccttgcagcagcgttgtctcagggtagttggacttcatacatgattgctagctttaactagagagcattctaaagggtgaaggctgcaggtcttttaaggcctggccttggggcattacttggtatcacgtctactgtgttcttttggtcaattgggtagctcagatttaaatggagggaaaatagaatttatttagtgtgaagagtggcaaggaatttccagctatttttttctgccacttcgttgtggactttgtaagtttgcctttatagacccaccagtcagacactggcatgaagtcattgtctttgggtttgtgtcacaagatagaggccggtatttcattgtctactgctcttaatttgttagagaatatttacgtgattaccggattcagcaacatttcaccagtttgatcacattaaagaccattcaagatacatttaggaaaatacaagtctttcacagaactcctttgttcaagtgagttaattcttggagtagttacactttgtcactttacactcaagtactgaaatgattttttatatgttattaatccctttgatctttctgttgttacagtttgtcgtattgctccccattttagagatggagaaactgtgatgggttttaaatcatgttttttagcaccaaagagtcaaatatggaagtcggcttgccctagctttcttttgcaatttttaagtcattgatttaaaagcctactttggcttatactttggcatcttgacattttacttgagaatccgtgataactttcaactgattcatttaattgaaattatttcagttcacatatttttaaaatcaaggctttgtgttgaggaatatggccaaccagggatttgtttgtatatatagaagtgtgtttaccactatacatgtgtttatgtattcatgtatgattgttttctaattgtgaatattcaggatttcaagttttttttttttacattgacagatataattatacatatttactgtgtggatttcaagtttaaaagaatagccatctctgcatagagatttgtcttttcctcttttaaaataccaaatattttgataaaggcactgagattggtctaagcctttgcattaccctatacagtcaagaaaggtgaggctatgtcttttttgtttttggtagtggcttcagattagatcaactgaatgttctgaatattttgctaattacggctattccagtggtcactgggcctcccaccattcctctccagagctgatggtaattgcaatagctgtgacttcctctctccctgtttttagaaggtgttgctttctcttgtatatcttgcttttatgaagtggctgtcagcagggagcacaaagagctctctggcagttgctgttccttcgagagcatgcttcttttgcctgtttgtcactccactgagtactgcattctggtagtgaagggagcaatccttcaccactttagtttgtgctgcttatactcttgttcagggttgaaggctggaatatagaatggagggatattactgatacgtgtaccataacgtgtatgcaaagcttaatttaaaaactgagtggaagtgaaattgtaggatattaatattttatgcccttgactttaaaccttctgtggtaaaaggtgatgtagaaactgttattgcaccatttcttctaatcttggcttgtaagatctccattagttggaattctgcaaatgaaagacgtaatgaaaggagagtttttttttttgtgaatctttgctgtcctgggcaagactcagttgttctggtaaagaggtggcaataaacaccaatgcagaagtcagacagtgcactataatgtattgaaccccattatttggtctattttaaatgtatgtataatctggttgatgaagtcttctggattctgttatcctattcatggtcagtcttagttttgttatctttactatcttaaagcagcaaatctcttttgggatgcacaattagaatggcctgtggaccccacatctctagagcatgcttcagtaggattctaactgattctaatgcacactcctggttaagaggcaggattagtaagtgatacaggattggtcatactaaaatcaaatccattaaagtcttaaggggttgaagaggtttacagaaggcaaattttgattcattttgaaagatatgtcatgtttaggagagtgtttgtgttctgcaacatatagtaaatgaagatagaattatgaaacttcataaatatgggaaggtgctttaatgtacattactataaagggaaaagaaaaactagacatcggtgctctaactgatctccatttacagattttggtcagttttatttagagtagcagcccaaagttggcaaacatagataattcctatttctgacttgaacagttgagaatgttgacaaatgcattatttcatccaataatttcttggactggaaacaattatatcatcatgttaattgtctgttattaagaagggggttttctaggttgcttcccgcccccatttgttacttgtatgaatttttaaggcttatattgatgagattttcatgtaatggaggggagaaattttttcctttttaacatgttcatgtaaaaggaatttaggaaattattttaatcttgctgggagctaagacaaaacacaaaacaaaaacactgcagaacagtttatggtcccatggacaaatgttcagtctgaacacaagtactagagaagaccttggaaggctgaggtcagaatgggttaaagtagttgagttcatgggcaaagggggacttggcatgttttcacacagttaagtataaatgtataatatgaacagcactataaagacctgggggagatgggctttggggggtttgtttgttttcttagaacatgttaccaaaaacaaaaaaaaaagattgaatacttttggatgatagggagacctttgaagaagagattgggtggcttggactttgccttttaagccacgggctgcgattatatttttgttttgtttttactatggaaaatttcaaacatgttcagaaattgaaccagtagaatggttccccatgtattcattatccagtttgatcagtttcagcattatcaatttatgactgatactgttttctatccctccgtatttccctctcctttattattttgaaacaatcctagaaatcatactgttttatctatattttaatatgtatctctaaaaaataagaactctctttttaaaattatacctaaaaattggccgggtatggtggctcgcgtctgtaatcccagcactttgggaggccggggtgggcagatcacttgaggtcaggagttcgagaccatcctggccaatgtggtgaaaccctgtttctactaaaagtacaaaaattagccaggaatggtggcctgtgtctgtagtctcagctacttgggaggctgaggcaggagaatcgcttgaaccggggaggtggaggctgcagtgagccgagattgtgccactgcactctagcatgggtgacagagtgagactctgtctcaaaaataaaataatacctaaaaacttaatttctttatcatcaaatatccagtcagtgttcacatttccagttgtctcaaatattataattattttttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgatttttggggacgtaattacttcataggtattatgcatttttggatagaggagtaaagtagtgaaagtaatgtttttaggatggtttgtctggcagcagtgtgcaaaatgaattggtagaggagaaatggagagctgcgaattagaaggcaggttcaatcagtgcaggaaggaaaggctacagtaaggcagaggcagggaaaagaaaggcaatagagatgagagagattttgaaagaaggaattttcaataccttttaggcttaactataagaaatggagagtcggctgggcatggtggctcatgcctgtaatcccagcactttggaaggccaaggccagtggatcacctgaggtcaggagttcaagaccaacctggccaacatggtgaaaccctgtctctactaaaaatacaaaaaaactagccgggtgtggtggtgggtgcctgtaatcccagctacttgggaggctgaggcaggagaatcgcttgaacccaggaggcggagcttgcagtgagctgacattgcaccattgcactccagtctgggcaacaagagtgaaactcctcaaaaaaaaaaaaaaaaaaaaaaaaagagagtcttaagtcaggttgaagttgtgaacctgagtgattgggagttggggtcaggaagatggtgctttgtgcatgttgaattgaaggtctgtgtattggtagactatccttgcagaattgtgttataggaagtgtattagtctgttttcacactgctgataaagacatactccaaactgggcaatttacaaagaaagaggtttaattggaatcacagttccatgtggctgggcagcctcacaatcatggcggaacgcaaggaggagtaagtcacatcttacatggatggcagcaggccaaaaaaaaaaaaaaaatgcatgtgcagggaaattcccatttttaaaaccatcaggtctcatgagacttatcactatcatgagaacagcacaggaaagacctgctcctatgattcagtcacctcccactgggtccttcccacaacacgtgggaattcaagatgagatctgggtggggacacagcgaagccatatcaggcagctagattgatcatgggggaccaggggagaggtaagggcaggaaatagaaatttagggattctctgtctgcctgggaatagctgaagccatacaaatggaccagctcagaaactcgtgagtgaactgaggagcactttccttaagtagttcgtcagcttaatcggctttctatagttgtcacagcaaaatattacactgtctttagagactggagtttctcatgatgatgccacattttgcctttctttgcttctgcggtttttcgtcatttataggtgatatggcagcagatttttgagcagaatccagctgctttccgaagctggagattccactggggatgtagacagcttgggaggaaataaaagccgagtccataagtgagcctgggaggagtgaagaagcagagcaagcaggacagaaagtgggcggggccagctatagggaaagaccttggggttgaagggatttgatagacttgccttagtgtcttttagttccttcagaagcccagcctgacctccatcatgagagaactagttagtgagggtggggcaccaacagttcccttgtgtcctctcctgctgtttctctcttatatccagagactacagagaatgtggttaatgggaaactacaaaacttatatgtaatcatttcaaaagtcctccctagctgaaaggattttaagaaaatgtgctattcagaaatatcccttaacctgtttaacagcatcttatttactcatctgtgttttatgaatacttttccctagttgcagaaggatggcaaaataaatgtttgctatcaaatctatacctgtaattcagtgaagcattgaacacaggtgatgtacccttcttcacaggggaattgtgttcaaaatcattttaattttttatcctcagtaagattatatagaaaatcttatagctctcaaaggtgcagattatatttttctgtaatagttctgggcttcccaaaaatttttgttggtgttgccaaagagttgtgtcacataagtgagtggcacaaacattttttgactagccacctgaaagttgtgaagggttttgaaaatataaagtaaaatataaagtgaacaccaccactgtcaacaaaatccactgctttggatatgatttcacaggaagatgacggctgtcaccaattgaactacagcaaatgacgaaagctcagcacgaattagccagtctcattggggtgataaacgacagcacattaaatatgtgttagcaacgtgatatggcagtgaaaaaagccaacgctatttttggctgtgctgcacaaaacagcatctcgtcaccgagctgggctgatcattactttctacccagtacttgtgaggcagcatctgggatgctgtcttgagtgtaggacacgtgcgtactggaaggatagacaaacgggtaggagtcccaagcagagcatctgctgtgactaaggactttagatgagacaagttttagaagtggcatgtttaggaatgagcatggaagtaaagagatgttaaccttttcagagataggatgatgttgaggaaatacatcatagactcctcattagttggcattagtttagtacagtgcactttagaggaattacccaaatactttcacagacagcatatcagcaaaaaggggctctaaagcaaaattaagcaaggacttatttatggtcaactatgttttaatcaagagattaacattggcagtgcttgctataatgtgagaaggaatagaaagtaatagattacataagtcaggtgcttttgattggaaattcaaatgcaaatattaaacctgggaacaatgggggtgagactttatagttatctttagaaattcaagtaacaaataaaggaattacttactttccgcagtagtataggcaagcacaacagaaagaaataatttaagaaatacatagtataaactgaatgtcagggaacatttctgcagtgagaactatcggaccataggatattcccctaggaaaattgggttgaatttcattggacatttgatcctgacagaattgaatgtgtatcagtagggaaatagactgaatatccctgtaggcatttttcatttctctcttctctgattctgggccctgttgatgatctgttcacctgctgtgattaggaagaaattttatctcttgtttttctacacccaggcacattttagatgctttcctgattgacataggctaaaaatggagcttcattgccctgaggttgacctggtaccatccctcctggtgttgtagaaatttctcctttctgtttgggaggcagtgttagggtcctttacctaaggtgaatacatgtaatataaaatgggcccatgtgtatagggtcagtgtcttcttcagatatatctagtaacctaacagggctgcaagctggcctctttgggagtgaatgatggttttattttcccctcttcccccaggacttgactttgaagaaaaaggatatttagcagactaggagaccacagacttttactgtgtcctgtagaaatgtgaaaaatttcaggttcctggatgggaaagggctactggagaagagcttgactccttatgctgtgacagtggtgtgtatgccagtctttccctgtagtagtatcattgtataatcaaagaagtaaactaaaaatgcaaatttaatttcaggttcattacaaatggtctgtatttccttgttataaactagtctattggataagattgttagatagattgttatccaatcttagtctattggataagattgttttcttagcttggcattcaaatacctgtacaattcggacaaagtctctgcttttccaggcttagtttacccttttctatagtaatgctgtattccagttaaatcagcctttctttctgtcctctaaatatgactctgtcctttcctacagtagtagttttgtttattccatacatctttcctactgtccttgccctcatctctgaataccttctctgatatgctccagtcctctgtcttacctatgaagcatccattgatcatttcccttcaagaactcattgcatttcttgtttttaccactcatttgacatatctaatagttatatttttcttcctctactgaatccacatctttcctttttaatcagattaaaaaggctctcttgaggaccatttcttacatgtctttaaatttctcacaactagtctttaagcctttggagagaaggaactatggcttatttatggtgcctgtctcttcccctaaactcacagagtttggcagtatgcacttaataaatatgttttgaacaaatgagtagtagatactctatacatatctattgattgatttaagatttgctatagactgaatgtttatgtcccccctaccccatattcatatgttgaaagccagtccccaatgtgatggtatttggagatggaggctttgggaagtaattaagtcatgatagcagagccctcatgaatggaattagtgcccttgtaaaagaggccccagagagctccctcgacagttctgccacgtggggttacagcaagaatatggccatctatgaaacaggacaggggtcctcaccagacattaaatttgctgatgcctttatcttggacttcccagcctctggaaatgtgaggaatacatttctcttgtttataagctactcaatctgtggcattttgttgtagtggtttgaactaagacaaggttgaattttaaatgctttgtaaatgtgttgaactttgtagatttaaaaatcatgtagcagaagactcataaagctacgaaggtttgctatattcccaggagaccagttcctcctgctttctcctagaccagcctgcacttaaatcatccctatatgaagagtttctgttggccaggcagattgttagctcaggtttccagatatgaaatgatgtcatgaaataatgggcatgaaataatgttggcaagagaaaccattaataattgggactgtcatagtattactattatatagccaatgctcgtgcatagataatatcatttctatcatgggtgtgacaataatagatttggaagaatggtgaaaaatttgataataggttaagtgaaattaaactatacaaacttgtcctttattctttgaaaacgatttaaatttttgatttttcattttaattttcttactcgtatttaaaaatttttccttcatgtcttgctagtgaaatgtacttgctgcaaattaaatccatttctttcagtgatagctttggtttgtaattaccttctttaagtgttaagtctgtccttagaatcatcagagcttctattatgtaattctttggagtaaaccctagttaatcagagcatgcatttcactggaggggcagctcagtgagtgatgtgaaggtgtttcctctgagaaacggaaacagttatgaagtgttttgtggtcctttgggagttgaggtgctatagaaatgtaaggcttttattacaactcctgacctactatacagaaccatgctaacatcattgatgattcttttgcataatcaaagaattaaacataaaagtcatattaattttcagcttcattagagatgcaagaatcaaaagagatgtttgccaaatgggaaggcactaaattggtaggagaaagaattttaatttcaagcttcaagtgaatgttataaataacctagcataaaaaagacactaccaaaagcgcctgacaatgtcctttttaaagatcagcaacattaaaaaggggaaaatgtaaaaaagaaaaaaaaagggaaaaaagaaactataaaaatatgaaattaaaattgctgtatttgagtcagtttatggtagtaaattacttctgagagcctcaatttgaagatcaccaggtagtctatggtaattagtataattttgctgtggtcaccaaatctttatattatttttgctggtcaaacagcaatacttttgcctttttttttttttttttaacttggtcgcagttgaagatgatgaaaaatccatttactcgtgaaagggtaaatgcaacttcctgatgtgaaataggggcatttaaagcactcacattaaggaaagtttgcattttaaatataaagtagtcttaaaatttttctctacccacatataaacaccattccaatatgtgtgaagagctgttgttcatcttgtaggatcactaatcacaggattaaagcgatgaggaagtatatacagtgaagaatgatgcccttttctttaaaacaaaaatctggaggcagccagaagagcttgggaaaattcttgtattttatatctattatgctcttgattttatatctactgtatctccctgatctgtggccagctgggatgcaaatacggcacaagaagttcacagtatcaaaggagcaagtgaataggaccccagaatgtgattgttatgaaagtactgagattattacatttaggccctatgtgattctggaggaagtgagttttactgctcagtagaaaattatatatatatacactgtatatataaaacacacacacacactgtatttagaaagaaaaagaccatctgttcattctgtctgtatttctgtggggatttaatctgacagtgaatcacttgggatttgtacagaataaacttgtgctaacatttttatgaaaaagggtagggaagacaaccaaaattttctctttagggattgtttagctctgctttttttgttttttttctttacagcatacgaacatggcaatatgatgattgattttttttttaatttgttttatgttagccttttctgattctacaggagaggttcattcctttgtcttagcatgaaaatttctcaggatagacagtagcatcaggaatgatctttaatagagtagtggttttcaaagagtggttcccagaccagcagcatcagcatcacttaggaactagttagaaatgcagattctagtgctgtatcccagatctcctgattgagaaacttggaggatggagctctgcagtctgtgtttagtaagccctcctggtttttctgatatgcaggagaaccatggaattagacacagactgtaataatgaaacgctagtgttatttcaagaaacttcaacactcagactcacttatgctgatgaatatgacctgggccaaaccttaaatatcttatttccttccaccctcataacacttcggagagcctgccatcattattcttccgttcagatgatgacactgttcatgctcatttgattggtaagcagtgaaccaggctttgaatcttggtctggtttcaaaatttattttcttaactgctgtagaataggaagatttaaaaaggaatgattttcaagtggctattcttgtgactttttacaactaagtatgtcatcaattaggaaagtacctgaggggttgagtggcaagttgggtgccaagagcaaaccagattataatctagaactcagttctagtcctgactctgcctttactctctctcattcatttagttggcctaatgtcctctgaacaggcttcctcctgggacacttgattcgttagatgactatacttttcctgtgaagtgtgcctattttacagagaagcttcccacttcgaactggaaaaaataagcatagtggagtgactttttcaaggtcattatcccctttcaatgggagagctatagtttgcttctattcagtaccatcctgttgtaatggaaaaagaaatacaaaccaaccaagatgctgaagtttgcttttacctgcattatatttaggggttcatttgcaaacctgaagtatttcattgacttgtacctttgctgtttgtcacaacaataatcatgattctttcatctcaagccttgatttgaaacagcctggagctggtccagacaaagcccatctagtcattgtatctaggcctgtcgatatcctcttgtttgtttttgtttcatttggttttcttttctttttttttttgagacggaatttcgctcttgttgcccaggctggagtgcaatggcgtgatcttcggctcaccgcaacttccaccttctgggttcaagcgattctcctgcttcagcctcctgaagcagctggattacaggccaccacacccagccaaattttttttttttttgtatttttagtagagaaggggtttctccatgttggtcagggtggtctcgaaatcccaacctcaggtggtctgcctgcgtcggcctcccaaagtgctgggattacaggtgtgagccactgcgcccggctcatttggttttcttacctgtcacctaaagttgcagtctccttaactgaattattagttcttaggcattaaggacagcttctttgctttttgtctgtaaactattgctgtgtcattttcacagtacatgctcaataatgtcataaagaattaatattttgcctcttccttattttattgtcctttcccataattttccagcctatcttctgtatattattccatttaacttttctgtttgtgatttttttcctctgttccctctgagcatttgtacttgccattcctgtactgcagatacacctttgttttcttctctctccatttattctctccattaataacaaaattaaaaaattacagctaacatttgataagcatttaccacataccactgtgcttagtactttatatgtattatctaatttaacccccacatttataatgccattattattcttagtttgtaggtgacaaaaatgaaatttggagaggttaagtgccttgcctcggctattaagtggtgagactgagattcaaattcagctgtatcttaattccagttaaacttttaattatagtattttgcctccattgttttcaaaagacataaaaaaacctttatggctttgtctgctttgctttggtatgacgtcttattcatgtattaggcttaacctgcttattgtaatctggaaaaaaaatatgcagagacctctaggctgacaggcacctatacctagaataaggattttctgctagagggaactgaatgtcatatggggctgtgatgggctacagcctcccaggttaagacttatttcacatggatcaagctatctcctcactccagcaatgacacagttagtatatatgttcataactaagcttaaatgccatttttaataaatattaataccagtataaggtaaggacaaggatgcacatacagtcctattatgaaatagggctgtagcagcatttttctagtttagttacttccttccagtatttcaattcctttcaatccaggatcttagtgattttgcatgtaaacctttttcctatttcatgctctctctttgcatttgctttattcagttgtattgaatttctaatgtggattagagcacacagtagggctggttcttcattttaataactttcctttccaggcacttctcagtaatcctttctttttttaagccaggtttagagagggagctaaaagcagaacaagacatttgagtttgtattgttctgctttattttcataagttccacattctcaactgaatttctagggacgaaagagaactcgattacttttagttcctttcagtgccactctaacttagtgacttgacttccatttctctaagtggaaatatttacatgtatttcaaaggatgctctctggcttagttagtatctctacactgattagagaatgtaaagcgatgtttaagtgcttattattttttaattacatttataaaggttaaaatatagataactcaaccattattattatcctcatttagaatttgtataccatttacatttccaaagtgctttgttcatgtaaattagttggtcctcctgccattcctataaattatgtcagtactatcctctgaaatgttgccattttcagtttatagttattatttttatttcagacaactacaccttgttcaaagggtgaaagtgattaatagctttaaaaccactaaaggtaaacattcttaaatacccttgaagttaagtagatgccggaattgctgagatggctgccaagccaatgttggagaatttatttttttgtacagattatatatatatctttgattttcttcttctcctctctgtttattttgtattttttattcatataggaatgtgcacacattgtatatttttcacaaaatttcatgaactaaacctacccactaaacacttgtgtcagggaacaacacagtaccagcatcactcgttcattgaatctcgatttgagtgcgcgattctgtcttacagactgaatctgtctaaacatcagcatagctggaattatggacacaatgagtattcatgctcagatgttgcttccattataaaactaatttctgtatgttccaaaagtgttatcttactgggttaaaataacactgagtagtcacagtaagagatgcacacaagatgtgcctcatgagtggtgtagacaagatatactgttggacatcacaggagcaaagttgtaccttttcagaaatgcttcacatggaggtgaaattagagctggactgcccactagggatagagggcttagacataagtgtaggctttggtaagagaaacaaagaagagggagtagtggtggcatgtgtcccaagcagggaagatagctatgtcttgcatatgacatgttttgatgcagggagagttccagtttgtttggagtaagggttcatgtatgtgtttagtcaccattcaaatttgagagttaagtagaggtcagatatctaaggactttgaatgctagctaaggactcatagtgaactaaacacttactgaataccatctatgtgttaggcacaatgctcagcacttttatatgcattttgaatttatgctcaagacacttggatctgcgggggcaggagttagtggcactgagatatatgagcagcctgggtagaaatggagagaccagagatagaaatcgcagaagactattagggttgatgacaccttggattacggttggtcctaaaatttataatttcagctactaaagacctggttctagaggactgaaacttcatcttttcttggttattctacatataatctaatgcaataagaacctgaatgatgagtacttagttggcagatatttatcagttgcctactctatatacatctctttgttagatttgatgggctgctcactctgtccctctgcccacctgatgttagttaatctgggggacaaccatgtaataagttacttcctagtatctatagtgaccagttatttgggagtcacctgattgaccaaagactgtgtttttacagtgttgtctcctttatttttttcttaggattctttttgcttttcttttttacaacagcctactgtgtcgcatcactgaatctagtttatagtttttcgtttctctacattccatcattttagaaacaaaagccacatctctttgaagaagtacttttgactttttctcccaattttagcacttgtccgtaacaactatgtaaggtttgttttgggccctcctttccttctatcacccctttgaggggctcttgtgccctgttttgtgttacgtggtaggttaataaacgaggtaatgaggggatgaatgtagagataggtggaacatatagattggtagattagtggatattttggaaaatgaattgtgtaagagaagacagaatttgaaaacagaaggacagagaaaatgaaaaggtatgagacctcagagtgggggcacgaggagctgtttgtagccagaggtttctggttgaactcaggttcctaaactctgagttgtacaggaagtagtaaaagttttttaaatgtccttctagttctcttttaaccaactagaagagttgccaggatttttaatttccactctggggtgtgcctaagaatcttagttaccattaccatttgtatacagtattattccttgagaataattccagagcccactttttttttttttttaaacttggcagtctgaagagatttggcctctttgtagtggtttttgtgctaatattgatccaaatttagtttcagtgcctgttttcttctctttcctattcagtcaactatttaacctctcagtgattttagttgtcctgaaatttggtctttcttagcaaggacagtttgttttatgttctttaatagttagaggatgactgggttcattcccgtaataccagaactttgggaggcttgagataggaggatcatgagctcaggaattcaagaccagcctgtgcaatatactgagacccccttctctacaaaaaataaaaacattagctgggtgtggttgcatgggcctgtagtcccagctacttgggagtataaagtggaaggattgcttgaacacaggaggttaaggctgcagtgagctatgttgctgccactgcactccagcctgggtgaccctgtcttaaaaaaaaaaaaagaaaaaaaagataaatcatcactctgaatcttttcattgagaattttttttaatagcctaagatgctaagtagtctatacagtgatttctgcatgattttcctttttttttgtctaaatcttgacataagtttaccttcttcaaccttttaatctattcctgaatgcattattttaatagatgtgctatttattaatattttggaactagaatattaattaccccttttaaggcaaatcactacccaaaacacattaactgtgccttcactaagaaccttggtaacacatttgcacctgacaaaagggagtgggcagaaaattagctaatgaaatagttgttctggagtactatgtaattaagggctttgcagagagcccttggggaagctggaagactgggaatgagttaaatgtatatgagttttctagtgctgtagtaaataaatgtgtggtagaaatgaaaattttcttgcggaaagtatttaaaacaaggacaaactgtagttatattagtttgcctaagtattcaggtgtataggaaattctgaagatactttttgttggctaattgccattaagtacccacgtgtactgctttgtaagtggtaaaatttgaaggctgctgttgagtaactgtttcaaacaggtatgaagtcagcagtgcttatgttttcattttatctatcgggaataagttgtggacaagtctcctaattcggtgcttctcaagctttaacaagcatatgaatcacaatcactgggggatcttcttaaaatgtagactttaattcaggatttcttgggtgggactagagaatttgcgtttcattcattcatttatttattttttgagacggagtcttgctctgttgcccaggctggagtgcagtggcaccatcttggctcactgcaacctccgccttccaggttcaagcagttctcctgccttagcctcccaaatagctgggattataggcatgcgctaccacacccagctaattttgtttttgtatttttagcagagatggggtttcaccttgttggccaggctgttcttgaactcgtgacctcaagcgatccacctgccttggtctcccaaagtgctgggattgcaggcatgagccaccatgcccggtggagaatttggatttctaaaaagctatcagatgataccagtggtgcatagaccacactttgagtagcaagagcctaatattttttttttttttttttttttgagacggagtctcactctgtcgccaggctagagagcagtggaacgatcttggctcactgcaacctctgactccctggttcaagcgattatcctgcctcagcctcccgagtagctgggattacaggcacgcaccaccatgcccagctaatttttttatttgtactagagacggggtttcaccatattggctaggatggtcttgatctcctgacctcgtgatccacccgcctcggcctcccaaagtgctgggattgcaggcgtgagccatcgtgcccggctgcaagatcctaatatttcttagaaggagagaaatcctttactcacaggaactgtacacacatgttcacacatatgcacaagcatgcctgctatccataagcatttgtcatctttcagatgatggaagctgtttgagacccttaagggactgtagtcatgactcctgtcttttcagtatccctttccccttatcactgtgatcctactgcatttatggaaaaactgctggcgggccatcatgtttgacccagagctgaagttcagaacttccttgttgattgtcagtgttagtaggaatgaatttagcccattatagtgattggcaattagaatggtaccaacattatcagttaaatcctgtctgtttgcttaactcagttttgggtgctaaggcagctgtattctccatttcagtaacttctgaatattaccattcaggtgctctgcatcaaaaagccccacattggctgggttttgtggctcatacctgtaatcccagcactttgggaggccaaggcaggaggattgcttgagcctaggagttcaagacctacctgggcaatatagcaagatcccatctctaaaaaatttttttaaaattagccaggtatgatggtgcacacctgtagtccttgctgcttgggaggctgaggtaggaaggtagcttgagcccaggagtttgccgtcagaaaagtcccacatcagttactaaagtctaacagttctacctctctctgtctctaaaatcctcttaagtctctctgtctctctctaagaccacagctttagttcagggcactggtctctctccctggctcaccataccatcctattaactgatcttctggccctattctgatatattctccatagtgcagctgggatcagctttctaaatgacaaatccctccttaacttttttttgtttgtttgtttgatacagagtcttctctgttgctcaggctggagtgcagaggcacaatcttggctcactgcaagctccgcttcccggtttcacgccattcttctgcctcagcctcccgagtagctgggactacaggcgcccgccactacgcccggctaattttttttttgtatttttagtagagacggggtttcactgtgttagctaggatggtctcgatctcctgacctcgtgatccacccgcctcagcctcccaaagtgctgggattacaggcgtgagccaccgcgcccagccccttaacatttaaactctgaaagttaagtccaaattccttgacatggcacacaaggccttccttgagtctggccttggaagctgtgcatctcacattagtttcttggtggggtcctttctttcttgcctccaatcttttgcacatattgtaccctttgttgtagaattccctaaagtgctgtgcacatttctttcttgcagttttcatcttatgttgtcattgccttttcttggctcaactgggaactttcttggggccatgactctgacctgtgcacagctgtcttactgcctggcacattagaaatatttattgaataagaggtgaaatgaaaagaaaaggctgcgtgcagtggctcatgcctgtaatcccagcactttgggaggctggggtgggaggattgcttgaaggccaggaattcaagaccagcctgggcaacatagtgagactgcgcctccaccccctgcgcccccccccccaatacacacacacacacacacgcacacacacacacacacacattagttgggtgtgataacctacacctgtagtcctagctgcttgggttgctgaagagggaggatcccttgagctcatgagttcaaggctgcaatgagttatgatcatgctactctactccagcttgagtgatagggcaagaccctgtctctaaaaaacatttttaaaaagagaaaattaaaacttaggtaagtactgtttctttattttgtctgaggtagaatttaaaatgttgaggttatggaaagtttatattaaaatcatacaacattgatttagtaataaagctttaatgatgtatgtagagcaaatatcaataaaacaaaatttgtaattttatattagtatgtaggcaatgattcatattaaatatggaagaggagggaaaagatctggaataataatcataaaaccaataataaatatttgagtaaagatagagatgttgtagaaattgtaaaacgttaaatttttccctttttgtggtttctctatttagatcatggtaaatggatataagtattatcaaaaaatattgatataattttttattttctgaatatgatttttatttgtctttggtagcaaatgtaccacattaaggtggtatttggattataatttagggctagtaaacaggaaggaattgccttaatccaaatatacagtagtcttcccttatttgtggggataatttccaggctcctcagtggatgccagaaactgcagattgtaccaaaccttatatacaccatattttttcctatacataactatgataaactttaacttataaattaggcacagtaagagattaataacaatgatagtagtatgctataataaaagttatgtgaatatgcgcttgggaactctttcatgcacacactgtcttgctctctctcaaaatattgtactatattgaaggtatgtactgtactgtgggtaactgaaaacatggaaattgaaactgtggataaggggggactatccatttacctcacttagtaaatatttgagtgcctactgtgagccagacactgtgttaggtgctgggattataagcaagatatacatgatctgaaagataaactatgtccattatttgcaaaaacaagttacatgtgagtgttctttgctgtctgtagataacaaatatgtgtatagtgatttactgctcatagagctcttttgtgcgtcttattgcctttaattccacgtaacaagctgagggaaacagagactgagagtaatttgtagaaagtgacattgctgtgtgatagagaaagtaaacttgaacccaggataggctccaattccaaatcccatgccattttcttacaccatactgcactacatccatgggcgattgtggaataccttacagaatcatatcaagtttttaagaacatggtttgaaaatcactttttttttgtatttataacacaaatgcttaataatttttgagcgttggggatgagcacaacctaacttatatccattatattactattgcgcctctgacactttaaaacattaaaaacctggttttacccttaatgttttctggaattgtatttttttaaattagcagtaaagggaaggtatgtattttttgaaatttcttcggattctttctgccttttgcaatttccttgctatcttgatgaaatacaaagggtgaaattcttatagctagaaggaactttagagaaagaaatatattattggaattacagcacataaataaaatacagttctcataattcacctcggtttaaattattctttgtatctgcttctgcagaaagttttcatttaggcaacagtcattgatattgacagtgtcagttgataaaaatgaatgtaactgtggtttattaaatgcaatgtgatgtatgaatgtaaggtggtattactatagtcctccacttggacagagagtgagaggggacagtccattgccactggtattgatgtcctaaagtgtgtgccatgaaccttatgctctttattaggaaggctactctggcttgtttactcttggatttgacaaagactgtttccttgacagaacttcagttaggttcctctgagccctcttctcaacgtggggtcaaccttgagtttctgtgtttgtccttgctaagtccagctttagcaagaatcctgctgtgtcggtttaatcagaatccaccctcccctttatacctgatcaccctgatcagatgtggatctgatcaagttccacatcccccacctttgatctgtaagtccttgacctgcctttagaaacaatcctgttaggttagtttaataagaatccccctactcttaatgtgtttcctcttagtacttttccatccaccatcctcttactttgcttcttggctataaatcccacatgtcttagcttaatatgaagttgagcccagcttctctcccctattggaatatctccattgttgtggtctcgaataaaatcttccttaccatttttaacatgttttgagaatgactttttttctttaacagattctcagcagcaaaagcaattcaagtaatcaagtctacgattgggtatagaggttaaggtctctatggcctaaaggtaaaagaaggggatatcagccatattcaaatatgtaatgtttaaataagctatgaaggatagcaaccttgggtaagataagatgtgtgtaagatgtagtccacagcaaactgaaaagcgtggccataaattctaggagtgagattaatttaaataaaatgctgataataaataccaatattaccaacctatggaccatttctccttgaaggaggatgcaaaaacatttaaaatcaagctggaataagcaaaataagaatttaggtaagaatggagttcttgttgagctcctagatttctagatgcacacctggtgacactttttttttgtcctctcaataattatggaaagccaggaccattaattatttttcacttttagatgataaacctgtggttaaaaatggtcaaataatttatttgaagtcaactagaacttaaacctgactccaaaacttgtaaaataatggtggtggtaatgatgaaggagaaggggaactggggagaagttagtggtgatgttggaggtgttgatggtgtaatagatgatgatggtggtggcgacggtagccatggtagagatgttggtggtgataatggaggtggtggtgctggtagtggaggaggtggtagtgatgatggaggtcatgttagggtgatggtgatgatggaggtattggtggtgatgatgggtggggagggaatgatgttggtggggtgggactggtgatcgtgggggtcatggtagggtggtagtgatgatggaggtattggtggggatgatagagctggggatggggtggtgatggtggggtggattggtgatggtggaggtgatggtggtgatgatggagagattggtagtgatgatggaggtggagagaggttggtgatggtggagtgggattggtgatggtagagatgatggtgatgatgatgatggaggtcacagtagggtggtaaggatgatggagggattggtagtgatgatggagttgaggagggggcggtgatggtgaagatgctgatggtaatgatggaggtgatggtgttatggtggtggcagctgccacttacttaggatttcttttgtcctaacctctgggatgatctaatttcacctacacctctgcatccataatttactacatgcctattaagtggcagagcttggatttgaacctaagtttgtctgacaccaaagtccacatacttcacaggaatgttgcgttgcttctcacgttatttccagtccaccatatgtgaattctgtgtattttcacagaataatgacacctgtattctggtactgtgggactagtataagatggtcaaactgctatcaatgattctattctctttgcatatttcagtatccaacaatttatttataagaccaaaagacctttctgaactatcataggtagcctgtgttaggaccatcttatataaacaattttctcttgctggaactatctggagtgactgcataaaaaaagaagtataatcaaaatcggataaacctcccagtaggttagtcaatagataaatcaccattgttcttacttataggctgtacctctgtgttgttcataagggattgtacagtaaccagcaaatttgtaaatgtttagctaaaattcaataacagaatgatcaagttttattgccactttattgaggctttgttttccgttagaaagctaccatttgatagtctactaaaaatgccagaatttagctgtattaggtttattcttaattcattgccattatggaatgttcctatagcacaagtgacaggagaaatccatgtataaatgtctgtgctacatgctataagcacagtgattcccacctccaccctccatcttctcaaagcaatcatgtgaagtatcaccagctatgagagacagaatatgctggaggctaaatttctttatctttaaaatgtttccaaaaatggccagaggagttgatttgcttttgtttccatgagtattttcgctattacctttagagatcactaactcagagcagttcatatgactttctgctgtcatcatcctgacccctgcctaaacttttcttactgtggaaaatattaacaattgaccttattcagacatttggcaggctgtggtcattattaattccttcttgcttttctacatattttaattgccctcgggatctggtattctgaagaatgctactattggccagcttgataagtttgggaaatactctcctcttcatagctctgagttagttagccttataggactagtaatgagagttgaatgaaagaactagaaattactagatctttcttataagggaaagctcttcttagctaacattttaaaataattttgcatttttttgtttttcaatagttaggctatctgtatgatgttcttaagagaatattcagaattattagcttgattttaccaataaagattagagactgagtatacagatttgctgggagtctctttttcatgctaagaaatgaagttatattttacccaggcctccctgcttatcatcttttcattttttcccttcctccagacagcccatcctgctgagccaatacacagttttgaaatggttttatgtctatgagcaccacatggttagtctgcaggaatcataataatgtcttggacatgtgtttcaagatagctcagccttcttatcaagacttatatctcacaggatatcagaggagggagggaataaagcattatattagggaaaaaagcattacattagggaaattaagagttttgtgcagggttatcaaatgaacgttaatattgaggaatgtatatctgtgtgtgtgattttttttctccacctgtggctctgctgcgtgcattcacattgtgcatgcgtgggcatctctctgctgccttattttatctgatttattttttacaacacaatcatttaatttgactcacctgaggggttatttcattatcagcatgttgtccacttctatgttaggtctattttgattgaaaccttggatttttcccttcaggattgtgtgttggggtgggggcatactggggatgacagagggagaaagaaagatttttatttttccttctaataaatgttcattgagaaagttatagaatatggagaaaatgaaatttataactctcctgcgcagaaatactgttagctgtgagtttcttttctatatatgcttatatagttgagattatgcatgtatacagttctgcatcttagctttaaaaataatgtcacatcttgataatttcccagtcattaaaattatttgaagatatcattgatgtatcaccttattttatattctatttgaataatacatccaaggtcaccaaaagatgacagtgaaatgtattgtttgtaatctacattagcatcagtaaatatggaccatttaaattgtgttaagtcaacctctctgatcttattttattaaagtttaggataggcactacattggatgggactgtgatcttaagagtctcttaagaggctatagttacagaggctaactatctttggtttacttaactttggccgcttttttaatccatatactataccccaaattatggtcagccatcttaaaagtatccatcttttgtatcaaaaggaatttagcaaatagatgtatgtagattagtgcaaactcattctcacttttgtaaaaaatagttaaacttgatgtcttacatctgtagactcatttttggatacaaagtcttaaatagtttgtgttagtcaaatataaagaagttgaagcatctttgtatattctgtagatcatagatcctcattgaatcattttactatagtgtagtctttaatagtttgtaatgtcattagaagtaaactcaataattcttattactatagaataaacatgctattaataagaatagaaatattgttagtcatttatgcgttgaaaagacatttccatttcctgtgcttttcctgacctcagccagtacattagcacattcgtacactggcagaatgctaactagatgttatcacagattatgtatctgtagatttaatcttttcaggacttagcatcagcaaaagtaggacagtttttttttagtctttgtattccatctaaacatgtattgacattctcaagaaagtcatttgaacaaaaatcccaacatcaaatactccagagaaggcatctccaggtgcaaattatgatcagattatgggagatttatcttcaaggtcacaaaagtatgctagctttgggggaagctgtgtcatagtgtcaagtggaacatgcttgtttatttggtactcacgcagtgttgtttatactgaaatacttgaatgtatgtgctcacctgctgtttttcttctgccttttaaaagtcttggagtacatcattataacaaagcaatttttttttgattttgcattgcaagtttttgtttctctctaataatgcagtttacttctaagtgtggctttgataggaagatgtcagaccttcgagtggatcactaaataataatcacttgtctatcagtgagcttgttataaggtgtgttgcttttgatgggctattacctgactgctgggtcaaagttagtcttgctctgtattgggcaatctaaatttaagccttgaagagtgtccagattgtacagaatttctgatttgtatctggtcaatactgtcagaattcagtttttttttttttttttttttttgccagtatttggttgatgggcattagttagctgataaaagtggtatgttgtggtggggcattgtgggagattagacatacttttattggaatatatttgggtattttaatattcccatctttatttgggataatgtccaattatttttttcactttcaggtataaagtgttgtgtttttcttcagcatttgtctaatggtagcccagctctgcaaccacacaattaatcccaaaccgccatgaaaaatcaaatattctttttagctgtggtcccaattatgctggagactgaggcaggagaattgcttgagtctagttgagtccagcctgggcaacatagtgagactctatctctaaaaaaatcagaacaaaacaaaagaacaggaccgggtcataagcctaattcatgtgacaccatcaagcatcagaaaaaagtagtaatcatagagaagtttttcataaataaattctgaatcatattaaaatttaatgggagaaatgaagtttgaggttttctttttttcccatgaaaataaaattcagaagatgtttacaattactctgctatctttctcaaaatagtggtttaatggcaaacctctcggaaggactctgtatctttcttagaggtgctgaaggcattgctggtgctcagttcatgtttaataataatgttattctggattgaagtgtggctagtataccagggttaatgctggtgctttaaggagaagggtgattggcattttaatcagtggaaatgttcagaacctttgtctgaacgactgtatttccagctgttcagatttctcagttctggttcagtaccaattcaaagcggagagctccatctactgaagacctatttcggaatgatttcttctgttgagttcagtgattttctgtttgcacaggtcattgaatttttttctgatttatgagctccaatgaaggttatgatgaaactggcaatttggtcatttcaaaaccaaattccttgtcattttgcttagtgcctaaatccaaaggacttaccagggggcattcttaattaactgtatttaatagtcaggttttcttgggaccaatgtagatagtaagactgctcttaagaaactgttgctatagatggtctttctttagtcttccgtagctgaatcccctttcatagactcacattgggattttattgacgatgtcatagaactgcagtgactttggtgtcaaatttaggcttgactttcagtcttgctactttggatggctcaagtgatggaagtgcaagtgactcaatttttataaacctcagattccttttggggacttatagccatgtttaatcagtctggactttgctggaagcgcagaagaatcttcgaagggttttaaataggagatcattcatatttgcactataggtcaaaccagagattttggtacccagaactttagctgtcacttcatttagagattaccaaagctgctgagagctatgttgtccaagatcatatactttcctggtttggcccatagtgactgatcagtgaagggggtataaagtccaggccatctcagacagactctgaataactttaaagggacatactttcatgacagtgtaacagagaagacacttgaagcagatataaaaatcacaagccctaaaagactgacttaaaaaaatacattaacttaaaaatcttaaatataacaaaagacattaaaacaaaacaaaatgatagaccacagactggttgtatgtatttgtaactcttctaagtggtcaaagagaagtatccaggatttgaaagaagtcatacaattcaataagaaaaagataaacaactcaatggaaaatggataaagaatatgactaggcaattcacataggtgaatgcttgaatgaccaattataaaagatgcttaactttgctaatagggaaatgaaaagtaaaaccctggtgagattccattttacacctattgattgacaatacctaataagcttgataacaccaagtgttggcaaggatgagaagaaacaggaactcttgtatattactgatgagaataaattactacaatcttttaagcaagcaatctagaaatatctggtaaagttgaagatgtccatattctgcaactcagccattctgcctttatgtgttagcctaggaaattgtcacacatagaaataaaagagacatgtacaagggtgttcattgtagcactgtctacttcaaatagaaagaaagcagaggaatgcataaatgtagggtgatgtttcctccatacagtagagcagttaaaataaactagttgcacatgtatccacatggatacatctcagaaacatactaagggtaatgtaaactgtaaaagagtatataatatatgtaatgtaactattatatatgtgatatagtgattgtctatattctgtattatagataaaccttttttgagatataagtttgataccatacagtttaccaattcaaagtatacaattcaatggctttaaacatgttcacagagttgtgtatctgtcactgcagtcaattttagaaaattatcattactccacaaagaaagtccgttctcttagccatcagccccctacccccaaccgctgccagcctgtcatattctccagccctaggcaaccacaaatctactctctgtctctatgtatttgcctactgacatttcatataaatgaaatcatataatatgtggtctttaatgacaggcttctttcagttagataatgtttttgaggttcatcagtgttgtagcatgtatcagtacttctttttttattgctggataatatttcattgtatagatataccacattctgtgtatccattcattagttgaacatttgggttgttttcactttgtagctattatgaataatgttgctatgagcatttatgtttaagtttttgtgtagacatgtgttttcatttctcttgggtatatacctaggagtggaattactggattcctggtaaccctatgttggaatagccaaattgttttctaaagtggctgcatgcttttacattcccaccagcagcatcagagggctccagtttctccatatccttgttgatacttgttactgttcatctttgattataaacattttagtgggtgtgaggtagtatctcattgtagttttgatttgcatttctctggtggctaatgatgttgatcatctttttcatgtgcacattgactgtatatagatttgtaaagcatgtaaaacattggcatatattgtttctcgatacacacatgtatgatcaaagtataaaaaaatgggaagagatggtgagtggagctttagctatatttgtgtcattttatttcttaaataacaaagggcattaagcaaataaggcaaaatattagcatttgttaaaattgtggtgctatatacatagctgttatattattttctaaaatatagatatgtatagttgtagtcaacaacctcaaaataatagttgttgtaatgagagtagaaaattttgccaaggaacaattaaaacataatacaagttgcagaaatgctttggtgcatgcttacattttgttgagatctgacaaacgggaagtaaaatttggtcataaaagtctaagttggagaatcatttattagtacagatactaaggaaaggttgtcaaccatgtcagatcacacagagagggagcaaatgtagttaaataaaaaacaacaaaactttatatttggcaattcttattaatatcctcctaggatgcagttttcattttaggagcaaggttcaaaatcaaattgtagggagtatacaatatatgctctatgagaaaaaaagactgtggtgtaaaacacattaaaaaggttgtcagtgaattgaaggagagaaatagggcttgaaaggaaagatggagctaagaagtttgccttgtgcatcaaatttggtgtagtacttgaccatcacccatgtgaacagtttgaaatttcaaagtggtaccacagcaacatagttctgatttagatacctagagtgacaagttttttattcatactttctctctttcctctcttttaaaaagatgtaatttgcatatagggttgtttctctttctagcactcaaagatcctttgagtaaggaataatggtttctataatagcactgccaaccacagaatatagtcagatgcataagtaaatatatcttgaaaaagaactttatccagcatggagagactttgtatgtgggaaagctgtgaaaaacatgggaagatgagacaatgtgtacaaagtgccatcaacactacctcactcatgatcggtcaatcttagtattccctcatgtctcctccactatcagatatttgagaagaaataattgaggaaaacgtttcagaacactctgaaaggaatggagagaaagggcaacagtacattttttaaagaaggatggatgaatgactctctgcttgcagggagggaagctaagccgatgttggagtagaggaggagctgaaggaatgcacggtgagtgccctcctgttggtaggaagagggcctggtggtgatgaaggtagcaatgtgggatattacagggaaggaacaacatttggagcatctttggatgagtgaagaaatgaaagacagatgtctaaatgcattgtctaacaacattgaggattcacatggatttagatagtatgaatgatgaggtctatatgattatgtgatttttataccttggaagctgggaatgaagaatagcatacagggtgtgtaatagaagggatttgcagggctgcaaggaaagatttggtggcgacatggcaatttccttaattgtttgaacagttcttttatggttaagtaattcttttaattctgttttatcataggacagaacttaggcactaaagagtctaagaaaggcaggttcctgcccagtcaaaagaaatcaccagtaattagagctatctaatcatagaatacactgtctttagagatagggagtttcctaacaagggaaggattcagagagaggctaggatgtgaagatggaaggtctgactgcgtgtcaactgaaaccttttttacacttaaggtgttaaatggttttgtactcagaacattgatggggtaaaaaaatctcatttataattaagagcagaataaatgtagtgactataagaaaccaggcgaggttagaatacatgtagtgactataagaatcaaggttaggttctacttgtacacagaatggagccaaggatctaagacaattggggaacatctatgccatagtttacgtccttttttctgcctctgtactagtgacatcaaggacagatcatatgagtaatatcccctcttgcttgctgtgatccttgaccagtctacctcatcagtacctttagtcaccatggtttttttaccctcatttaaaatttcatttgaaacaagtcattataattggcttctttaaaataaaaaaccaaggagtgttaaatttatttgtagactgtgcatgtgaaacattagaattctttatagatttctagtttttgcatgatttttaacccttggcatcaatcagtagatggattttttattttaagtgaaagccatagtattaataactaaatgtctcttccatgttttactaaaaaagtaattcctttctaccctttcttcccactttcatctccacttggtaatagaaagaacatagcagatttattagtttcactcatctcataaagataatgtcatcaaacatgttatgaacatagttcaggacaagagacaactatatgtattgattcctttctttgttccgtgctttacatatttagactataggctacaatcttggagaatcccagactcgacactttttttgttgctgtggcacattagtgcccagaaatttagtattgattactgtagtttctcttgcctcatctgaatgtgaaaggaatggcaaagtggcttcattcataatgttggccagttagctctttttgcttactgaggttgtacattggttttggagaatacggaataatcaggctcagagttactttcacattgtactgctaagatactgttgaattaaagtcacagtgttcatggaaaataatgtgtcagaaattactaagaagaatgtctgaaatgtgcacaggttgtgaagtgctggagagaaaaaaatgggtcagtgcattgattctcttggggtaagggtgaggaccacattctttaaggggtgataacaggagctctagttaaaacgtttctaaatatacacgacccacctcctgaggttctgctgtagctgtcacccctagggtttgttgttttcctttattctgcatgcatcactctgtgtactcactactagtagttacttttagggttattgtgaatattgttagatataagatgaattggtgcatatcctctgacgctgggagaccattgtaattgattggtcaggtattttatagcgaacttctatgtagaatataggattagataaagcctttgtatacggtaagctttcagaatttaaattaaaaatgaaaaagtcaatggagatttatgggaatatattgtaaggatgacagataatttcagtggtgagaaaaaggtcatctttgactatgtttcaaagtcataaagtggttcaatatgatattcctggtgtaagtgaattcaaggagtgttgtacagcagaggaaataggggagacatcctctgaataactgttatttcaagaggctgggtgtgtaggcagaattaaagaaggtagaagtggagagatggtttcaagaaaataacaaggtggtttcaatttgagagacattagatgaatcatgtaatgaggattttgggtggttatggacttgtagcaccaccagcagcatatgagctgatgtatggttagtaggactgaaaaaatgtcaaggaagaggaggaaaggagactcatggtatggaacagattaaggacttatttacagatgcagtgaaggaagacgtttgaaatgctccaattcttcaagttggtattcatgattaaaataattaagaagtcagttttgagaactaacagtaaaggaattgaccacctgactggtgttttgatgtgaagcagatttaaagggataaaatctgtatgatgggagatcaggaaggcagcagtggtgcattcatacacagccaacactcaagtatttatttgagtattgttctggggagccatggaggatatggtttttgtgttttaaggggatcatagtctgattggcacagggataacatcaaaggccaacccaaatagaagacagcaaatgttggtgtgtcaaatgaatgttagtgctgtttgaagtgtgaatcccagatcccaggccccaatccaaaccgactcttattattttcctatggctgcctacaaattaccacaaacgtaatgatttaaaatagcacacacttattatctcacagtctctgtgggacaggagtctgggacgctgagatggttcctctgcttcagggtctctcaccatgctgcagtcaaggtgttagccagctctgggttcacctgagaggctcaactgaggaagagtctgcttcttcttttttttttttttttttattatactttaagttttagggtacatgtgcacattgtgcaggttagttacatatgtatacatgtgccatgctggtgcgctgcacccactaactcgtcatctagcattaggtatatctcctaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgttggacagagtctgcttctaagctccagttgttggccaagttctttttcttgctgctccaggattcatgacaacttgcttcttcaaagccagcagtggggttggtgggaggggttctgctagcttcagagtcttgtatagtgtcatgtgacagcctatcatctttttcatattctgttggttaaaagcaagtcacagttccctcccacgccgaaggggagggaaacacacaaaagcgtggacagtaggaggtgaggatcatggggccaatgtaaagtcttgtctgtgacacctgctggatcagaatctacatttcagtgacattccttagacgattacattttaagaaactgttacagatggtaggtgccaaagaaggttgatttagagggagaagaaagttctttgggcttgacctggccaggtgaattgttttatggtcagcaaaataatttgttgtgtaaaagcttattcacatcagggaatttttggtattctttctccctgccacttctgcttgagtatagtgtttttcacttttgtagtgctgttgtactctctgagagagtttgtaatttcctaacttgggcttaagaaaaaaaaaattgttcctttcccttttactattccattttgatgataggggttggtgtaaactaatggacatgctctgccctaatagcagaacaatcttgggaaagacattgaactatcctttgcatcaattcttttatatgttaagttctgtcattcttctcttacagggctgttgtgtgtgaattgaatgagttgaagtaaaagttcttggtaaagtgtaaagcattatataatgttgtggtggacttgttttgttgtaatgccttattcacagagctgcccccttcctaccaatagtagtgtgtatccagaagtcatgattgttccttgattgtgtctaaccacagtccttcagagaaggcatggatggctgatccaaactgggtcacacagattctccatcttgggaatttggatttgggaccaaatgatgacagtttagtccttgctgacctaacgtaaagagattagaatccaaggaaattgtggtacagctgacttctactgtacgagtagcagagaatgttccttgcagaggacagagggaactcagatctgaagagagaaggaaagttatggagaaagagggcccactgctgggggcctgtctgcttttgatttcctgcttgcttttctgggtccttgcagcatttttgcctttaagttgtataacacataattctaaatctgtatattagtaataattttccctcttttgttcaagctattttgagttgttttctgttactttcaactagagagctgaaatgggagccaataagtgtgtacttaaaaatttttaaaaatctcctaactactcattcatttttcccccaatgcctacataatttgtttttaaaggccaattatattgcttcattcattgaatagtcattgagcattttttcaggatactttagaaataccaaaatgaagaatatgatccttgccctgaagcaattttttaatttactaagagaaatggacatttaaatgactacctataatactaggcagaagaaagaaataagaactatgtgcaattcatttgaggtaatttttatgttatgcccagtaacctgattgaaggtgattaaaaatttcatttttttgcaaagaactgagcccttttgtccctgattgatgataaggtcctgacatgcttttgggcccatcatttttgcttacgcctctgaacattgcaagtaggctgggcagtctggccatatatacctttcttcattaagtaggcagaggacaatacaatgagataggcaaaactgaaaacaaaacagaagtttaaatcggagatttttaaaaaactcgcttagtgaagttatttgatttcttgattaggtcatcctttagctctgggtgatttccatgtttaagcttggttttagaggttttgtcttccttatagcttgtatcatgtataaaaagggtacttatataccttatattatacaataaagagggtattgatattgcttgcattgcataataaaaagggtgcctaacataagagttctgtgtttcctatagtttgcattacataataaaatcagtgcttaaattagatgggagccagtgaaattatagtcaaactgcatgaagctgattttagaaccacattttcttaaaatggaggttatgtaggttacatgttttactggctcatggagctcttcaaaatgacccagttcagaatgacattcaacttagagctgattgaaatgggcattggtggaaaatcccttggggatttgtggagcaattaaaaataacctaggaatctaattctttttaataatagaaaaaaaatctgtagttagaattttagagaagtatgtgaaagttttatcttactacagaaattatgggaaatgcttactttttaaaaggagaaagggaaagaatctcatgttgaaaattgtcattaggtaaagtaatagaattaatggagcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgttgaacccgggaagcggagcttgcagtgagccgagattgcgccactgcagtccgcagtccagcctgggcgacagagcgagactccgtctccaaaaaaaaaaaaaaaaaaaaaaaaaatagaattaatggagcaatccaaaatgagctaaataagtttctttgtgagaattcttctagagattaattctagaattcttctagagacttcataatatatggtaaaactaatattgctgcttagatattctgtgtcgtcttttgtcctcactttaggtaagcaatatgtacgccatagcactctctatcttactttacatcactttgctcatttggtgattgtgtaggtgtgagtatgtgcatgtgtgtagacttttgtcagtttccttcctgctaaattttaagctcattgaaagtaagaaccatgtgattagcttattattattatgtaccctgtacctagtgctgttcttggacataatagtgagaggtgacaacgtgctagcagccctcggtcgctctctgtgcctcctcagccttggcatccgctctgggccctctttggggctggcagaggctgaagccggcttcctctgctcgtggggaggtgtggagggagaggcgcgggtaggggccagcgctgcgcgcaggccttgtggccggcacgggatctgggtgggcacgagctcggagggcccgcacttggcacagccagctggcgcctgctggacttgatagggggacgagctccctctgggctgcggagtgcctgggctaggtgccgcaaagtcctgtggcgagtgctagcgagaggtgaagccggctgggcttctgggacaggtggggacttggagaacttttctgtctagctacaggattgtaaatgcaccaatcagcactctgtcaaaatggaccagtcagctctctgtaaaatggaccaatcagctctctgtaaaatggaccaatcagtaggatgtgggtggggccagattagggaataaaagcaggccacccgagccaacagcaacctggtggggtcaccttccacgctctggtagctttctctttgtaataaattttgctgctgctcactctttgggtgcctgccgcctttatgagctgtaacactcttatgagctgtaacactcactgtgaagttgtgcaccttcactcctgaggccagcgagaccacgaacccaccagaaggaatgaacaactccagacgcgccgcctttaagagctgtaacactcaccgcgaaggtctgcagcctcactctgaagtcagcgagaccacgaacccaccaagaaactccggacacatctgaacatctgaagcaacaaactccggacacaccatctttaagaactgtaacactcaccgtgagggtccgtggcttcattcttgaagtcagcaagaccaagaacccaccaattccaacacaataggtgtttagtaactactcaatgaataaatgaatatttctcataaccttgtaccctacaagcgttactcataaaaagatatgccgggaatatttagaggtaacattatttttattgtcagaatattgtatattcgatgtgaggtttagcactatgaatagagtcagtaaataatccataaaaatgtgatcagcttgactcttgtttcttatattctctcagagagaagctaaacttaagagagagggagatcaatagatgagacatttaaaatgtttagcctgtgacttggtaaatgactaccaaaattctctggaggcaaagcctgtataaactaggttggctagcacacagaaaatgttaggggagttcccaaagcttcagactaagttagtgatggcaaccagttcagtgaggaaacaacagtattttcctagggccagagctcaggatggggagacactgccatggtaccctatgagggaaggcatggactccatgaactgcagttacggtgggcagggacaggaacttcaaagacagtgagctgagcagccatggaagcttcaggggatagggagatgttggtagggagttgctttttcaagggaggacagaatttagaagtcggtagtctggggaatgtaaaccaaaaataaaattctaaggcccccaagtcatttgaatggacttcctcctcagccaagacactttttttgttcgtttgtttgagatggagtctcgctctgtcacctaggctggagtgcaatggcgcaatcttggctcactgcaacctctgcctaccggttcaagcgattctgctgtctcagtctcctgagtagctgggattacaagtgcacactgccacgtctggctaattttttgtgttttagtagagacggggtatcaccatgttgcccaggctggtctcgaactcctaagctcaggcaatccacccgcctcagcctcccaaagtgctgggattacaggcgtgagccaccacgtctggctcaagacactcttatcatttaatctgaaagactggctcaggtcatgacgggaacatggggagttggacatgccccattatacctctccagcattaacatcaacacagactttaagtctgaggagaaacattttacaccttattctctctcaggcctacaacctgaaggcttcctctgcaaataggaactttgatctccacagttctttctcctaaccccgccattcatttctattgatcccaggtctttagataaactcaaccaattgtcaaccagaaaaaatttaaatctacctataatctggaagaccctgctttgaggtgtcccacctttctggaccaaaccgttatatttcctaaatgtatttgattgacgtctgatgcctccctgaaatgtgtaaaaccaaactgcacctcgaccaccttgggcacgtgttctcaggatctcatgagggttgtgccattggccatggtcactaatatttggctcagaatatatctcttcaactgttttacagagtttgactctttttgtctacaggaaggagatgatcagcacccacttcccgtagatgttttctgtttctggtaatgatgtttttggtgttagggaattcagccttggctattctatgttcattttaaggttggtaacatcatgccccagttaggggttatgtgtctgtaattgccacaggagcagccctgtgtgttatgcctgcagctggctctgaatctgttaaggaaagagcaagtaaatattttcttacaaatataaaaggaagagttaaacacttattgtttggaaaccaagctgatgagcatattatattgtctgaggccccagaaataagcaaattaattacatgcaaataacttgctcatgaagtgtgggataataatagtatctgtttggatgtttatggcaaatttatttacatggctcaattttctgctaattttcctgtggaaaataataaatattggttccttttgcctttcttttagaaatacatcattgaaattatgaaaactgttaccatgtcttgctatctttgctttgccaagggcaattttaaagacagtatttgtaaatacatggtgaagaaagaactattaatgtatgtaggttctttctgctgtaaacagatggttgtcatcaccaacatcattaaataatacagaggttattattgaatattaacattcagtagttcagttgacttcctgttgatctttttcatgaacatcttttgatgtcagcttcttgctgagcttcagacatttcctctcttaaggtataacagggaattgagcagtttatattgacagtgtgatccatggtctctgtctttttcattaatgagtaattggattcacattgaaaagatggctctaagctctgcctagtgctccatacactctaaaggaaccttagcatccaatgtgactctcctgatgctcccatatgtgtggtttttttttgtttttgaggtatatcaaaggtgattcgatgagttgttttatttttttcaagataatcatttttttgcagttcattaacttggattgtatgtcaggcgcctcataagctaggggatgagtgtgggattgagtctttagttgggatgaggagtatttgtttttgtatccaactttataggctgtgctgctcgactcccagcctttctcagtagggtgatccacagctctactaggttactattttatttgtttgctgtctgtatgctaaggctcaggcattgacatcacctctatacgttttcatcaacaactctgacattttgacatgacaaccttgaaactattatcttatggaatgccagacacatgatctgttgttcataaagcagtaagtagaatggaaatggatttttcttttaatttttggtagagcaggaattttaacctccagtcagaaaggaaaacagagcagtttgtatcttggattagcttttatcagctactctgcaccctcatttttgccatctacaagtgcgttggggtgcagggagatgtggggttggcacaggaaggttgagccacccaactctgtactctgtaaattaatatcttgcttttgcatgaactctctttgccggttttctccatcaattgccgtggtagagatgaggctggtggccaaatattttcttcttgtatttccagtgggtaagggggtggtaccacacacactttgggtattccattgttcttcctttcagtttgaggttcccatgtagaaaaattacactgtgttttgataatctgattaacagaagggaaaaaatcaattggtagattttgaagagagaatcaatttccttattacagaaaaagatgagagacataactaccttgtgtttgcaaattatttgcttcagtctgtgatgctttcaagagtttgagaaatagggtatttaacttctcaacttatgcctgataggatcacggtaaaagtgctccagcctaatggaagcttaaaaatgcagctcttagaattgctggatcacacttgacagtgatttgtatgtctacggcttattaaacctcagcatagagaatgtcctgatttaaaatttttcaattttattcacttggtctgatgtgaggagcagccatccttcctgttgtcttgtgtagtcgaatgtaaatttctcagccacagttaaatttctggtcaaggccaaccacactgagcgttaaggagttctttctcccttggacttctcaatcagagaattgctaacatttcacctttgactttgttctctattgacatctaaatgccatttgttattccagtagccataagcatttgccatcaagcagagcacatgccttagagtgatcaggaagaagcaatgtcagaacaaatggtaatcactctgtgctaatattctattctgttctattctgttctgttctgctctattctattcttattttattataatccttggagcatatccagctttggctagttatgcacagactcaatgcttagaaatttgctgttgtagaatttgtaaatcaggaaacggattcaataattgtggcttgaagacttgtttagtataatattcgggttccttcagttatattctacatcagtgtgttttctggtatgccacttgctttcttttatgccacaaacatctgttgctgcttattgtagatgttagattttgagccagggtataccaggacttactaaagttaattttggtaaaattgcctgcagtaagtatcatcatttttcttaaatttttttcttttgtgttttgtttttccctttttctctgatcagaagttaccttatgaatgttatacatatgtgtagattagaaaattcttataatgagtcagaagttgactataggaggattgtggaaatattgatgccttggaaaggctgaagttgcagggaaagtattaagcaagagaggcgtggtttgagaatagggattgaggtgattgacagcacgggttggaagaacaatgatgaaggagaagtagtgaggatattgatttagtaagtgaaagggcactgaaagaacgaagtcttagaatattagagaaagaattgatggaaacatgacttttaatttttttttgaatcaatcttgatgtttattttggatctaaaataaggaaccaagtataagactgctttgaaatcataatctgaacattattttaaacatttcactagcaaatcatctgctttctgtttcactatgccgttttctaactttgctaagaaattgattctgttacgtattaggacctaaattttttccataatttttaattttttaaaattaaaagcattgcgatataattcacatataagtcaccattttaaagaatataactcaataggttttagtatattcacagggttttgcaactatcaccactgtctaattccagaacatgttcgtcactccaggaagaaaactggcctttagcaatcactcaccattagcagtcactcccattcctgcttctcttcagcctttggcagtcaccagtctactttctgtctctgtagatttgtctattctggacatttcatgtaaatagaatcatacagtatgtggcctttctgactagcttctttcatttagcataatgttttcaaggttcatccatgttatagcatggcagtacctaatttctttttattgcttaatcatgagacaggagaattcccttgaccccctcatgggacttgtgatgggggtgtggcccacttactgggctgctgctgagctcacacctcttgtggaatggggaacacacaggcaaacgggtgccagggctgggacaaacgcttttgggctccagccccatggcagtgtctaggggtgtgttaaaattaatgctcttttagcagttgccatctctggacagcctcttacaccctgccctcttggtacctgagtttttgtctagcatccaggaagaatcaggtcacatggacttgaaggatgtggagattttattgagtgatggaagtggctgtcagcgggatggggagctggaaaggagatggagtggaaagaggatcttccctcatctccaaccgtccccagctgaactcctttcgacattcagttgcttcttctcttttctccttctctgctgcaatgctctgttcctctgccaatggagtttggggtttttgtgggtacaagatgtggggcatggcgggccagggtggttttggaaaaagcaacatttgagcgggaaaacgggataactcttctcatttagggctgtggtttccaggcttgcgggtggggcctttgctggggaactgccctcttctatctaatatttccctgcttctggtccatatcaataatattccattatatggacattttgtttatccattcatcagttggtggacatctgggttgattccatattttggttcttattaataatgctgctataaaaatttgtatgcaagtctttctgtgaatatttgtttacaattttactatacctaggaatggaattgttggatcatatagtaactttgtgtttaactttttgaggaactgccaaactgttttccaaattagctgtaccattttatattccaccacgcatattgggcatattatttgaaatgtaactgatttactaagaaaaaatagttttaccctttctatcttgccttttggacatcatctatactggaatgagttactgtctgatactttgaaaggccataaaattgtagagcttgagaggttctaatgaatccatctttctactggaatggaaaatccctgaagtttaggcaccttgtccattttgttcacttctgtatccactccacctgtgtcagcactgtaaatactaggtgcttagcaaattttactgaataatgaatctaatccaacccgtttgtttcgtaatgagaaaagtgatgcccagagatgtcaggtaactttctaaaggtcactaagggatttaatggtagaacaaggactagaattctggtcctgatttccttgccaaattcttgccttcaaagtcatcttgaattcactgttcttcctgaacttcatggtccattgctgacctgatacagaattttctgacagttttatagctgtgctttgggggtttattgacatttaatgagtgtttttgttcttgtgaagtcatttacatgtttactgctgaggctagcattcataacaagaaaaaaacatttaaataactgcattttacccagggaagataaattacagttgcctatcaataagtagataactttcattgctgccaagattattagattgtggaaggcaataaatttgtaccctcccttgtgagtcacttgccttaaaaaattcacaactaattatctgaaagtgagacaggttagtacaggtttgctatctactagtattcctttctttcctaatcactcttgcagatggaggaatccattttatcagcctttcctccttattctgctcttccagagtaatatatgtgtaaattaaatgtagcatagcttaagtaagcatagattaccctgtatctgaggcgttgtttttagagccacatttgcatgttaagtggagttgtgtgccatgagggataggtttatagaccggacccgtaatgaagttgagaatcattgtgcaaaagctgcagactacaggtagacattgagagcctttgaatgtggagagcgtatatttcacttccttttgacaaagactttattttataaggctttatgggaaacagtgtgttcaattacctcagttaaaactcattccagggagcagactattaaaatactacttgaaagtactgagatttccccctttttgtaacttttgatcaactgattgatacctggtatttaaaataacatgtttaaaaaagattcctgaattttgttgtatctgtgagagataccctagggaggatcataagtctactatgatcataattgtgttcctggtctagtctatccctttaatgttgggagttgagaatgggagaatataaaagaattcttttggttcaggtaaaaaagacatttttagaaagttagcatgggatagtgaggaaaaaaaaacaaaacaggcttttatttagaagatttgtgttcaaattctggctctacatctaattagttatataactttattaactttaccaaggctcactttactcatttgtaaaatgtggatgataataataaattcctaccttacaacacagctttgtatttggtgagctaatgtatgggacatatagtaggcatttaatagctgatagtgaaatctgaacctggggttcattggaccttcttaagaaaattttggtagatagatatataaatataagtatcatgtttatgtaatatatgtattcctctcccccctttatatctgcatcccatgtcttgtttccagtaggatttaactggtatgtggttgataagttaacttttaaatgtatgtaatagccagagccttttaaagttatcttaaaatgttcactgtaaagcttcgttaatagctgctgtaaatctgtttgtcaagtgctttccactctcttccagtttctgctaatgctactactattgcttactacattatccaagttggaaaccttggtatgatctttcctgctttctcttttctttgtaattctgctgtctagcaggctatttctatgcaaaactaatactgcataaaatattgtcaatgccaatgtaaggtagacagcttagcaagtacatggacttgaaacaccagagtatgctaagcagcactctatagctgtaatgtattaccctttgtcaacagatttctgagacatcaatgaaactcctaatcatgtccgtttatacgatataataccaattttacagtttttttctgcttaattctcattcttattttcgaatggtagtagtatcaatggcagacttctgtaaaactaggactgacatacttagatgatgagatcttgttattccataagcggtaggataccagatgtggtaaacaaataacctctagcagcctgaatggaaggatgtggtaggttggattattgttcagcaaatattcattccctaacctaccccactcccaatagccccccacccaacctatgagagcagtctgtttcgtcatccaattgctattggacttggtcgtgtgacttgatataaccaatggaatgttagcaaatatgccactagcaaaggcttgaaatatgcttgtgcagttggacttggtctttgcacttctattgtttgccgtgagaagaacatgcttctagtagctgctaattcaagaaggatgaaaagcactggctctggacctgatctgcagcttggtaccaagcccagtgtagtccagcctacagccaagtcccagataatgagcatatatgtgagcaaggaagatatacttgttgtatgctgctgaattttgaggtggtttgttactcagtattgtggcggtagctgacaaatacagaaggatactcatttcttttaaagaccttctttaggcactgttttggaagctgcagctttccatgtagcatcaagaactttattgttcaatggcacctattttaatgccagttttgtctctggttactggcaaaactgttcaggattgaaagctcactttaaagaaatgcttacaattcagatgggaagaagagtgctggttgaccctggctatctccacaaacctgtctgtacttggaagttgtttctaggaaaatataatggccagtggctcctttttttgttgttggatcagctagttgtatgtccttagtggtacaaagggcagtgaatacacaaagatagtatctttaattatggaaggagcctattaaaattccattttatcttaagaaataaacatgtaaaggaatctggaggaggccaaacacctctttaaaataatgattgtcttgggctaattcctttactgtgccttcagcatcattagatgccaatcctactgtgtaggttcatttgcaaacaaaactgattagagactggaggctgtgtgcatgagacctccctaaagcagaggtttcagaaacctgcacattgtttaaactggttaccctcagcactacttttatttattttctctctacatgggggggaaaaagaaggttgtttatttcaaagggtattagaacccattcttcaaaagagaataccgaaaaagagaaaaaaagatattgtgtaaaagctcagaaggttttcagaatttcccttttttgcccattgtaaacatgatctttccctttgctctgagctcccccctctggcattaatggtatatttctctttctgttactacaaacttcaaagctcccctccaagtcattttgcaaactgtaaagtaatggtgggggctgcttttatttcccagagtttgtggtgggggtggactgagaaatgtagaggaactgttggcaacatttattaacttttaatttggtgcagaaaaaatcggaaaccaagtaccatacaccattgatgttgcttcaaagatactttgagcttgtttaaccaattttttaaagcttgtgtgccggactgaaatgaggtgccttttatacagacctcaggattgtgctgtcataatagataaatccatatgtctctttgtttttgtaattaaagctttatccttcctcttttttgtcttcaatggctatctttgttctgatagagaccgattgctttattgtaagtaaactcctaactattgtgtgatattctctttaaaaagaagactggtgatgcctaatttatttagcaccatctaggaatctgattttcagtgtggcttaattttccagaaaatagtctctccccttttagcattaaagattgtattttaacatctttaatggaaattttataaaatacatttctcagatttggtccttttgtcacaatatactgagcacattcagactttttctggtgactgaaggactgtcattttgaacctggttaatcgatgctttggttgcacttttgcacactaccctttattgaatgtattgtgatacgtcagaggtcatcttgtcacatgtgaaggcacggacaacgttccatcgtgctgaaccagtcccagacttccattaaaaaaaaaatcatacttgttcactcttcataccctctgtcttttttttccttgctttttgggggtaggttatcatgtctagctattgatcgtgtctgtttcagacaagctcctcttgctaagttgctcaactattgtggtataagctgcaaaggcagagaaccaaggtggttagaattgtgtgtagaataagcgaccagaaagcactctgtggcatcatgcacatgaattctcagctatggattgtataacataaggacattttgcccctggaaatgtcccttttttcttaattctctcttccttagtttctgctattcttagtggtccaggctgccaggtaaattaggtattcttctgttaacaatggcagtcaaatgatacctaaaacacctttattgtagaattctctatcctagtcccatccatctgtatttgtgttacttaagttttagctattccatgaagatccatttctgggaaaaatgctccgttatctagtgatctgttaatttctagaagtatctaggttgagggtaaagtttttgccgtttattttgccacctagattgtgctgaatggataagtgaatgaatatgtttcttttgatactgaagcaagtgggttttttcttttattttttgtgattaaatatttggttagtttcttttttcctcttaatttgttcttacttgtcctttattccttagagccacataaggaagggcagggggaaagaatttgaattatctcagtgtttttttttttttgtttttttaaaggagatagaatttgctcttgctattcatttcaagaaattggtgatcttgcatcagccggcttgtttttgaaagatgtttttcttggcatccatgcaaactaacgatatgaactgtatcaaacccagagtggcgtgggccttccttgtactgccttctgacttcttcagctgctatgtctgtacttgccctcctatgtgccctgagctctgccctctgactgagaagatctagaatttgactgtcctctttaggccagagctatcattactcatataaatgatattctttttgagatagctttctcctttcctcttcatttggcatcaaaactaataaatgatgaaactaacttcctttccagtaattagaacctttctctttttctcttttttgtctctcttttcctgagtgaaggcagtgtggtgttaaaaaaaaaaaaaaccctaatattatccatatcttatgggatactctactggcataatacttctttactaaagcctagaaccatagacttcagttttggggacctgatcaaagaaataagacagacctatgaaataatcagcctctttaagtatcatcacatacccttcgtgtgtacgagccagtggctttcaatttgatttaatcagtgtatggttattaatgtgcactatatggaatgcactgtgttctatgcaaaaaaactccaaaaatgaaatcttcataccctccccctttattttagcttgtaggaaatgcatttcttctgttttgcttgtgtggataattactttagagtaacttatgatcttttcccatgagcttagtgtcaatttcctggaggcatataattttatataaatttacctgtttgccctgtctataaattgaggatgaactgataaaaaaaaaatacatctgagtgactatggatgggtttgtgtgggagtgtgtgaggatgggagaaacttccatgattcattaagatatattatggtcatagtaaaggctcattttaaaattttttgatttctttttaaattttgcgtgttatccaaacatgttagaggatttcattttaaagaaagtactgaaaatatttgcccaaattaatatttgtgttctactttttttctcttatagtttctcaaatttactatatttgtgttactagagtttttagatttttattctgattatggcttatgattatccaccagatgtttaagtattttaccttttgctattatttatgagagaaaaaaatggactgtaagctccctgtggtacaattttctgttcagaagaaatggaaaagtttggtggcattcattttctagctcatggtcttttcccattttcgattatctggtgatcacttactatttgctctaaacttcagactaatgctggacaatgaagaagaatgcctgtgacctcatggagctcacatctggatgggaaaacagtgctattggtttcaccactaaaattttccgtaatatttctttgttaccattttaagatcgataggatattttattatctaatcttttttccacttcacatcttttatttccccgtttttctgtgatgtttccatactgattgtaaatgactccacaagtgtgtgcatgaattcccttaagctcctctgcttcccatcatccaggcctgctgattggtatgagttcagtattgtcaagtgttccccatctgctttttgtcagtcgctatttttgcaaagtcttccttctctctaattatacaaatatgtctttttcatttttcttgtcaaagacaaattaaaaagaattagttcagtttcttagctagtttagtcttcattaattccaaaccccactccatttttagcaccatttttcttttcctagtctttgtcccgctttttggtaattttaaaagctcctcttctcttgtctgacttatttaagtagcatgaattaatttgctacctctgactcttttctataagttttagctaactctaacaagatactttttcactcttctccatatttagttcagatctgtctttgtctgtagatctttgaagagtcatttgtgaaactacattaggtgtttcttgttcattatcattttccccaagaggaattttaatcctatgtgtgttaattatttaattatcctaatgatgtctcatatggtacccctggcctcttgcacactgatggaattaatcccttatcccagggctcctcagagttcctgattctttaatgtttgtacatttatatttaaatagttcttatattagtttttaagtaactttcccctggtttttccttgccatcttgattttgtctcttatttctctaatgccctatgttctttcgatttaaatattatgacattagtttcttcctttctgttgcctccaatgggggttgttattatctaatatactctggtttcaagctttaatagccatgagaatcgtctggaatgcttgttaaaagtccagatttctgagtcttagcccagaaattctaattcatttggtttgtgaagagcctagatatgaagagccaaacatcccaagttttaatgaggtggtctactgaggcagtccactatgactaccacctgctaactgccatcctttatcttaaacgcagcagccagatttttcatctcagaacatttataaaatgcctgctctctgtaaggcactgtgttgggcactcagaatatcacagtgagcaaactggacattgttcctgatcttgcagtgcttatagtatgttgaattgttttccttatctcaaaaacttgattacctgttgcttacagatgacagtaggtcagttcattagtatattttgctgaggtgctgatagaacataagaacaatgactgggaatcaggaaatttgacttacaggtttggttttacttctgcctctgtacacgtgtgtgtttgcctatgtatgtatatgtatgtgtgtgtttcacttgtaaaatgaaggagattgggttggattaccactgttcctttcagtcagtatttgaacctcggttttggtttccatcttcaagatgttatagttgtttaaaggaaatataccatatttcatcagttctttttttttttttttttttttgagatggagtctcgctgtctcgccaggctggagtgcagtggggcgatctcggcttactgcaacctccgcctcctgggttcaagtaattctcctgcctcagcctcccaagtagctgggattacaggcccccgccaccacgcccagctaatttttgtatttttagtagagacggggtttcatcatgttggccaggatggtctggatctcttgacttcatgatctgcctgtctcagcctcccaaagtgctggggctacaggtgtgagccaccgcacccagcccatatttcatcagttctaatgtatcatcacttatcagacccctcccaacttcagagatgttaaaatgtgaaataatatgtatcatatatccatgaagtatagtgtacgtatttatgtgtgagtgtgtttgtatttgtgaggataatgataccacacaaagctaccttctgactactgacacatggttacttgggaccaaaaaagctgtatcactggtctgacactcctgaaagactcaggatttattaagaaacataaagcctgtaacacaaaagaagcaaagatgtaggaggagattatcagtctctcagcccagatgacccttcccatgttttccctggacctgcctcactgttgaattgtgtaatgtgtagagattcctaacaatgaagccatcagggagactataactcattgggtaactcttccatctatcactcagctctgacatctccaagaaaccaaactcagatgagcacattgcttattgtgagttatagcttctttattttttactttttaattcaatatattcatttaaaggcattaaaaaaataaatttagtgattacattgaataatcacttactggcaaccctctcccacccccacagggacacacagtttaaccatttctgagtcaaggccttgcataggtaacattaactactgtttacactcttcaggaagttgtcatagttcttgaacactacaatggctttcttatttctcttcatgttttcactggatctgagtcttcctgggagggacagtgacttattcagggattcagaggaaagtaaggtactggaatcaattctgcatttttgtaaaagctctcattctgttatttttcccacctttatctccacccccacccccccattacctattcaattctgtcttccttccaagtacttttagccttagaattaacttctcatgctacagttggtcatcagtgttcatgatgtgactggaaatgtcagagacatttgaaccagagcaactccatcttgggtaagggctgggtaaaataaggctcagacttactgggctgcatttccaggtggttttaagtcacaggatgtgatcagaggtcagcacaagatacaggtcataaagaccttgttgataaaataggttgcagtaaagaagctgggcaaacccactaaaaccaagatggcaatgggagtgacctctggtggtcctcactgctacactcccaccagcaatgtgacagtttacaaatgccatggcaatgcattctaacttccatagaggaagttaccctatgtggaagttaccctaaaaaggggagagatgaataatctaccccttgtttagcatataatcaagaaataaccatggaagtgggtagctatcagcccttggggcagctctgtggagtagccattctttttattcctttactttcttaataaaacttgctttcactttactctgtggactcaccctgaattatttcttgtgtgagatccaagaaccctctcttggatgtggatcaggacccctttctggtaacagaaatattttagtactattgggagattttggctgaggtcttctatttcagaagttttaacatcaatagccagtggcaaatgctaaataaatgatacagactgtaagtaccaggggagttacaggaaagtagagatcactgagttgttggaaaatgcttcaagacgggagagatatttacagcaagtaagatttggagaagtagtaccagaaagagagttaggaaggtacacggaatatgtggaaggaaggaatgtaatgaagggactagcagaaggtaggttgggactggctcatagagggcctagaaattccatctgaagattttcagttgcatattttatggagcaagggtttctaattgtctttttgccttgtttttgagacatagtctcactctgtcacccagtctggagagcagtggtgcagtctcggcttactgcagtctctgtctcccaggttcaagtgattctcatgcctcagcctcccgagtacctgggattacagatgtgtgccaccatgcctggctaatttttgtatttttttctgtagagatgtggtttcaccatgtggccaggctggtcttgagctcctggcatcaagcaattcacccacctcggcctcccaaagtgctgggattacaggcatgagccaatgtgtgccaccgtgctccgcctctagttatcttgaagaggcatttatcacttcctctaaggttccagtcatcttctaagatatatggcttgcaaatgatacagtggggctaattttgactcacactgttaagcctgtgtgtttgtgtgtggggggtgtgtgtgtgtatgtgtgcatgcacatacacgcacacatacctatgtaaatacaacatccctgctggtgcttattcctgagatgggattccttgagcagagttggggacagtgcattgctgctggctgggttctcctccagtgaacaatcctggaagactgtgaaatgaaattctgaccacttggtcattcagatctaccagtaactaatgattgacccacttacaaggcttgccataaacaatggcaaaccattagaggttttttggttagcttatttttttgtgtattatgtttgttttcatgtatgttttttaatacctgccattgatggtttgaaattattgttttagaaaggatatactgggcatagctggtgaattggaggtgataaaaacttaagtcaaattaaaaagacccttttgaaagcctagcgtgaagtgaggggaacagaataaggacaatgagaatagaaagaggtggttattagacagtagaaaggatgaattacagaatgattggtgggataatttattcatttattaaacatttattgaaatttattacactgtggagatttaaagctgaaaaagttggactccacttcagagagcccccaagagcgggcagtctgacaagttaagtagtgatggtatgctgtgcttaaggatgaagcaggctgaaacaccctcgaggcatgaagtgatgcctcaggctagtggggatggggaatggacaagagaagagcttgtggggtggtatttgagcctatttataagcaaaaagaaagaacctagtagagaaaaagagatttacatatgatctgggagagagaagggatgattaataaagtgagttatggaggaggtgggagtagatggattttgaccacaaggagaagggatttgaaggaatcgaagatttgctggatactgaagaaaggaatgaatcaaagatgaccaaggaatcagttttgtgtgttttgtgtgactgaaagaatggtggtcccatttgtaataaagagaagatgaatctgtttttaaatacatttgagtttgagataatgggagtccaataggaggcttgtactgaaggttgataaggttgacctgtgaaagatgagggtgaacaccattgattacagaggagtgtaatgacaatgtaatctacaatacaaagtgcctctctgcaggacttgggtgtttgtgaagtagtggagtgagaagccccagttgctgtgacgggagccagggagtgagatttacaacagtttatttccctgtaggggtggtgttatagctgctttttcttcacatcttcttccgtagtcgcatttgtccaggatctcaggcacaggcatggttgtggaggctagacctcacatgggtaatagaagcactatcagacacagaaatgtccttttcaaggctggggttgggttccgaggagaccctagcaggagaggcccagggcaaggggaaagatgaacagttgacacacctgcctcttggtaaagtctcttgcgcagtacagaatgtgggcccatctctgctttctccaccagagagcaactggatagccttggatggagtcagaaatcagcctgtagatctgtgaaatgcctaatagttgtccctgagtctattgtcacttcagtctggtggtagaaactcaaataccaaaaactcctcagtgaccttccccatggtcaagcaccagggtgtagaatccagcagatgctttgggtgagtgtttgtctctgcagctctacagattcacttccatgcaggttgtcttgacctcctgggggcatcagtgggtggtgtgagtggcctttatcaaaggttctcccattttcctggctgtgatgaggagtcagaattagttacagtatctaaggaccccagagctccatctttctctctcaaagttatattcccagaaaggtcatttgggaaacaccccctctcaaaggggcatgtagtgcttaagtgttggcttctatacacaaaaagctcaaactgtataagaagcacctgtgttggaagatgatgcccagatgaggaaagcttggagtgtggcctttattttggccattatgccaggcaggaccagggacaactgacagaccgcaggaactatgtagttcagggaattaggagcatttcctattctcttgggtcaggagacctgtgtgtactgatatcctggcccaaaaggtatgctgaaaaccaggtcctcataagagtggagtgtagctcactttctgattgtgcatagccatgggttcagtctgagtgtttcttcaggagaagccaaattataaagtcagcctagctgaccagaggaatttcagtccaaaggggcaagagagattctgaatgagagccagcagaatggaccaaggagaccagcaaatgaagaatcagagcacagggtagcaagtggggcttggcgttttctccaggctctttattcttcctgaatctccctccttccatatgcatcaatttggacatatacttagctaggtggagactaacatttattgaggattgactttgtaacaggtaacgttttatgtgttggggccacagcagtgaacaagatagaacaagatagacagtcttacaaccccctgcttcctgccccacggagcttatgtcttagtgggcatgtggagacggtaaactacacacatagggtaattccttactgatgacttcctatgaaaaagatacaattagagaaacagcactgtagggtgtgatttgttctggaggtgttaaagctagggtggtcagcaagccttctttgaagagatggcatttgggttgagtcctgagtgaggagaagaagagtgccacattaagattgagggaacggagaagaaaattgggtcttgtattttggctatgttaaatgtgggatgcctgtgggacatgagatcatgagcaggttggtcggtggtgtcagcttgtcggtgttcaggtcagaggtctgggatgacagattgcagggccttaccagatagattgtattttaaagtcacaggactggatgagatggcgttttcacacttttttggagctctttttaatcatgtatatttgcctagagattaacaacacgtaagattcttattttaaatagaacagattttttgttgaatgaggcagaactttgggggcatgaatatgattttgtgtgtgtatgtttttttcatgtttctggaccgtatgtgtactgattgacaagttcctcctgtcatgtacttgatggctaaaagacagcaattctcaaagttttcagcttctatcctgacaaattgaaaattttctgaactcattatagaatctactcaagtgtacatatgcagtcataggtttctgatcttcagatttattaagagtccctgaaatctttcttagtaaatattgtatttgaaagagatggctggaacgtgtgtcaagtgctttatagttaacacacatctgaggttccaaaacctgtgtgaggtaggaagatgttgtactctttcctttgcagttgtgtagggtaggactttggaatataaaatgactctgacgggaaaacacaactcaaaattgttaggaccaatcttagaatccaaggctttgattcatatgccagcgtctttccactacttcagtggttctcagccttggccccatgttagattcatcttgggaagttacaaaataaaataaaacaaaaagcccagcaattgtgcttccacctcagaggcctggacagttactacaaacaaacaaacaaacaaacaaacaaataaatcaacctctcctggtaattctaatgtgcagcagtagctgtgagtctctgccctattccacattgccttaccaggagctgcgttatctggtgtgttgttaccctgtaatcccagcagtttggaaggcggaggtgggaggattgcttgagcccaggagtttaagaacagcctgggcaacatagcaagaccccatctctacaaaaaatacacagaaaaattagccaggcatggtggcgcatgcctgcagtcccagctactcaaaagtctgaggtgggagactcaactgagcccagaaggtcgagattgtagtgagccgagattataatactgcacttcagcctgggtgacagaacggaaccctgtcttaaaaaaaaaaaaaaaagatgactgagccaaccaggatacttctaatgaccttgttaaggaagatctcttttctttctttaagtctcaagcagagtccttcctctttcttgtgactgtttctctttctggttgtgagtttgcaggtatcccacattctttctctggtatcagtattctctgtgcttgtacatgagaccagtgaagctggactaacccctttatttccacagcctaatttaattacaaccaaaacctctcaataaaactgttttcttatttacgagggagactttattccattttttggattgagagagatgctttttatttttcgccctactctgtgctgtaaaattatctctggagatttaattgtgtttttgaatggttattcctagtttttaacgcagggctgtctgtaaaatgaagatagcttcttctctagtttgctcactgttagctagtgaaaacatgccagcttataacttggcaagattactctgagctactcagggcacggtcctcagtccagcgacctgtctgctcactattacccgtccttgatgaaataagtacagaaatcgagatgaagccattagaaactcctagtgatttggaaaacgtaactttagattttgttcatctttgtctttttaaaaaatatacttttaatgttttataaagtatcaaaaactgataatcctcataggtaatttcagaagccatggactggatctctgaatccagtagtcactgagaggactaataactaccgctgcttttttcacgagtagaaataatattcttgatttgcaactattttgaggatgtagggtaacacagtgtaagtggtaaatttcaagttctggcactgggcattagcctagagcttagctttaatctacaatatgcatttctcaacctgcttctgatactttgccacctgtcctctctaggctgcagtttacatttacagatgtttctataaacctttgaagactcaggaacattttggttggtttttaaccataagtgaaataataaaggggatagatttcagtttgctttggcagctttagttttcagttttgagtgattctgaccaagtcaactccacagttcatcattttatagtcacttgtattttggctgtacaccagtatgttctataaaatacatcattttctaaagtacattgaggcatgaaaacatcagtgttaatccttttctgttacacattgttttaggcaatcaaagacttctgcttgctttttcctaactaggatatatagatcttcttacatatgagaaatgaacattgcttcactctcttgtcttctgtagagtctaccaggcaagtgctccactctgtttttgtatattattattcttactgtaagaataatgcatgcttattatagaaaatttggaaaatacagaaaaatgaaagaggagatttaacttttttatattcctagtacttagagagttcacatttttatgtatttccttcttcaaattttgcttcattaaaaattataaaattttcaacatattgggagtacaaaattctatgtgcttatttaaataagcttttttctgtttatcaataaatgtagatatgtatattataaaaatattaagaaaatagagaaaacttataaagaagatttaaaaatcacccagaatcctttatcccagggataatttttaaccttcatttatatttacttactttttttattggattcatatcataattatttttaagtgtacctaatacaggcattgtcacaggttatggatgagagaagagttaataaaaaaactaatgactcaagtcattcagtttgagtttcaaagatgtgaaaaattatttctgaagttcctaagcaaaaaatgtctattatgttgtgatatgtaattcttccctttagagagaaagatgtactttttatttagtagttgtcatggaatattgtcccaaatgtgtttaaaatagttgagccactattagtaaagaaagaacaacactgctgttgtcttgggtgttcaactaaaatattgtgactgtgggttaaaaagtggctctaggtgagggacagagcaggaaaaagcacagtgtagtgaagcatttctgggtctccttttgcccttgggctgtggagtgtgccccactgcactcagtctagttagataactaatactggagctgggaaaccccaccagtcctatatattgtgacttccttatgctttgaattctaatttttactcattcttcatatgtcttttttttttgagacatggtcttgctctgtcacccagactggaatacagtggtgcgatcatggcttactgcagccttgacctcctgggcttaagcaatcctctcacctcagctaccttagcagctaggaccacagacacacaccaccatgcctgtctaatttttaattaatttatttatttttgtagagacagggtctcactatgttgcccaggctggtctcaaactcctggcctcaagtgatcttgccacttcacccatccccaagtgctgtggttataggcatgaggcaccatgcccaacctagagcaggtcttaagcctctttcctccgcttatggtggatagagttgtatcaccccaaaagttatgttcaaatcctggcgtctggtatatgtgaatgtgacctcatttagagatagggtctttgcagatgcagtcaaattaaggtgaggtcatactgaattaaattgggtcccaatctaatgattagtgaccttataggaagatggaaatttaggccaggcgtggtggctcacacctgtaatcccagctctttgggaggccgaggtgggtggatcacttgaggtcaagagttcgagaccagcctggccaacatggtgaaaccccatctctactaaaaatacaaaaattatctgggtgtggtggcacatgcctgtaatcccagctattcagtaggaggctgaggcattagaatcgcttgaatctgggaggtggagtttgcagtgagctgagatcacaccagtgcactccagcctgggtgacagtgagactctgtctcaaaaataaataaataaataaaaagaatatgggaatttggttacagagaagacacacaaggaatgccatgtaatgatggaggcagagattagagtaaaacttgtacatgccgtagaacgccaaggattgctggctaccaccagaagctaggaaaaggcaaggaagactcctcccctagagaccccagagggagggtgactctgccaacaccttgatttaagatctgcagcttctagaactgcaagagaatacatttctattgttttaagccacccagtatgtggtcatttgttactgtagccctgggaaactaacacacctctcaagaacacctatgttctgaactgtctcaagtttttttctgagctttcttaaatgcaaggataatttcttttaatacactgttttttctttaaaaatctatcaacattgctccttagtcttctcacatttagtgttacaggaagtatatagctatcgtgatttttgttctttttgtaagttccttattctatctgtatctagataagtgttatttcattgttttccctggaaaatgcggtaaactcttttgtcttactcatggtgtttttttctgtaaagcaagaaaatacatttgtgtgtgtgtgtgtgtgtgtgtgtgtacatctctttttacaaacattatttctgtaatacttggattgaatccctgttctgaaatttttatgtctatcatctctcctccagcttttcaatctttattattgctgtttttcccatctatatttgggagtatttctcaatttgttttttgcatctctgattttattttatggaatatcaattgttagtatcctagttcctttattatggctttctcttctgaagttgcagcattttaaccttccttacaattcttctctttcccttgtcccctctttaaaaaaaatcttatcctggtatcttttccttccagcctgttttctctttaaagatttcttttactgttgcaagaagctatgtgttcttgtgtgctactgaggatgccaggatttactgaaaattttttgtttctagtttttgggttattattattttttttttgagacagagtcttgccctgttgcccaggctggagcacagtgcagctcactgcagtctcaaactcttcggctcaagcaatcctcctgcctcaggctccttgagtagttgggactacaggggtgtgtcaccacacccatttaatttttattttttgtagagatggggttttgctttcttgcccagtctgatcttgaactcctgtcctcaagtgatcctcctgttttggcctcccaaagtactgggattacaggcatgagccaccgtgccaggcctctaatttcttgaaatgtatcttttcctcactttttcttttccctgtttactcattctcaaatgagaggaaatctacctagaccttgtgtctgctgactgttggaatatgaagactgccttttagcctattatttaaacatatgtgctaatgaaatcattttctgagttttactgctagtaatcaatttcatgtacacatatgccagctcaactccttgttaccatataatgcaaatctgtttttctgagatggaacttcaacctgtatcactatctggcttcctgaaacacataaaataataaatgaattactaaggtaaacataaatcgttttccatgattatttttgtatttacagtattttacaaaagatgattctctttgtcagaattccattgttagtcctctccacttcttagtagattgtgtaattttaagtactatttctaatggatgcaggacaagaagtgttcaggtgggatggtgagttcgggagggccagctgcctctcaggccagcaactatgtggtcgtgaacggttgctcactttggtttggagaatacagacagtgcaagagtgggaaaggctttttgtacctacttccaagtaagcagattactttccttccactgatgcaacacaaaccattcagtatacgtgttaactctcttccgttgaccttgtatttagtggagattgtttaaagattctggctgtattgtgtgtgggtccagatttttttttggcattgtgaagcttttttttttttaaatcttttgcattcatagatatttgagtgggtacgtgggagagatcgtgttgggtattaccagacaaatatcattttaatttggaagtctgacatttgttcctcatttctacttgtaggtttcctgttgacttgtaatttagggcagtatcctcttttgatcttattttctttagctctaaatgggatttcaaatttaaatgtgctttggttagcagattaacataaacgtttattaattcagataatttactaatattttatttgttaatatgagaaaattatttctcttgtattcctgaatgaatttttttctttcatttgtttgatggactcagtacttaaaattttttactttctcttctatttgtatattttcctctctcatccccaggcatattttatttaaaaaccttgagtcagagaaagagttacacggacttatttggggatttgagctgatagccacccatagttcacccagctgaactgccttcctaggaacacgatgaaatggattctcaattctgatgtttcttcactaaggtctccagcatgatactagtttccagtgtgttggtagggtagacctgctcagcccatagctaattgatatgatggaaagaggtcaatgattttgagttggaaacacagctgtatgtcaggataattacagagaaacctgttgccttgctattacctttttaaaaaaaatattttaattgtagtaaaaaacataaaatttaccatcttaaccatttttaattgtacggttcagtagtgttaactatattcacattagtgttaccttttattgcctttacctttgaaagctttttgtcctactcagaagagctgaggctttgataattagcctgatgcactgtgaattgctaagagtccaacttttttcatggaaggaaccgaagacaaaatgagagaataaaagcagagaggagggaagaggaatacagcttagattagaaatggtccctacagcagcattattagtaaatatctcattttctggattccaagaccctaagaagtataagattaggaaaaaaaagtaaaactaccttaaatgtacacatctatcataagataactgttgatttttggatatgtgaaaaaatgtgagcaaatgtgtaccttagaatctgagaaataccaggaagtctcccacatggtgatgagaagcagcaaatgttgtgtctgaggaggaagttggtgaccagagtagaacagtgccacagcacaggcatcaagaagggtcacaagccatctacccccaatagcctctgccatcctcatgctccagtcaacctttagctctctgtgcatctcgtatgtccagaatagctaatgctcatccattctagatagcagttttattttttctataaatgttatttttaactaagttgtttgattctctactattatggattgttgagagcccctgacagcctgacaaatgtaccctgtggaacatgtgcttagcagtgatgacagaatagccaacagaatgttacatatgtaaactactcagctttgtgttcactctgggcaaatgaacaacatatggacatttgaaatatatgtgtgttcaaaattctgtcatgtgaggttagttgtggaattcgatagtccattttgtatttgttccatgtgaaaagggccttataatggcatcaccagttgttcattaatctcctttcccttatgtaaagtctccttttgtcctccctctgccagtctgtaagttttatcatgacatttatacatggaatggattgttaccttttctgggaggagaataaaccataaatatgaacgaggcattaaaagagcttaacataaatcactaagaaaaatctgtagactgtgagaatataaaaatcgctgtgaattataaataatacagcaaggttatataaatcattttatgtaaaggcagacatatatttctacttctcacagtaaggcccagtgattttaatatcattggttggccagcgtctatagtaggaatataggcatggaatatagtagaaagttccatagtgaaaattctgggagatcattggtagcatggaacagtgatacttactttctgttggagattgcatttgctttatattgttatcaaagtatcaaaagaaatcttacattttctctctatatttgctcttggataatagcacgcagatctgtaatcatttaaagaatgaaaatgtgtattgaaaaatttaaacattttgttttaacttaattaaactgtcatttctctttaattagtaattaactttcagactacttttctagaaagtatccagagaatctccttaattgttttttttcctattgtatctactttaacaatattttctagagaaaattaatcataaacatataactttatgtaagtttgcataagcttatgcataccttttaagcatgtattaaagagagtattctttttactaaagttatcgtctcttggttaattacttctgttttaataaacagattattctttgctgaagaaagttttccttataatatgtaactcttacacagttcagaattatatgttatatgttaagtgcataactttattgtgacagctagatgattttctttgtatataaaaaatgcttcattcatgtcactggaattaagtcacctctatacataatacaagagataaagaagaagtgtaagacacaatattgttcttagattgcttcctagttgagatcaaactaatataattttaacagcactggcatttcaagacaatttatgattaagttttaaattctgtgattcagattgcttttaattgtcaatcttaaagaaaattaaagacatgctactattacagtttcacccctactcacacataactagactgaaaacgttataaatattcagtttccagtagataaggaaatcttttccttaattcatttctgaaaggacatctttttcatactaaaagaaccttttgtttagtattatattttaaataatttctccaacactgctttcatttattttatttattttattttattgagacaaagtcttactgtgttgcccaggttggggtgcaatggtgtgatcttggctcactgcagccattgcctcctggcgaagcgattcttgtgcctcagcctcccaagtagctgggattacagttgtgcgccaccatgcctggctggtttttgtatttttaatagagatggggtttcgccatgttgtccatgcaggtctcatactcctggcctcaagtgatctgccctccttggcttcccaaagtgctgggattataggcgtgagccaccacgcctgaccactgccttcatttcttctgaggagtagctttgtttcttgttaggccaaagtttatgaaacaaaatttcttccttgctaataatagaacttatttctaagatggcaatatgtgattacagtagtcctcccttatccgtgtgggatatgtgccaggacccccagtggaggcctgaaactaaagatagtacagaaccactctatatactatgattaagttataggccagacacagtggcacctgtctgtaatcccagcactttgggatgccgaggcaggtggatcacttgagctctggagttcaagacaagcctgagcaacgtggtgaaaacctatctctacaaaaaatataaaaattagccatgtatcgtggtcacagctacttgggaggctgaggcgggaggattgcttgagctggggaggttgaggctgcagtgagtcaagattttgccattgcactccagctgggcaacagagtgagaccctgtctccaaaaaatatatataaaataaataaaaagtttaagttataaattagagtgagaaattaacaacaataactaataatagaacaatgatagcaatatactgtagtgaaagttatgtgagttatactctttcttaagatatttgaggaaggggtgaagtgggccagtacaagatttcatcacattactcagagcagcatgcaattaaaaacttattaattatttctgtaatttttcatttaatttttttgaactgtggttgactatgggtgactaaaaccgtggaaagcaaaaccatgggcccaggggttaggggaggtggggatgggactgctgtattatttagtagtattattttcttatcaaattttatctgacaaagtttaggaataccaccatctagattttaatcgtagattttcagttaaaatgtcatggttgatatatgagacaaaataagtttattttctagatttgttacttgtagaacctgtttattatagagagttctaggcttctttgaaagctgttctagagttgataaatctgaaaattcaagtggtaggatgaaccaatatcatggataaagctgagctaatggttgtccaatgaataagtgctgactagagctttaaaactgcatatataatatgcataattggcagtccatagatttatgggttttaagttactgctattttgacttaaagattgaacgatctatctgtagtgctagtgatgtttcaaacatcaaaagtaacagaacttcttgcaacataagcagtgcaactcttgccatgtctattgtatcccaaatcatacacctttattatttattaactgagaattattgcaataggtttaccctctgagaaaataaattataaggaataaattatgtgagctgtttgtctccttccaccttggaataagccagaatgtctttggttgatatgcttcattctgtaatcaatatacgtgtattctgcttttattcatggaggctattttgtaaagataagtacatttttatcagttgaaggtaaatgcaaaggaggtgaaagcacctctattccagccattatcattatccattatcattaatgatcctaatttcttcttgcaagttactgtgactgaatcctagaatcactgtatttatagggatcaccagattctagagaggtcaccatgtggctggaaaatatttgggttttagttttatgtgcccagaagaaagaatggctgcaccaaggtcaacaaaatgggcaataattatatctccactgtgtgaaagtgccacagtatcaggaatcgtaaactttgttgcctttatggagcacactaccataattcacattcatgcgatcatatcattgaattggcttaggagggagaaaacttgagatggaactcccctggtattttggtaaataacagtaagccacattctgtactatctaatcaatgtctgatatgagaaaacttaggaaacatcatgaattgaactctgcaaactcccctgaatggtgtggataatcatcttgaacttgaaggcaggtgtaccttcccaagttctctgagctcatttttgggctgcagctcctgccagtatggaatcaggtatcacagagcccaggatgaaggacatgataggtggtttggagaattgagtcactccacagatcacctaggtgacgaagatacttgtggtgtgtagcacacagaaagcactcataaatgctgtttaagctaataaaggaaattacaggaataggccatagaatttgaagaacacagataacacttcaggataattttatttgcaggattatttgtataagccagcagagaaactaaatgtagttcaatggaatggaagaccactgaagaacactgagagctccttcagagcataaactatcttaatcatcttttcgtgggcaatacctaacatagtgccctgcattcaataaatgctcgtcgaatgaacagaaactttagtgaaacgttaatatttgtgttgggccttgaaaggtggttgaatttgatttagtgaagggaaatgacatggcttttcagaatagtaggactcaatgaataaaggcacagatgttggaatgagcttacttaattttgtgagacacaggagaggtcagtctgatgagaggcccgtggtgtatgttgtggtggtaatggttgataagaggttgttattgattgaacacacacaaaaagactcagtgcaagcttctttggggaaatacaaagggatgagacatttttgtactgagaaattctgtctcacagactagtctcataactcctgatcaatagccttactataggctgttgatcttgaaagggcaccagcaagaagcaagtgcagtatatagctcagcacacccatcttccttaggtagctcgccatattgagtgggatcattttctcaattaggttgcgtatcaaaatttaatacttgttggattgaatcagatttaaaactctgaaatgctattcttaggaagagggaacctttctccttagagttggtgtatcccattatccttgagaggcaaccagggactctgccggaaggacttcacaatctggcagagacattttctgaaaataatgatttaaaaattcttcccttctctgcttcctcttcttttttcacctttaattgaataaccattatattgtattactttttcacttatggatttctttaaaccttaggtattttggttagttctgtggccaaatttaatcatcatagtacagtagtaggtatagcttcagtaataatgctaacaatgtatgcttttcttctaaagtgtgctgttggtacttgaatttagcagacaccgaatttttctcagacttttagaagaaataaaagaaggaagaattagaagtataatcagagaccaatagtggggttgacagaaggggtgtttttcttaataaatgtatacctaaagaaaagttatttttactggctagatatcacactacaaatattttctgactttgagttctgtagttattttgtctagaccactacgcagctattcatctcattcattattgcacttattggttgttttacctagctcctctgaagctggagaatctgagattaagtattagagctggaataaggacctgactctgggggttgggattgtcatttatcctattgcaggatgcaagccctcgcaaattttgtgaagtgcactccaaagacatggttttgctttcaactgtgatgacactataattgatcaagtatattctttcaaagaatcataaattcttattggagtttgaggagatgtcatattcatttgtcaacatgtcactccagggacacaggtgcagcaaatttatggaggaagcaccttgtgtttctcctgagtcacataaatatgaagcagaattgattgaaaacgtgtggttttagattactcctcaggtggagagcaattaagatctctctgtaaaggcatttcactctgcttctcaggttttcttgtagcataggcagagatcaggtctgaggggacaccagagaaatttttgaagacctgatggtgtcttctcagaaaagaatactaagacatttctctggcagagagaatattgcacatttttagtcaagtgcatgattaactttgacatttggaaatggaacttcacgtaaaaataagcatggtacttctgcatgtttaattaagatgtttagttcttgtcaaggctgatagccctccctcccacccccacacccccgccctgtgaagggcaatatattctcaacttctgaaatttcagaaacctgtacttaacctttaattgtcactccatttacatggaaatctgattaacaacttttaaagttcatgagctcctggtaaatgcaattaagacctttttggagtttgttattaagagctggcatttaaagaagactaggccctggctactgttgctgtcttctctgtagcaggatgtcttaagcaattagcagagaacatgaggtacatgaattgtatggtattgcttctgcgttaacatggttggtatttaaatagcatgctgtcttttttcttttctgtggcttgctttatggtgtgagcttgttactgaatggtagggtagagctgagaataattaggtagagctgtggtggttttcataagtaccgagttaggcacagttcctcatcccattggatgttctctagttatgtttacaaatgctcactctcatgtcatatggagtcaaggctaatcctactgtgatgaatttattgtatccatctcctggctgtggttgtctttttgagagttaaaattaaaagatgtagttattggagagaaatgatccaggtatacaattaatttctgatatcaggcatgtgagctgttcagccattgcccttgcctcatgggggcagaagtgggggtgaagtttgttggggcagacatgcgtagtataatttacaaactgagatgtgctgtgataaatggaaaatggggagtaaatagttgaaagacaggatcttatcggatcatatgctgccaatcatacagtgtgattttcatttactgatagaattgggctgtttgatggatgtatataatgcatttcttcggtactttatgtatgcaggacactgtgcttattagaaattgaggaatgatgagaaaaataatgaaatgataaatcaacagacatatcatttaaatacattgcatatgattgtgctattaaagtatacttgaatctacatatttctgtcctctttgaaatttttatgagtatatattgcttttaaataaaagatcaaaataaagaattatttgggaaaaaagaaataggaaagccaatgcaaaagaattaaattggatgccagaaataccagtgaaatagttctccatttttgtacactagagcagtggtccccaaccttttttggcatcagggaccagtttcatggaagagagtttttccatgtatggagggtggctggtgatggttttggaatgaaactgttccacctcacatcatcagatattagttagattctcgtaaggagcacacgacctagatccctcgcatgtgcagttcacagtagggttcacactcctgtgaaaatctaatgctgctgacgggaggtggagctcaggtgataatgcttgctcccctgccgctcacctgctgtgtggcctggttcctaacaggccatgggctggtgctggtaacaggccacagaccagtaactctagtgcacaggaacccttgcgctagaattttcatatttactgtaaacttacttaaaccagcagtgcagttcatttgattaaccttttaaattttaggctatcctcaagtgtagtgcgtaaataaaatagtttaattccatgttttgaattaacacataacattcagtataagtaatgtataataatcaaatacctattgtagatgtggaaatttttttttggcaacaaaactgataaaatagtattactttttgtttaaccaagctgtcgacaggtatttttcattagtttagtagcttgctcaagggacacacacacccacccacacacacaccatcaccttcagacagaagaattttccttatttcatagacagaatcttgtagatgcaagagttggcgaagtcaagaaattggtgatattaagttgttctttcagtcataaagcattttaataagatacttcagtggaaatatcattagacatgaattttgtctaatacatgctggtattagataaaatgccttctgctcaagtcgtgttgggaggtgaagagagaaatacaggaaaagttaaatatccagcagtgtatgattaattgccaagtccaaataatcatctgtgggtcctctaggaatttaaaagataactttagatagattggtcagagaaggttttgcgcatgggttagaggctgaactggtccttgaaagaaggctagaatttaggtattttggaaagatcattttagatagggataatatgcatatattcagaacagtgagcaccttactgaatttaaccacattctgaggaggctgcgatgaattcggttgagatgttctttgtggactccttaaagaacagaaccactgtatttgtctctgcattctggtgccttgtactctcagtgcttccaaacccccttatctcctggtctttacaatgttccccttaaattccaatgagaaggtatgtaacacagttcctggcacttagtaattacaaagtaaatgctggttgaatctgaatttgcaattgttatctctaaaaattctattttgaatgaactataggcaaatatttttttataagtgtgacaatatttacatattacagataaacaatataaaatcatctttagtaactgaactgctaattgaaaatgctgggtcttagccacttaattgagtaaactgtctccagagagtaatttgggtcttttccaagatgcattaactctttcaggtcgttagggtggcacttatctcattggagcagaaatgtaataaatggtattcctataatgtaagtaaattaatgtacctcaaaaagcctgaagtttcaccatgggtgttgtagttgtactccaaggagctcatctgtgaatgtgaaacagcaataagtagctgctgtttggagcatcttactttcaatttaggtaacttaagacattgtgcctagatgttgacagagatacaaagaaaagacctggctgacaggcggcagagaaggcaaataactgctaaatgaaatccttgagagatacaaactgctgtatgggttttaattagagtgagatatcatagttgacagtcgagatagatggtaatctcccagaagacaggcatcatggcttttttacacaatatgcttattcatgtttattctcagtatatagacatgtataagtataaatattaatatgaacaaatatatttgtaaatatgagttgaataaattgtaaacatattttacaattttcatatgtgtgctttttttccttgtgagaatatgaaatattaatgtctggcattgatctaaagtgactatagtaagtaggtggaaaccagaaaaaacacacggcatcttttagagatatatgctactcacaggttccctgtaacctcaacttgagtgtcagcctactggtgggggatattgacctttagctagaaaagaatataagaatgatttattctacccaccagcatgttacagatttacatctgatgggaagatagaggcacatagttgtcatcgtaagaccaaggggaagtgacataaaaagaccaatgcaaaaagaactttcaaaagaagaaggtagagataacagctccatgagaagataaaacttcaaagctataagcccctccctctgtttcctcatgcatggggttggcttcatctccatgcatgtaactctgattagtaacatctgaatggaggaaaagtagtttgctaagatccattaaagtctacttagattcactttcttgatctcataccccaagctttaaaaaaattttttatatttttccctggtacctgatgtacagctaacattccccatacttgataaatggaagagtagttaatggcaggaaaaaaaattagataaatttagacatgatggaaagcctttgggagttatttaagaaacaggaaataaaactttagtttaatcaactggtaatgatataaaaagaaccaataggaactcatcctatagaggttgattggggctgtgttgtgagaggcgctgaataataataagatagaggtttatttattttgaaggcatggaggaagccattgaaggacttgtcagaggaatgaaaacattgggtttaatctggtagcaggttgtgggatagactgtcatgagatgcatgtggcaggatatggccggtgggagactgttttaataacctgcatgaaagataatgaggacctgatttagaaagatgagtatgggaatgaaaatatttagaagagggactggacatgaagtgtgtagtattaaatctataggatttggcaggtgatttggagaacaagactgagaagagccacaactaactacacattttgatcccaggtgatcagaagaatgatgacattaaggagctcccccgctttggtgcccttcctccctttgaggagaggtggtaatagagagtttacctggtcagtctgagtttgttggacccatgttttagcatttcctaaacatctgctgcattgttttgacctgcttactgtgatatggatgtgagaacccagacattcttacaagcaatggcagtgtatctttggagcttgagagaaagtatgatgtaagagggataattgggaatcattcaaaatgtagaaataataaaaatggaagagagcaggagcaagggttaggatattttacttcctaattgcattttacagcctaactactaatacttaagtaatagtcttaagtattagtgttagttcttacagcctaactactaatactcaagtagttaggttgtaaaatacagtaatcaaactcattgaagtgaaagaaaacattccaaaagtttagagaatgagtattagcagaagcctggatttagtaattgagatctttattgtagcgcaaaggggaagaaggaagaaggagaagaatgataactttgaggagatgatgaagatatacagataatttcatttacccattcattcactcacttacacttataaagtgattgctgtgcttcaggcagtgttctaagtggaatactcatttgaccctgatgatagtactagcaaatagataatattatttctgttttacagatgaaggaactgaggttctgaggcacagagaggtaatatcatagatatatacttactggaatatattagaaaagaaacagatttctgagccttatcctgatagataataatagtctgttatgtactaagcattttgtatgcgttattaaaaaaattctcatttaattctatgaagtagttctttttctgtttccaacttttaagttcaagggtacatttgcaggatgtgcaggtttgttacataggtaaacgtgtgcttctatgaagtagttctattattatcttttattattatttttgtttcacagatgagggaagtgaggcttagaaagattaagtaacttgaccaaggtcacataactagtaagtagtagagttgatttcaagcacagactttctgcgtttttatatgactctctcattttgtagttctaaggcaggcacatgaatttctattttaaaggagttctccaagtgattcctatgtgcagaccagtcttcccagaatcttagcacaaactgagaaggaagaggtctgtatttttttggaggagataaaacattgtggacagagagaactcagagttggtgaccttatagatggagtatttcctaaggacacagaatcctaaagaatagtagagtggaggttatcggaatcaaggagactgagaaagactctgtgatgatagaaggagtcagtatattatgatgaaacatactagtcttaaaacagagtaaaattgtgttagttaattagttaattacagaattaattaacacaaccagtagctgaagttttttttttttgttggttgggttggtttttttttttttttttttttttttggagttagggtctcactctgtcacccagactggagtgcagtagtgcagtcatagctcactgtagtctcgaactcctgggctcaagggatcttcctaggtcagcctcccaagaggctgggactacaggcacatgcatgcctggctaatttttaatttttttttggtagagacacggcctcactgctgttacccaggctggtcttgaattcctggcctcaagcaatcctcccaccttggcctcacaaagtgttaggattataggcatgtgccactgcacccagcctgaagtttttgtaatggtgtaagataattctagagtttggtagtcaaagttgaaaagaaaaggggagaaagcaatgtaaataggtagaatgaactttaaaatatgtttaaatgaaatggacagagaatatattgaagctatagttaggaatatacttttggatgttgagaccatttttgtgccatcccctagcattgtctcttttatttgtctttgttttttaagagtgaaagtagaaataacaaactatcagaataccatgagatccaaaatacatggaggaaaaattgactgaaaggagtagtggaaaattcagtgattatggttggtgattttttaaataatgaatacccttttttgataattaatagaacaactagaagaaaatacagagaagacttgagcaacactattaaccaccctgatttaaactgacatgtatggtacactcaacaccatcagaattcagatgatctcaaggtcatatagaatattctccatgtgagtctatatgctagatcatcaagtaagtctcaatacatttaaaagaattgaaatcacataaagtatatcctctgaccgcaacagaattaaacaaaaaaagggaagaaatttggaggtccccaaatatttggaaataagacaacaaacttctgaatataccatgggtaacagaagaaagacctaaataatcatatgttttcatcccaagagctagaaaaaggagaaaactcggccgggggcagtggctcacacctgtaatcccagcactttgggaggctgaggtgggtggatcaccagaggtcaggagttgaagatcagcctggccaccatggtgaaaccctgtccctactaaaaatacaaaaaattagctgggcttggtggtgggcgtctgtaatcccaactactcaggaggttgaggcaggagaatcacttgaacccaggaagtggaggttgcagtgagctgagatcatgccattgtactccagcctgggcaacaagagtgaaattctgtctaaaaaaaaaaaatggagaaaactcaaagccaaagcaagcagaggttaggaaataataaaggtaaagtgataatcaatgaaataaaaatcaggataactgtaggaaaaaaaagtggaaccaaatagaggtcttttgaaaagatcaaaaattgatatatctttaagtagaccaaccaattaaaaaagagaagtctaaagaataccaaaagagagaagtctaaagaataccaaaatcaggaaatgaaagaggagatataactacaggctctacagaaattaaaaggattctgagactactatgatatgccaatcagacgatgtagatgaaacagaccaatttctacaaagacacaaagtaccaaaactgactcaagaagaaacagaaaatctgaattgtcctataacaaataaattagtaattaaaaattttcctgcacatacataattcacacaaatattctgtcaaacatttaaagatgaaataataccagtcctttgcaaactctttcagaaaatagagaaacagtttccaatgcatcctactaggccagtattaccctgataacaaagccaaagtattatagaaaactgtagagcagccttacaaacataagtgtaataatgttgaacaaaatattagcaaattgaatgtatcgacatataaactgtattataccatgattcattgggatttattttaaaagtcaatgtattaccataaaataaagaaccaaagtcacataatcatctcaatagatatagaaaagcacttgacctccattgattatttatcaaaaaaggaaacatactcaacctaataaaaggcacttgtgagaaacccgcaactagcatcatcaaggaactttttgacctaatgcaaatttattaatttatagatcatggaaataccatcaatcttaacctattcacattatgtatttcaagttcacgggcgtatattccaaacaaaatttattgtcgccatgtgctatgaaacccatttttcatgcattcttaattattgtttatagaaccataatttttaaaatccctcaaatgagcaatcttttagccattgcttttatttctcctttttttttttttgcagaatgactgattaaattttgttcattttatcttctctgcattgactcttaaatttgtcctaattgtataatcttattgccactgctttagtttaaaaccttttaattttttaaattgagctgtcttggtcggttgtctcttcttgctctccttcctttataggattttcctgatcattcatttttgcccctaatcccatttccttccagtcaataattttgtatactgtcagatcaatttacatacagcatatttatcaccatttcatttgcctgtttaaaactctttttcattgcctcattttgtatttggcttcagttcgtaatttgtcattacagattcttttttttttttttttttaagattcttggaagtttgtcagtgtactccctttccaggcttacctcttgttggtcattttaatgtcgcctgaaatattcgttatttactgaagatgccctaaattttcccatcactatgtatttgcttgttctgttctgtgccttcatttttttttgtttgtttgtttgttttcacacattctaagattcaatttatgtccttctatagttccatgatcttgaaggctttttttgttgccctagttaggagccatcttgtcctcctataaatgctcttagccatatttttgtcctgatgttttaccactttctcctttgtattgtactcattcatgtgtgtctcaattaatagataaatacactgagggaaggacttatttttgagtcctggttttatatctagcacaatactttgcatattttctgtgttaaataaatatataatttaaaatgaatgaaaacatttggaagctattaaactgggctttctttgctaagagctattctcttgagaaaaagaaaaaaaatcatgagtagtttgatcagatgttcgatacaggaccaaaaatacatgtgtactcttggaagtttttgatttgttttattctgaacaataatgaaccattcacaagaccatagcgttagtggttttaattgtgcaactgccattgacaatgagtataattgagcaggcatctgctttattttcaaaatgaagaatttttcctttcctttccttactgcagaatattttaggttatacaacggggaaattagactgctctattgaaaaaaataactttttctgttattttttctgttattaacattctattcatagtagctctatgaggaaaactcgataagtttttgtaatttaaaatggacattctaatttaaaaatatcattatattatttcagtctcttggctgtaatgttttcaggaatcaaggttataatttggtgggtatattaccctgattttgtctcctgcgcttttcaaattcctttgagacatcctccattgggtaagactatactttctgcttgggctcttcccttgctccatgaaaaccgggaggcgccttctgggagaaagccagaggaattcgcctactgtgctccgttgtttcttccagggatcatagctgtcagtttctgctgaatttgattcccctctagggtcttcaaattcttattttttagtattttttttggcttttacagttatcagcataaggaccagttaaatgagaactgatttgctgtacccagaatacaaactcttgggcacttgcattttaaaagagcaagttattgaaaattccattatttaatataggcacatttaaaatattgcccaagagaagttgagtcttagttcatgttgagagcttgagacaattttttcatgttactatttctcatgtcatgagaagcagtctattatcagactcatcaaagaggaccaatatactatggcttaatgtaaatcactgaatacgtgaagttagtagtcaagaaaattggggcaggacgcagtggctcacgcctgtaatcccagcactttgggaggctgaggcaggtggatcacgaggtcaggagatcgagaccatcctggctaacacggtgaaaccccatctctactaaaaatacaaaaattagcctggtgtggtggcatgcacctgtaatccctgccactcgggagagtgaggcaggagaatcgcttgaacctgggaggtggcggatgcagtgagccgagatcgtgccactgcactccagcctggatgacagagtgagactccatcttaaaaataaataaataaatgaaagaaagaaaaaaacaaaaaggaaaattgggttcatagttgtacagaatgaaatttgtgcaaaccactactcctgtttttatgagatgccagtattttgcaaagacagtaattttggtataaatgtcaatagattcatattagtatatactcatcaatccataggtatcttagtgaaggaacaaatactcatttaagctattataaggaagatatattagatactataaagacatactgcaaactcatagggtagaaaatctttgaccctatcagcaactggatgtgagacctataacactatggaaaacatttaaagtttgcagtgttcaagtctgtctcctctgggtttcctatttctctctctggccagctagttcattctttattctccctctgcggattgacttctttgatttttctatctgtaaaaggtggttgccccaaagaatttacatctcctcctttacatggccagtagagaatgtattccccaacacattcctgagaaagataattaactggctaattaggggttggttgtctccctggtgaacattttggctgtggctgagagggtggaatcacaggttataagcatggctaccagagtccactatgtggttggggaatagttcttagatgaggagagggttttgtaagctgaaaagttgcctgaaagggatctaccacatcaaatacctcagagatctgagtgtttaattgagtagctgggataaatggagaagctaaagacagaagatgtgttaattctaagcctatgactctcatatttatttaaaaaaaacctctgcatgtataaccacaaacagttataggcaaaaggttaaaggagattaaatggtaaatgaggaattaattcagaatgatgttaccaatgttagcaagttataaatctcaaaatttttgtcctgctttaataccgtgagattgctaagtaacatcttaggaactactaatcaaatatagcagaagagatgcctaaccaacctagtttatatgttctttaaaacactctgtatctttattttgaccacagagccattcaacgtaataggtcctcagaaaaaaacagtgaatgatgatatcactggaatatgtagacttccaagtgctttccaactgttttgttgttgttgttgtttcttgcctttagtttttacagattataccttttaagttgacacacccatcaattttgactattatttttggggctcttgatgaacaacaaatagaaattcatggtacttaaaaatagtaaagagattagtatctaagatatgaaggaattgagagccaacaagaatgtgggatcctgcacattttctgtagacagaatgtatttgatattgtaagtaatgctctttgttccagaatttcaatcttgggtgattttcttcacgcaaatgttaatcagaatagcttgtttacttttatgaaaattaaaatttgaacccataggtgtgtgcttagaatatatacaatttggaaggtgcagtacattatccaccatgatgtggaatcatcaataaattatatagttatattttaatactaggcatctgatgtttgtgtcaagactgtgtagtagaagatttagcccaattcaaataaatttcaggtatcctagaaataaaggcttttttgttctttgagatactaaaaaattctggccgggtgtgctggctcacacctgtaattctagcacattgggaggctgaggcaggcagataacctgagatcaggagttcaagaccagcctggccaacatggtgaaacccagtctctactacaaatacaaaaattagctgggcgtggtggcaggtgcctgtaatccctgctactcgggaggctgaggcaggagaatcgcttgaacctgggaggtggaggttgcagtgagccaagatcgtgccattgcactccagcctgggttacaagagcaagacttcatctcaaaaaaaaaaaaaaaatccctttactaatttgaatatcaaaataaaactttacctaaatttaaaatagtattttccagctggtgatgaatggtattagacaagagaggcaaacaatgaagcaaacaaacacaaattgcaaacatttagcctgtggttaaaaattacacccatcctttttcttttaaattttatttgtattgtagatttttgtactgaggattaatttacagagttcattctactttgaagactttttaatttgcatataacaacatattcattaaagcttctttatgctttttttaaaaagttcagcaatttgttgtatttttttgatttgctggtctgttgcatggccctatggtggaagtaaagaaatgtaatgctttaaggaacatataaattgggggtagtaagatgtctttattattaaataaggactaataatatcaggcagtttttgatgaatacttattgaatgatgtagaaaatgggtgttttaggagttcaggaaagggtatagccaactagagtggcctggcaagggctccttgaagaaaaaacactggaattattcttggaagtatttgttggtatttatttaggagagaaggtaatccagattaggccttctagaaatgagaatgcccacatatattcagggaagagttaagtaattttgattgcagtgttgggtttacgtttgagagaataagatacgcttggaaatatgtactaaagtcagaatgttgtagatgatgaaaggagtagccttctgatgatagcagcagtgttttaggactgtcagtctgttgatattacgtgagaaggactggaagggaaagagatgagaggcagaaaattaaatgaaaactacatgaattgaactaagttggtggctgtcaaaatggacaggagtgggcaaactaatagggagttgaggaacagtcattaatgatcttgaggactaattcccttatggacacaaaggatgtggaaatgtatcaaaagatggttctgaagttttaaacctggaaagtagtgaaaataagaaactaccaacaaacaaaaaggagacagaaggaattaatgtttttatgggaagatgatttaggtttcagaggagttggttttcttagtgaaatatgtgaatatatatcaagcatgcagtcacagatgtgggactggagctcaggagagaaatgaggaataaatcacattgtgataaagggaacagtagatgtaaaggctactttttaaagtttgggactcaaagacagaaggaaaataagattacagataaagcataaggaccaatgcaagatttttgttgagaaagtaggaaaagtgtgtgtttgcagattgaaaggagaagtgggtggataggaatagactaacaatgctgagaggtaacaattaaggggactttactgatgataaggggactttactgatgatgagaaaaagaaaaatgatcttaaaatacctgtgttttgaggtcagtattttattatacaaggccccagtcattggattctagaacagcaagtgcctcaaaagagttacttggattagtgtattttcatgctttggtagaaacatcactctgtcatgttgatgttaaccatctgaaatatgagtgaaacaatgcatttatatacatctttctgtgttatattaatttgaaattcttttctggtttaccagtctttttttgatcacaaattgctgaaaatcttattagcagcagtgccaaatatacagtataatttagtccctgagttgagttgttactagagacccaactcaatattctccctgatcattgggtagtttgggtgatgtattaacagagctagtacttatcattatattatttcatccacataccgaataatactctagtggcttcataaataaataaaaaatatttaccagtctgttgacatgttttgtattttccaagtgcaatccttattggacagaaaattaaataaagtacatttactgccacctatagacctgtgcttatttgggtgctctggtgtcaggtgcatatatatttactattgttgtattctcttgcagtattgacccctttattaatgaccttttttgtctttttgtacagtttttgacttaaagtctattttgtctggtattggtatagcaaatcctactctgttgtgttttccatttgtatggaatatctttttccatatctttacttttagtcagtgtgtctttataggcgaagtgagtttcttgaatgcaccaatattactgggtcttgttttttttttttaaaacggagcctcactctgtcgcccaggctggagtgcagaggcgcgatctctgctcactgcaagctccgcctcctgggttcacaccatcctcctgcctcagcctcctgagtagctgggactacaggcaccaaccaccatgcccggctaattttttgtatttttagtagagacagggtttcactgtgttagccaggatgctctcgatctcctgacctcgtgatctgcctgcctcggcctcctaaagtcccaaagtgctgggattacaggtgtgagccactgcgcctggcctgggtcttgttttttaattcattcagctactgtgtgtgtttaatcagggaatttagttcacttacattgtgttattattgataggtaaggacttactgctggcattttgttacttgttttctagttgttttataactcttccttcttattatctttctttgtggttacatgatctctctggtagcatgttttaatttgctgccttttgtttttagtgtatctattatgggtttttgccttgtgataattcttagattttaaattggattgattttataagtagaacctattggcagtagtagattttttaactttttaatttttttgagacggagtctcaccctgttgcccaggctggagtgcagtggcatgatctcggctcactgcaacctctggttcaagtgattcttgtgcctcagcctctcaagtagctgggactacaggtgtgcaccatcatgcccagccaattttttttttttttttaaagtagagatgagctttcactatgttggtcaggctggtcttgaacttctggcctcaagtgatcctcctacctcagcctcccaaagtgctgggattacaggcatgagccactgtgcctagctagtagttgattttttaaaaagcagctgcttttcttgtgttgaagctctcaatatgagtagtggctatggaaattctttgtaggtcaggacttcgtagcttcctgtggcctttctatatctctttttgcaggtttgttttagtatttatccactatgtgtaatagtgagtggtaacagcatgcactccctagtacactagggatcactttacaggtcttgaacctctgtaagccccatttctttatctataatctgtgaatttatctgataaaattttgtgctttaaaagagataatacattttacatggattagcatgttgcctgcatcatagtaagccctcagtaaatgttatggcattgctgctaatgctgctgtagtttggaatatgaggattaaattgtgattaaagaggaatgttgattaactcactcagcacaatatctagcacatagtagatacccaataaaaacgttccttttactcccatgttcaaatgcccaccccgcctcttccccatgaataggaacaagtagatgacttactagctataatgaatcttttcttagatccccaacttggaaaatgaatgaccaggttaatatactcctgaatgttggttttagaattagatttgcatggttttaaaatagtttttcttaattgcacattaaaaatgtgtatattaacattaactgatttatctggttgtacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagtaagtattattctgctgttaataggttttaagaattgttagactgaagtaagatgacttcctactttattaatagccataactttgtctagcttaagttgattgaagtaatttagaggaagtgaatatatgttgagttttatttatttttgttttctgtcaggtgaagtggttgttttgggtacagttactggactacctggaactcctaataaaaatttcttgaacttgtttcaggggagttttatttaaaattaagagaaatgaaactccccaattgtttctggggaattttatatgaaatgaaaggaaatgaaatatattagccttgaaaaggccccaagagccaagaaacaacctttgttaataaagttatgcaaatgtttctagctaagcagtattgggccttatgtggttacttgtttaataaaagaacaatctgggtttttttttatctaattataaccttagttaactccatgaacccatgtgcccaaagtgtatatctcttggcaacagctaatagttaataatattgataataacttcaatagtaacaacaggtaccactgattaagtgtttcctaggtatcaggcactgtactgggtgagtttcccaaaataatctcagttaaacatactttaaatttgagtatactaaattttagcagcagcagtagtagctaacgtttattgagttcttactaagtgctaatcaaggcattaaattattctcatagcttattttatttactaattacaacaaccttataggcaagggttgtatttttaatacttttgtacatataaaaaaatagagacatgaaaggttaagtaatttacagaaggtctcatagctagcatgtggtagaaggaggatttaaatcctggcagtcttactttagatctgttttcttttgaggatttagtagatatttaagaagttgtgtctgtaaatataagcatgtaaagtgaccaccactgaagtatcccagtatattgaatttattctttttcagcagttggagatctaatatcttctgttgattcacatttgaggcttgtttttatcttagatttttagtgtttttaataattaaagcttcaacagtttatttattttgtgatctagcagagaggagatttatttagtatatccctgccagaaatgaaatctattctgtttattgaatgcattcctttttaaacagttttattcagagagtggatgcaatatcagttacaatgctttaggctgcaagtaacataaaactttaaatacaatagattgaactataggaaagttactatctcacgtaacaaggatgaatgtggaggtttccttaattcaactgtacaatatcataaaggactcagccctttccatctctctgcattgccatcctcaacacattagtaatgttttctattgcgatcacgaggtgtatccatcagttccagtccagtaaagacagtgtgggcaagaaaattgcatgtgattctccctgtgaatctctctctttaaaaaacatatagactttattttttagaacagttttaggtttatagaaaagtagagcaggaagtacagagagttcctttatattccccgcttctctgcattttaccctatttaacatcttgtattagcgtctgtttgttagaattgatgaaccagtattgagatgtcattattaactaaattccatagtttacattagagttcactctttgtgttgtacagttctaatgggttttgacaaggcataagttcccaccattacagtgtcatacagaacagtttcactgctctaaacatcttccattcaccacatattcatccctccaccctccctaacccctggcaacctctgatcttttgactatctccataagttttgctttttccagaatgttgtatagtcagaatcagtgtgtagccttttcagaatggcttctttcacttagcaatatgcatttatctttcttccacatctttttgtggcttgataggtgtctctttgtattgctgagtaacattcctttgtgtggatatgccatagcttgcttatttacctattgaaggacatcttgcttgcttccagcttctggcaatcacgaataaagctgctttaaacactcatatgcaggttttggtgtggacataaattttcaactcatttttgtaaatacctgggagcaacattactggatcattcagtgatactatgtttagcttcataagacactgtcaaactgtcttctaaagtggctgcaccattttaaatctttttaaattagtacttacgaattatcagtttattaatcatttctgctaatgacaaaactcttcagcaagttcctattaagctctaggattgggtcgtaagcccattcctaaactagtcactggcaaggggaagcagatctcagtggttgtcttaaactaggcaggtttctctctggtgctaggtttccagctggagaggaagccactttttctgagcacatggctgagtaaagagcaaggaagcagaatgcccagatggaatcagggctatgccagcaagcacaaagatagtagaaggaaaaggtagttggtagaggcaactgacactgtctcagatgcgcctaagcaggcccttttcttttctttttttttttttcttttctctatttctagctcaatttaaccttctaaatatggaatcattgcagaaaacaggctttagggtttaaagttcatgctctcaaccatcaccgctgactttcaacctcagtcagaccacatacacattttcaaacatttagccagtgcttctgaagttgtggtattgggaaaaaaaaaaaaagaaattgttggaaatgaacaaattggcttaaataattattacacattttttattattgggcagtaatgaaacttatcacagacacagaattaggccgttattacagatttgtctgtttccagtcttggtgctatcattgagcccatgtgtgtctgagcaggtctcagtatctctggatataaactaaggaggtgagactcaatctctagtgcctcttttactgcaaaattatatcagtctgtgacttgttgcagacataaaaagaattcctgagtaccaaaaatacatcaagtcataaaggattaagattttgactgtttttatcacatctgtggaggactttattaccctctttaattacccttagctaaggttaattaagtctgtttaagtcctgccttattgtgctatgtgtgcctctctattctttgcttaagagtttatttattttttttctttgccgtatctgatcaatagctgtcagcatgctttttggaggtcagtggcttcttttctgcacttgactggcaggtggcatgtttgaagtactgcacactttgccttctttctggctgttagtaccctcttagttcttggcagggtgcagagaggggatcacgtaacccaagtgtttccctcacagactgacattcatctcagtattcatgttccttgtcaaggaaaggataaagaaggcataattaagaaaatgatggtgtgcctgccttgttgccagaaacctatcccattagcactgttgctcgtactatgttgctgcttttaccccttagtggcagtcattcttagaaggattcctccatctggcaggttgttatcctgcctttgaaatctcagtttgaaatgggatctcttatcacatcaaaggatttactgtttgatatgtcataattttatctgttttttttcttacttgcacgtttatcttaagactgatttgtttttgttatttctttttgtagttattattttaggttttagaaacctgttctttatcatgagtctctccctccttctccctccttcaccagtgtttctaacctctgaaatagttcctgggtaggtgtgaacaaatattgcgtagcttggtatttttgagagtattttatattgtaggcagcacgtcaaaaaactagcagccatttagaaaagaaactgttttttaggccatttagggagagattatagctgccttgcttttctggtgctgttattcagccacatttctagtatgtcctttgtctagtcctctacctgtggaagttaggcatgagttctgctctgaggagccagtgtgtctgtgttggtagctggcagtcactggtgacttctgagctggatggtaacgtaattagaatgacttcataggatgctttcgttgctgcatgtataaggatcctggctaaaggctgatgggggtctgaaagcaaaaggaagttgggacagatcacagttgtaccagttgaaatgcagaataagcaaaagatccaaatacggttgtaaaggagccttagccaggaatatcgctcataaatcaaggtctgcggcagctggccctggccctgtcatggtatagccaaagtgtcttcatcacggaacatcggggagcaccacacagaccagagtagaataatgtggaatacagagctggtcagcacttaattggtttacacctgcttgtctgtttcccctgtgtttctctgcaggttcgaatcgtcctcccatgccatcagtatgagcgcctatctgcgagaacagagaagggagctctatagtcggagtggagaactgcaaggtgagtgattgagcttctctggaaaaattaattttctggaggagtatttcctttattacacatgagtttgtgtcctgcattcacacgatcctttcaaggtaacaaacacttagtgacttaataatttgtttcttctgtaatttcccagcatctgctgccaagcaggtaaaactattactgtggccataggacttgtagacctgctactgttcaagtgggaattcaaagcaaaaagagatgaggccaggctcgtcttgcttaaacagaagacctgagtccagtcacaatctaggagaatgttggtcttctgcgactgccactgttacttctaattgttgtttttgacaccttctagaatatgacaggagtacctgagatttgggaaagggaaaatgcaaccactgtcattatttaaagggaaaaagatgcctctaaatagtatgttataatcaatataactgtgatgaacaggctatttgatacccatgtatagttaccaaagagttgtaagctgaagaagaaaatatttagaaaataaattaaatataaataaatatattagactgataacatttccttctgtgacaaaaagatgctgatcatgtaaatgtaatgagttaagaaaggtttggaggtcaggtgtggtgactaacacctgtaatctcagcactttgggagactgaggcaggcagatcacttgagtccaggagttcaagaccagcctgggcgacatggcgaagccctgtctctataaaaaaatacaaaaattagttggacatggtggcacgtgcgtattcccagctactcaggaggctgaggtgagattgcttgagcctgagaggcagaggttgcagtgagctgagatcatgccactgcacttcagcctgtgtgacaaagtgagaccatgtctcaaaaaaagaaaaaaaaaaaaacaacaaaaccacattggtgagggcctgctaagtgtaagacatcttaggtgttggaagtagtggaagttgggtacaaagaaatataaagcttaaagatctagttatgaaagtaaagtatacatatgtgtgtgtgcatatatacatacacacacagagatacacacacacacacacgtcaataacaatatcaggaagtaaatactaacaactgagtgggtggtatggataaattgctagagaaattacaagaaaggagtgattacataaattgttttagaactctgggcttttctccatgagggatgggaacgaatacttttactgtcttgatgcgttgggctcacgtagcattttgcagtgactggcctgtgtaattaaatatttagtctttaagactcataattctgtaccaaaacactatgaagtaaccactcaacctttcttgatttaaagactattgccttgtcattcctaacttcacctttgttattaatagaataacctgtaagtttttccaaagatgctgctgtactctctcatatttatatcacagtaatagttctacagcccataaatgtggtcaccagaagtaaaagcctagaagtatgtttagggtattaggaagaggagattagcctaccaacattttatttaatatgaaagggttgtcatgcattctggaagacatgcaatgtgcatgtcgagagtcttgatgtagaggagtacagactgtcattagacctggaacaagtgaaaggacagaaaggagtgaaggaggagggtgactcatgctctagcaggctttctctgcctcccaggagaagaggctaggctgccaagagtgaaaggaaatgatgataacagaacatacattattgcaggaggtaggattgtgctcgaactgcccttagcaggctatctaaggctagtgtatcttccacactcacggtatcctaattttaatttctcttcagatttgccttaaggaatagtttaaatttgcctccatattttctctacacctgtcttctaatacacataaatttatttgatggtgacaaagcatctcctttcttctttttaggttgagtcctaattattttctttcttaaaaattaataaacactatctgttagagcagttataaggtcccagctaaattgagtggaaagaacagagttcctgtgtgcccttgtccccacacatgcccaccttcctccagtgtcgacatccgtcagcacagtgcagccttccatttgacccttctagtgaacaggcagagcatgtccctatggttacatagggaccgaggacctctcatcgctcactcacactcaagcataaatagtcaacaagggcacaggactagtggcagattctttatgcttgtatgagtgagaatggagagcactctgcagcagccgtgggaaggcttttcagtcctgccccagtggtccacgctctcttgagagacagtatagggtggcagtgcagagtaggtggctctgggcccaagtcacctccatttagatacctagctccccagcacttgctttgtaacctccagcaagttccatggtctctgtgcctctttttccttttctctaaatgggaataaaagtaacactccctactccatgaggtggttatgaaaattaggtgagttaagctaggaagtgtttcaaaaagtgtctgacatatagtgaatgctatgcctttcttcttctcctctatttctagtactgtggtgtgacttcagagtattcacacacattctgtttgtcctttctgtcatctttatatggctaagccctcctgagctttccaagttaaatttaggtatcgctcatttggatgggcttccctgttggtccctcctctctcagcctgtcacaaatacacacacattctggggttgtggcccctgctgtgtgttactgccacatctttaatgatgttcttctgagtactttccatactgcattgtggaacaatgctctcttgtttgagtttgccacgaaactataagctgcaagagcaaaatactattttatttcctgtgcttctcacagcacctggtacaataaatgtttgataaatactggttgacttagtgacagaatgaatgaggacagttaggatctaaaataggatagagagcaccatggagaggcaggaagggcctgaaaggaaccactttcagctttatagttttccattagtctttaagttgaaggcaaagtagagggtatacatatatggttttgtcctctgcagttataagctttattaaatagaaatattgcccttgagctctctggcccaggacaaaactactgtatgtaattgaaaaacattttaaaatctaagtgacagaggaattttactctgtgaggatggttaatggagaaatcactacaatctaactaggaattttcccatccttcaaaaagttaattgaaatatgggctttcaagcacaagtcgattgaacttaccagttttcagcaaggaatatttctggttacaacagaagaaaagtaatagttagcaaccacattatgttcctaataatcattaaaaatactttaggtgagctgacatattacacacttggtgagagaataaatcagtggaccagtttttgtaaaagtctgatggtgtttcattcaggaggaaaagtttctctgatgaatgcttttaacatttcaacaggaaaaaagagaagaaaatcatacctgtcttccattaaaaacggctgtcctttttcagttattccattaatgactggtccaaggaccacaatgagatctgcatttcagcttgtccctgaaaaggcataattgaatagttcagtcaaaccgtaagagactaagggaagatttttgtttcttctgttaacaccatatagcggcaggctttgcttcccagtaatttcggttcatacgtcaacttttccttccgttgcagggtagcggcgaagaaatccaccagaaagacaatcaaagtaacattaaaaagctcaaattttacaaaagttaagttcctgccaacattttcaatttatcatacaattagaaatgtgactcagtctaacaacacccaagaggataaaaggattaa

SEQ ID NO: 273 - DNA, 409950 bp, Homo sapiens
agtgctgaagaaagagggcactagtgtacagcccagatcgcatccttgcaccgtctggattagagctgaggcgtctgcaagccgagcgtggccacggtcctctggccccgggaccatagcgctgtctaccccgactcaggtactcaggtatgtctcaagtccatgtcctccaaacagactcaggtgagcggacacttcctccggtgaaacccacccacaacggcagacaaagtcccagtctatcagattttcctccgggtcccaggcgcattctcgcttatgtatttcttttcgtcctgtatcctcaggaagagtcgggaccaatgggtgcctgggttttctttctcctttttctgcctcacctcctgtgctctcctcgcccgctcccatagcccccttttcgtcgactctcaccttgagaaaaggagcaggggaggaacgggagagggagccaacttcagccccgcaggcggctgagatttggcgcctctgtccccaagcgggtgggtttggatatatacctgcacaagcggtgcaaggtgatgagaatgagggcggaggggcggtggggactcgagtggaagggagtgtgtgtgtgtgtgtgtgtgtgtgtgtgtgtgtgtgtgtgtgtgtatgggtaaagaactcagaggagggaggttgaaagagcaaagcgggtcagggaattgcaactcactggtcaaagcgtcccttgcaggccctgccagggaatgtctggctggaccgagcactgtccagggtcctgaaggcggcagggctcaggctgccgcggcgagagcaacccggaagctcccctccgttccctttctagcaactatgcaaaccccaaagcaagcgcaggaccccccctaacccgtccacccaccgcgggaaacaagttaccttatctgcaccccttcttcttgaacatacacagcaagcctgacttcttacgggggaaacataccaaactcctccatacggagactttaccaggcgttgccttagtaactaatgtggattttcttcaagctggcaaatttatatttacagctgattttatgtcagggcttcttcaacccctcaaaattaaagtaaaaggtgcatcctttgtttacgtttattttaaagtcgcgcttccacctttacaatgagtttccaaattttcttctgaaaaaaagttgatcttttccaatccggaaagttctcttgggttgaaggacctagctcctcccctcctctctgctcaccttccccaccgccctccaagttagaaagcatgataggttttaggggaccaggaaacgacttaaggttggaggagcgggcgagttggcggggctctgcgccgcctggacccgtgaggacagagggggcaggacaccccgccttcctcagtgaccacagctgcgctccaagctgttcctgcagccgatatcaggatgtgccgaaatgaaacggacaaggcaactgttaacattatagaccccagagttttaacacaggtcctctgatgacaaggttgtgatttttctctgtcttttgtcagcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaaggtaggcattatatttgggaaagaagggtactgagaaagtcagggcaatgcatgatgtgctcctgggatcatagtattgttcctgtttatttctagcactgtggggaacggagtttacccttctcagtactgcccacccaggcattgccttttatcctcatttccttacaattatagtgtaggaaaattgtaccccatagaatatctgaggataataggagctgaaagggtatcaaactttccatgcaaagtgtccagcagtagatttgacttgaatacttgtttgccctcatattttgagtttgcgtttggaaggcttatttgtccaaggtgttatattgcccttcagtgactggctatgactttccaggtgtaatgagttaattcagtgtgagtgattggcaaaaagaagttactattccacaaataggacttcaaagctttatctttctttaacagttgaagattttctttgtcctcttgtaccccttcttacatatccaaaactttcctgtgaatgtaggattaatgcagtcatctccctcagtatatcagaaacttatatttttacttctggagtaccttagttacaaagaaaaagtaagtaatttaaataatgtattttcttcttactttataggctaaaatcatccagattccctcactcccccaagaattatcttgttttatgagaaataacactggtgaccacttggatttgagttttggtttctagtcttttttcttctaacacaatgaacttacatattagaattaaagttagatcagttataaaatactaatgaatggatagcagatattaggtttataatgtctttctaaaatgcaatagattaacctaaggttaaaagctttgatttttccagagacttatggatgtgaattttcaaaaattttttatataaagattttctagactctcttcaccttaggttatatacattttttaataaaaggggatttctgagctcagctactcttaagtcccccagtaggtttatgaaaaagctgaagccctggttataaattaacatctaggacaattcacatgtataagctggcagaagaagacaatcttgctggtatttctgtattcatatttcttcaactcaaatgactttcaagaagccataggcatggctccatgtttttttaatatttccataatattcagttactggcgtgaggtctgattatagaaattgacagcatccatagtgaagtgattatatggttatcattattgaaaacatatactttataaagggaacagaattttcagaacaaacataaatgatataggattacacattataatttcagattttgcttttggaaaaaactatctgctgtgatattataactttataataactgacttatgcttctgaagcttgatttttaatcatgaactgcgtatctctttttgaacaaaaattcattacttttttaagactcaaagtattaattccttatattttaatatttaactttactacatgttaatgtttagcatagtttctttagtgcttgcttaaatgaaacatcctgaaagagcaagttaaaatgtgttaaatatcatcattggatagatccaaagatgatggcaaagagaatggcaaaatctagattgaatgtgatttatttaaatatttaataatatttcccccattgagctagataattgattattaatattggaagtataaattctttcttcaggaagaagtaatgcttcattatttttaaacagtggttttattttccatatttcattataagattgttttatttggtgagaggtggctaatagtgggttgctttctgaggagtagaattatgtttttggaaaatgaattgaacatgttttcactaattttgctgcgaaaggactaatattataattttgcccatgtgttagtttggattactatgtttcctttctgccttctgattggtgttgtatggcaaagacaatgtctccgtactattatagtaattgattccagactacattgtgttcacagaacagcatcatagaaatatgtggggtttattttattaccaagcagttacaccattcaccttgccattcatatataataccttgtttcttctcaaagggaattagttacttctcttattaaacgtaacatctgtaaaaactaaattgcatttctttccttctatctggaaaggaattttgtgtaaggtcccactgaagattcatttttcctgaggttttgccctcctgcttttcagggccccatagtgtactggcctacaggcacttccttggatcatttagtaattttactgctttcagactgatggggtcgcttattggtgacagttccctgtcaaatagcagagaagaccacatatcagggttgtctctgtcgtctgagcactattcagcaaggaagccagtttgtctggatattggcaacttagggcttagaaattctggggcctctcgtgaccttcatctctcctttccaaatcagccattccctagtcaattcattatcatcgtttcttgtattagaagttaaccaagaatagttaataccaaaagcactaagtgactggactagtgtaccttcatttctgtagttaattgtgagattatcttgaaatcatattgtttttgaatggtacagttgtttttatattacttttttttatattgaagctaaacttgcagatattttctgttttgttttgtgttttaaccagttacaatttagtttttatattctcttacattcttttcaatcttatatcatattatttgtaccacacttgatacatgacaattatcaatttacataaaatgaaagaaaatcagtacacataaagttacctgcaatgcaatagactctccagaaattgttcatgattagctctggaggcaaatgttaagatgagcctgtcaagggggaggcaggatattggagtaatggagccttatccacaaataaagtttgaatgcactttggagcaagctgcctacctggaatgtgagtctttaaatatgctaagtatatagtagagaaatagcctaccactgataagaatatctcagccaaggacactatattttgttcttctgataaaatacagattccccgtcaaaaaaacaaatttattatttcaaatgatttttgaaaacagtacttaaaaataactgtagttaataaaattcaaagcattgaacaagtccaataaaaatgttctttgagtatgtagctacaagaattttttttgagtggataaattttcattcattacttttatgtatttatttatttatcttaagcctttcttctagtattttgtctcagttacttagataagtattgatataataatgaatttagtgatgctgcttcccttattaaaatatccactttaaggtaaacttttctttccagttagattttgatcttggtgtgacatttttttgacatttgcttacattttatataaaattggcctttttgagcttctttccaaaatctgattttttcctttttaagtacttttttatttgatataaaacaattaaaaagtctaatgacatcagaaaaaagtcctcctaagtcataaatacatactttgattaatgcaattacctgtaataattttatatctactaaatatcatatttcctatctatgtaccagtaactttctatatatctttcttgtcttgattgcaacctacttcaaaggaaattatcttaatacattgctcattttatcatatagtaagaaataggagtgttttgaaaggttattcaggccaactaataaaagatgcttagaacatcacattacgtgcttgcccacgctcaaagctttctaattgtgattagggtttctaattagagtaggagtatatcggagttaaattgagagcagaatttcacctgacttttagtcagttcttctatgtaatgacctaaaacagatttcttgaagtttccaccaatccttcattgaagactaggagtcatccaaaacattcaagcttcttttccatgtgacatttatcatcaatgaataatctctcttttgtagtgtagctctccagttccttcactcatgcatttcattttttacttcccttaccatcatagctgactagagtagatcttacatcaattaacatcccaaggtcttttcagaagtgctgctattaatccatatctccttccttttatgcttgaacagttattaattttgttactgttaccattagattcaagaggaggacttgaattttttccctttaaatgtaaaattattagcttcaatctgcctttctaacatcagtaagttctgggattttgattgtttaatttatcttagtattccagctttgtgtctccaggatttaaccatatacgttaaaacctgaataagataagggtcgaaagtaaagtctcaaaccctttcacgagcaaactacctggctaattctggtgttcactcagcctattatgaatttcttctatacagtgcttttcctcctcttactatactaccttgcaaatgtataaatggctatatgtagtttaaatgaaaagtcatcacaacagatgactttaagtaaagatttactgcataaaaactttaaataacaattttgaagacttaatttcggttactaagtagtttttactttaaggggagtgcagtttaaatacatgtaaagtaagtaaaagcaatcacagtatagacatttataaacatgagtttattcaattgtagggaactgaaagaatgtattagtggtgcaattatctagagaaaacctggagaaaagggaattttggttagagttttgtttggaaacatagcatttgtaaaagagacagtattgaaagtactgtaatggtgtgaaaaaaacagatttgcttatctggaggaaagagtctggggtaagaactaataataaaaacagaagtaagtcctaatattctgtgattacatcagtctttatagacatgaaggacaagtaatggagaatcttgaagcatgtgacaaagagttttggtttcaagaaagatacatccaagcacagttagacatgtgaactttggccaagagaacatatattattggcaaaagttggtgagtggacgaaagaaaagccagatattgttacgagatactttatttgtaattttttaacaagtgttcatatccaagtaaaaccttgtttatccataaccttgattctctagctgtctactttatacttgagagttggtctctttaaacaccaacatttacatttaaaacattttatgaggtgatctttgcaaacactactgtaaggtcccctaacttcttttaaagacagtgctcaatttaatggacattttccttgaatataccaagttatcgtgaacataaatttttaccttgcgctggaatatggtggtaatcttggagcctgttaaaaaaatataaggccatttattattactcaaaatggccacaaattgccatacttaaaaatttttatctttattttttcttttatatcttggctggatttattaaactcatttttaaagtcattaatcagtatttagcaaacagctattatgtgcatagaattagagtgaaatccaaagacgaaaaaaatgacactttcattattttgagtaaacttgaactctttgtgattcctttgccacacaatcaccctgtgactacgtttatcttgctgcaaattttataagaagctgtccttcatagggtaggtggtgatggcagcttccattttatgtttctaccgtgtggcttggcagtagccatccttctacaagtattaaaatttttgcccttatgatatagggagctaatatacaataactgctttgtggattttcagtaactgggcagtgactggagtgatgggttcacaaagagacttatcaaaagtcgtgttttcggcatacacttttttaagaacacagagggctggggaaccacatccagaaaagaatagtttggtgaacacctacaaccactaaaaaaactcatggcacatgctgttctgatatatgttggaaacagcatgtcagtaggagaaagttgtcaattttcagagaagctgtagttgaaaaccagagtcaagacaaggcataaagccttgtcaaaatgtcactgtcttatgcaacagagagttatcattagattctaaaattatatagaaatatttgctactttttcctgtttaattgttctctatgaatgtctacaacatttaaaatcttaacttacatgagaaattataattttaattaccttctgtattccagaaagctttactctcttaaacttaaggcattgtagtaccaaatagaacattaatgtttttatgaagagaattgcttctcagaaatctccaattatcaattttaggattatctattttatttatttcatagccaacaaattaaatattcaaggcaattatctaaatatccaggtaaaagccttaatttgtagtagaagcacaggattttgataggcagaaattctttgattacctagtaactaatttgccttctaataaagacatttataaataaacacgtgactattatgcatcacatatttttcttggtgctagtaacacataaagtaataaaaatcaataataataactattattactactaatatttgttggaagagacatgtaaatatatagacagttataggctcatgggttaaaaagaaaatgtttaattactgttttgaaaaatgcacaaaacatatgggaaatactgtatgcatgcacatctcagtttcatttgtaaaatgggaattataatcactaccatgttatattcctcacagcagcttttcaaagaacaagaagatggtacccataaatacatttcagttgtttttcttaaactgccaccaaagcgatgacttcttctcagctgatgaatattaagcaagtccaagaagccagttaattggatacagattttcgaccctaaacctagtaatataagattaaaatgaaattcatgattaagataaaggtgtagcatctactatagactttaggaaactttcttgttacaaatgagaaaacaaaagcccagaaaaataaaacaaaatgacttgctcaagatcataaaattcatcagcagcaaagctaggactaatttagctttgttttagatactttctcaagccaaagttttctttctttctttctttcctttttaaccctcatgcacgcctctcatgtgaggtccatactatttagctcaactgtgtctttccaactttgctgctgtcatttagcagcttctaggagattcctcttctgaaaactcactctgctgttagtcttcctcttaatgtcagctcttaccttagttttggatgactccaacattcatgtgtttgtcccaccaatacctatcctcatagctcattgatctcagctctgtgttccttgccttctctttagcaacccacttaccctgaccacaatctggtaccctggccttgccaataactattttatttataaatttttaaacatgagaaagtcactgaaaaatagaagcctctccttttcttcaacttcttttgctcccacctcacctgctctccacatttctctggaaggtctgaataaagccattttctcagctgatctggtttcccttctgcatctgagcaactctacctccatatttgtgcttgttatcatcttgtaataaaagtcctttcgcagagaaaataaactttcaatgtagagtgactgctccacatgaagctctatttcaggagattatgaattaaccatttttttttctccagctccttcagggcagaaatgtaaaataagaccagaattaaacaccttgttaaaatgaaagaagaaaggatgccttctctatgagggttgtggttaacagtgggagatgacacatggtcagacatctctgtgacaccatctctaccacaagtaactagaagtggtatggagtggataaggatgagaaaattagagaagggtggctagagttgaaatccagagatctggaataggattgactcaagggattaatagaattaggcatgcttagagagctatcagggtgaagtatacagaaaacagtcccctaagtttattatacagataagatgcaacagtgctccatatagggctaggtagatgtaatagatgtaagatgtcattattgttgtcatgctattctaaccttaattaggaagatgcccttagcttagatgagcctgtgtgaagtaaatacagggaagttctgtggtggagatgtgaaaataaagagggaaaatgctgatttactaacactgagtggcgcatattcaacttctcattctctccctttataaaaattgcactcacagcatgtggccctcaatgcaaatcttttgattggacagcatattccacagctattgttaaacaatcagagacagtttcctctgttctctgtggtgctataacacattttataatttgtttgttataaaaggtagaacaaaaaaatcaataaacaaattgctgatagtatgttcaagagaaaaaaactttatgaaagattttaaaaggttatatcaggatattgaaatagtggaaacagcttataataaagaaattcaatatccttttttttcgataaataaatacattatttgttattttcaggttttggttaacaggtactactctactggcagagaagaagtcatgtccagattcctatctcaatttttatgttttgtagcacattctttggtttgaccaatgctatagtcattgaggagtagagatagtggaattatagtcttccttttaagaagttcaccacatggtgattactattcagttttgctaagtgcaaccataggagtaggcatgaggtagagagacaacagagagaactgtgattagctccctctggtccagggaagcagtgagggaaagctcatagaaggtccccagaaaaggtgacatctgaagttcactatatccgaggaaacaaaggagtaaattcagtaaaagcactgacatagaaagcaaaatatgctcagggacctctaagaatatcattaactctaaagtatatgtcctgggaaaatgagtggggaagaccaaactgaaaagagagaaagagcctaggtcatgatgggacatacttatcaagccaagaaaattagactcttggaaacatggtgagccagtgaagaattttatgcaggaagaaatcaagatcagattatattttggaaagggcatctggaaagctttggagaagacagattaagaaaaggagtcaaattggaaattaggagacaaatctgaaggccattgatggttgagggaagtggagaaggaaaggccagttcaattaattaattttgtcaagagatgattagagttttactaaagaaagtgtcaatggaaaaggatagaggagaatgaatttgactttctatgtagcagggaggttagtgtttagtgaatgattggttatgagaatcaaggaaaaagagaagtctagaataagccgcaggtctattttgtaggaataaatagggaataaagagaaatcgcagactgggaaaaaattagtttaggctgtttgagtttgtggtatccattggacaataaagtcaagggatcccataggccaccgatctggaaagagagttatatttgaaatttgtcagaaaatatctggttaaaaccatgaaaattgatgggattgccaagggggtaagatataaaacacaaaaagatggtcaagggcagtactttaaggcatgtgaaatgagaaagagtctacagaaaagggaaaaaggacagtttaaaaagtagaaaaagaaacaggaagaacctcatgttatgaaagccaatggaggagacagttttgataatagaacagtgacaaagaaagctgatgggtaaaagaggaagaactatagaaacagtgttctgtactagtagcgatacatgagactgtgtaatttatatgccacaacaacagtgttagaatgttctgaatttttatacttttacctgtgaattttatgccttcggatgatgttcttattgcatgttagtgtccttttctttcagattgaagaactccctttagcatttcttctaagaaaggtctgggggtgatgaattccctcagtttttgtttgcctgggaaagtatttatctcttttttatgtttgaaagttagctttgctgggtacagtattctcagttgacaatttcttttcttcagtgctttgtcatcctgctccctcctggcctgtggtttccactaagaagtctgttgccaaacaaattggagctcatatatgttgttttcctttctcttgctccttttgggattatcaacttttgaaagtttcattattatatgccttggggtagtcttatttgggtgaaatctgtgtggtgttctctacccttcttgtacctagagatttatattttctctagggttggggagttttcttgtattatttctttatgtgatctttctaccacttgccctttctcaactccttcttgaaggccaatgactcttagatttgcctttttgaggctattttctggatttcagaggcattctttattccttttctttttttttcttttttctcctctgaatgtattttcaaataacctgtcttcaagctcataaattctttcctctgcttcatcagttctgctgttttaaccctctgatgcattttttttgattcaactaaagtatttctcactccaaaatttctgtttaactttgtaaattaattatttcaatctctttgttaaatttctctgataactttataaattgcttttatgtgttatcttggagttcactgagtttctttagaattcttatttcggattattgacctgagagctcacatattgccatctcattggagtcagccactgctccttgctttacccatttgggaaggttatggctccctgtttgctggtgttttttatgaatggatatctgtgtcttattgaaaggttagttatttatcccagtcttcattccctgtgttggtgtggtctgtctagtgatgtgtatttacaggttctatgctggttgcctgttgagtccccttagccctagacagctgcctttattttggcactagatggtgccctaggcccaggtttcccacagctctcacacaagttggaagcactgcccattctggattggggagaggggtctccaagagaatttctctgctgtttgggaggctgactaggagtttatgcccagaagactcatgaatgtgcctcctacaatgtggtgctgctgaacctcctctctgactcggtatctcctttgtcttctgctcacaatttttcacttctctgtggcttcaaggatcttcacagcctcagcttcgaattctgggttattggtgatgataatcttgacactagatagttgtttttggttttctgtgaggaagatggaaggcatatttcttctactccaccattttggtgatgtcatacccatagacggagtagcttataaataatagaaatttattctctcacagttttggagaaactggcatgtccaagatcaaggcaccacaagtttggtgtctggtgagggctgctgtctgcttccaagatggtgtcttgttactgcatcctccagagaaatgaactctgtgtcttcatggtggaaggaacaaaagggcaaaggaggcttaagctagttctctccagttgttttagaaggcactaatccatttttgagtgcagggccctcaatgactcaatcaaattcaaaagtctctatcttttaataccaccacaatggggattaaatttcaacacatggattttgggggacgttcagaccatagcaagtagcctccacttcctcctagctctgtctttccagtagtgtgtcagtttataaatcaattggaagggcagaagccaggaggaagtggaggctgctaatatgcatccttgttcctgagaaagggagatgagagatccaatgataactacagagagatgtacttctaagtaaaataatcctttaggaggggaaaaaattaagcagttttaaaggctgatgaaaaagagtgagtagaaaaggaaaatttgaagataattgatcaagcaaggttgctgaggagccacgacaaagctgtggcagggctagccttgaacagaagccttttctctgcgtggtgatgtagtgaagttcgggaaagaggagaaaagagtatttgaaaacaacatttggtagcctttattttctgaattattcaatgagggaaatggaaagagagaagaaacaggtcaaatacaaatagagcatatttttagaggagccaattgagatgagaaaccacatattcctagtagtgttagttcatactattttgacattctcttcactattgtacagccctcagttacaagcaagaagtctcagctttcatagcagttaattaacttggccacctactggcccaatgtccaaaaacaccaaaatctttctttaatttactacaaaggctactaggtgcccatcagagatcagagccaagaattatcctttatccagatcctctcaaagggccagataagagaactgatatttaacagtgtcatctgggagatcattaccaacctctctgtatgaaaataggtttccaggggccacccacagtggctcatgcatataatagcagcactttggaaagctaaggtgggaggcttgaggctaggaatttgaggccagcctgagcaatatagcaagaccccatctctaaaaaaaaaattaaaaaataaccgtgcatggtggcgtgcacctgtaggaggcacctgtaggtggaggctaaggaaagaggattacttgagcccaagagtttgaggttgcagtgagcaatgatgcattccattgtgtttcagcctggccaacagagtgagaccttgtctaaaaaaaattaggtttccagaatattacatacttgactttgtttagtcttcctgaagaattgccttttctaagtaacatgttaatattttactttttcatttcttaaaggtcagaacagggattaaaaatttagacaatgcttatcattttcatctattttttgttgaagatattgcctgtgctgcttaatgcaacttgtataaattcatcagaaacatattatttttagatttaaatgttatgatagtatttgtttctcttaaagagctaacatgtttcatcttaattggtaatgagaacattgcattttctgtttatctcttgcctaccaggaagctcaaaactaaaattaatgctcaatcacagaatatattctagcttatgtgcatagatactagcttcttccaccttacttcaatggcattaatttatacttttttataattgtaaaatatctcaactctatttttggaaagagtcaggtgatatatatatatatatatatatatatataaagggaagtgacctcctcgtaggtgtatatctcaaccagaatttctgtatgctatgaagcagatggtaatgacaggtggaaagtttttttttaaactgtggaaactggaggtatcttacactcatagtttaatacgctaaagatgagaagatctagtgtgtacagaagaatccttgagtgttgatcacataacagaagagaatcatactttttcagattatttgaaattcctttcttggctcagatgctcacctgttcctgccatttccttcttagtgcattctgggacctgccatgaggctgtgtttggacattttgtccctttttgacagggcatatgtgtggctgaaacattctgtctttcttccatgttcaacctcgatatgggtgcctctgtggatttataacagtctcccttcctgttttccccttttctcatgtttataataaaaataaataaaatctgggaaaggcgagtctgtttgtaaagtgactgctcagtgagaaatggagaggaagcttgcttttacccatcttctaacttctcctggtgttctcatgcacttccctggccataattacttgtagtctggcagccagttttgttgaatgttctaggtaggctcagtacctatgatgctgtcttctacttcattcttgtttgccttaagggcaacatgatgtaacttgggaaaccgagcttgatataggatgagaaaatggaagacaccctatgtctcttaaacctgttaataaggtggtgattcaatcacagagaatagagggaggtactgtgtgttgatacatgtgagggataaattaatctttggctagaagcaccaaatttgaaaccatgaaaaggcaaattcatttttttggtctatgtcagtacatgctaaaggaaagtttagtatgaaatatctttgatatgccattttaaaagtaaaatcttacttgaaaagaaactgcctcttaaaaatgaaaaaaaatcgagtgagtgattaattttttgaagtgcttatattctgccttttacaaggttattttaggctctccttggtacagaggaatgcagtcaaggagtcttaaaccttattgttcatacaaatcacctggggagcttcaattacagattctgacttagtagatctggggtgggcctgagcgtctgtctctacaggctctcaggtggtattgatgctgctgatttctggaccgcaatatggacagaacctctggaagccccttctcataatttacttcttatgacagtgtattgtagatgctttcccatacatttatgaattatttcctgcaaaatcgtttatatatgtttaagagaaatgttgtttgattctcacataggcagaaaatggattttaaaatgtgcaaatttaaaaaattatagaaaagatatttatctattcatttcttacatttaatgattttaaaaatatgcattagctaacctgaataattactgaatgtagcattgtagttaatcaaatttctggttacatcaatgccttctcccgctagaatactttgcccccaaaaagtatctgtcctggtggaatataaactgctggaaagtaagatcttagttttgtttcattcactgatattttttcagcaattaaagtagggattcggacactgtagacacttggtacacatttgttcaattgaattaagtatggaaggcttttgtttcaaatgccttttctgccttagtaaggggtttgatgatttaagagcttacagggcttcacatcaattcttagtgcctagtactgtaaatgtaaatgtaaatgaaacaagatgatcgattatttattcaacttccaagaaccagcaacattagaagtctttggtttttactaaatttgttgtagattatttttcttttgcttctttctcaccaaagtggaatacagcaaaaaaaaaaaaaaaaaaaaaaaaaaaatcaaattaattgcatgttttgtgggtagactctacttattatcactcttccctttttccctttttaatcattgaaggaaaaatcattacatttactggcaattaaagctcacagatgttatatttttctcaatcactctctttatatgaatactggtgtctagtaccctctcttccttttacactttagcgcccgtgggcagcaagaggtgtactgagtaggaggacctggatttgatctcacgtcctctgagaacaacctccatgactctggacaagccaggaaactgctttaagtccatctgtcttctcatctgtaaagagtctgtcttgcctttgcctttcttacacgcttcctgtgagacccaaatagttgatgtggaagtactttggaaactgtatacttttatatacatacaattagctgcattatattctactatagcttgtattgttattttctcatttttattattaataattcctcctagcctctacatttaccagaaagttataaacaaccactattactcagcatttatttaaaatgatagattatatgctaaaagagagtatctaagtccttgatttgaaaagaaagcttagatgtggggttacacacagctagttactacaagatgcatgatgcatgactatcattgtagcccagctttttctctctacagcctctgaaggatctcctgatcattgacattaatttcttcatatgctctgcctactgtctgattttcttccacccttactctttgtaggtgggcttgaagggtaaccctcatatttatatcagtaagccagcaagttagtcaatttattttataaaaactgctctactaattattaggcagtgcaccaggcatcagatattaaaaatgaatccaggtgtgcagaggccaataaagtttggtaacataagcaaatatatgtaaaaaattatccagatattttattacagtacagtaaaataatattttttatgtttccaaattttatgggtaccctgcagttcttaccattgtttttagtccagatggagggctagagaaaggattattgccacatcattgtgagagggtgtgaggtccaagggagggacaggttacttccagtagggatattgggtaggtatttgaaataagaggcattaaaactgggtcttacatgatagctagtgttacaaatgcagagctatatggaaaaataatctcacatcaataaaatcatgtaaatcagggatctgagtaaggtgctaacaggtatgcagagaatggtgagtggtttaattcatctggagcagaaggtagttacaggagagttgtggagctggttggaaaagcggacccagatgtcagagtgctgagaatgtcagagtttgaatttgtcttccatctgctatgttagtcaaaatagagtagaccctcttttgcaaatttctaccaaagactgataaatagggatttatttttaacatttcctgcccactcatttttcgggttcttttttcctccttgtagcatttgtgttagaaagcgacacctttgcaaggaagccaccttctttgtttgtctagaaaaacatcattaatcatacagtccatttacatttccagagcaacataaatatttgattttaagaaggatacaggcaaacttattgcaatgttttgcagctagagttgcagcctctgtggacatgtggcccgcctctcagtgaagcaaaaggcatatcacaagctggtttctcagctgtgaaatgccactacttaggtcacatgcctcaggaaaaaaaaaaaaaaaacctgccaggagcaacgccttcttcttggcagagaggcatgccacctgtcacccaaagctgctgtcccctctagcatcatgcacagataactttgcttcacttctgcatgtggggaagttgtgttctctgccttttgcagtgtatttctccatggcatttatctagtggagaatttagtttgaaacttattgaattggggtttattgcccatacttattggacaaatcttaatccagaagaatggttataacctagaatgacactgggtgaaaatttgaattgtgtttcacatgaaagatggcatataacaggcatatttccacctgacacctagctatgatgccacccttggtgacagagcaagatcactccttatgtcactccttaatagcatgcatgggttcctggaaatcagccttagtgaacacattctggatccttagaaccatgcctcatcaactcttaaggcatagaaaacaaggaacataattcacatattcacaagcaggtaaagcactccatacagcgtgtaccatattttagatttcctccatatctttgtaaggtctgatatggggttaagcacaaagtgcttaattaatatttgttgaatgaataagcaaatattgttttgttaagaggcaatctaatagacatttgggctggccagggtattggaattccttggcttcatgtttctctaggaaggacctatgtaaaacctcactgggacttacttttaggaagagatgcatgttcttactgccataataatgccatcttggcacaagtgtaatacttaagagttaaagcattttcctttgcgtttttgagtgattccaaaacatatgccattaaaaccattaaaacatatgctttttcaaaacatttcaaatataattcttatttttgccctctgtttttgttatgggttaattgtgtcccaccacaccccccaaaaaagttggaaccctaatacctgatatctcataatatgagcttatttgaaaatacgagctttacaaaggtgatttaaatggtaaagttaaaatgatatcattagggtgggccccaatccaacatgattagtgaccttataaaaagaagaaatttggatacaaaaaaagacacgcacacaggaagaacacaatttgaagatgaagacggagattggggtgatgcatctgcaagccagggaatgccaaagattgtcagcaaccaccaaaagctaggagaaggcatgggacagactctccctcacatttgtcagaaagaaccaattctatcgacaccttaatttcagatttttagcctctagaactgtgagagaataaatttttgttgtttaagccacccagtgtatgctactttgttacagcagccctagagaactaatacagttcttttgaggctattatattgtaaaacctgctctaggttttggtactttctgcatgtgctaaaaaaaaaactagtgttcacggtgcaactgatgctcatctttttatcgactattaattgcttaacttttaccctccccctaccatgtgaaccaccaccttctactcataaatggtaatataactcagaggtatgttattgtgatggctaattttaggtgtcagcttgacttgattaagggacacccggatagctggtaaagcatcatttttgagtaggtctatgagggtatttcccaagagattcacatttgaatcaatgggttgagcaaggaagagctgccctcaataatgaaataagctaaggacctatatagaactggagatgggaccccccttttctccttttcttacacgtcagtactccaggatttacgactttgaactccaggacttgcatcagtagctgcctagattcttaggcctttggccctgtactgagggttatgctatcatcagcttccctggttctcaggcctttggacttagactgagtcacatcactggcttccttggttctccagcttgtagacaagttactgtggaacttctcaacctccataattgcatgagccaattcccatatgaaacctcctttcatatctatctatctatctatctatctatctatctatctatctatctatctatcatctcatgttggttctgtccctctagagaatcttgactaacaaaattattattattaaaaaataacaacgatggcagtaccatggagtgagtatttattgtgtgccaaacactgtgcaattgttcaatgttcattgcttcatttggtcctctcgataaccctagaaggtaggtactattattattcttggaagtttaaaaatgatcatctaagtcatacaggtaaaaagtggcagacgcagggttcaaacccagtcagtctcattccaaaggcttagtgtctgattactacgtataatctcctgtataaggagacactaagattcaaaacaggcttatgagttttgagctagatattgtcagcatttttaatgtctaagtgagtaaggaaaatgtaaataaccggtgcaaagactgtattaccatgagtgagggcaaagtctttttaaaaaatcaggtcctggagctatattgcattcgacacacctgttcttgtcaaccagaaggacatagcccaactcattaccaattcagaaaaggataaaataaatgcacactgggtcttccttttctgttttcttcatgtgtgtctctctagaaaatgtgtgtctctctagaaaaggcagttctactctaaagcttgctcctgtttggctgcaagtaacagatagagggaggcattgtcagagggtaagagtagctacacactgatttgttttaaagcacacttgatccttgaaaaaccttcaaacacagtaactcctggaaatgatgataaaaagacatgccttcttttcttctgtatttagaacaattctataattaaaagaaacaaacatatccatatttctaaaaacaagggatatttttaagaggggggaggggaagaaaagctatatcttctctttggaaatttccagggcattagtaatgggagtttactgcattttgaaatttgacaatactcttagctgctcattctccaaagcagaatctacacactgccaattaattttccattgtagtgttagttcatgcagaagccagcctctcttacttagtccctagtgtgattacggcatatgcctatgagattcctgtttgtttgttcatttgcttttgtggaaggaattccggtattaggctcatttgattggaccaaataaagctgatgacctgtgaacctgtgatccagtgaggaggatacatagagtctatggtttcataacagagcgttgcaatcaacccttcctgggaaggtctaccagtgactttggcttaccaaaagagctactagccttttaaattttggttcctccatttgtagttatagttcaagcagacacataataaaaagtctgggtatgaaggagggggattagtggttaataaggagacttggactcagacacatctgctttcttaccctatcttagagccgtgtgactttaggtgagtcactgagactctctaaacctactcctcaaatctgcaaaccagagattataattgtacttacttctcatgcagctaacaagataatggctagcatataataagaactcaataaaatacataaacatacacacataagctaataaggtggtggtctgatattgtgtatcctacagtggttagcttctattggaagtgacttcccctccatctgtaaatatgatacagtgctcatcctaagtctttttcagagacctacactggagctagcacataatttactgataaaggggaaaagaggaagattcatatagagaatagactgagagcctcttaggcatctaactgctcccatcccttgactgctttgcatctggaaaatttgcagtgtttaatatgctcctgttaaaaggtaatgcctttggaaaatatagcacttaaagctatgatcagttatgacttcaagattttcagataagtggttagggggtcatgacagagtagtgcctgcagcggggagccagtccttcacaggccagttggaagacatcaaaggttattcctatttcataattgttagtggattttagctatgaacatatgtatagcatttcctgaagtttcctgagaatcatctttaatcatcatcactactgtttcccaagcacccttatataatcttcttggtttatataaactaatggcttctactctgtacaaggttgcgatttgaaaaggcactgggaagaaaataccagttgcaaagggtggtggaggctgaagtcatgtcaacaagatcataaggctgaaaccagatatttgtaatgctgcttgtaactttctcgagagtaggatatatcttatatctcttctgatttatatagcacttattacaactccttgtacataggctgaaaatgttagtttaaataaattgacattacaaagtaggatttttttaaattttaaatcagagttgtgaggctgtgaggaaaacatgttctttatttgtctgagggaaagaattagagattgggagcaatttctgtaaccaaactttcctcaatattatatttactttattacattccattttcttagtcatttatgggccataaattcagcctctctgttgtttataacttaagtttttattttttaatttttgtttagggcactggttgtcacttctggctgctcattacatttatctagggagctttaaaacctatagatgcccagccccagccgtggaggctctgctggagcctggaaatcagactcaggtgttcacagcccttcccatggggagaaggatggggagttagggagagaaaggggtaaagagtgtgtctagcattgcaaatgtatagggtgagtctgcctagtatcatctggtatcacctatcccatcccactcagccatgggtctccttgccatccttgagcacatgaaggatgtaccctcattaatgccttggtgttggctgtttcctccagctgaaatccactttcttcagctatttttgtggctggctgcttcttttcatttagatcttaattcaaatatcatttcctcaggaatcccttctctatataaagtataacccttcccctttcactttctatcctgttgctttgttgtgtttactttgtgccatttcctactattggaaattatctcatttatgcaattctttacatatttgttgttatactcacctactaacaggacaccgtcatatttccagaacctagaacaatgcctgatgccccaaaagcttgaagtatacatttttgaaataaaaaaaccccggggttttatgtttataacaggaaagacaaatatgtgactagacattgctaattgacctacggtaccctttctcccagattctgtaacatagttctcagcaccattctcagttatccatcattagccttcagatggaaacttcttttatacccctggtttaaaaagtaattttttgtacctagcttatttcatttaggaaattaaggctcaaataggtttagcaaattttatttttttattctttcttttaaatcattcacttcacaatacttattgagaatttagaatacaagaagcaatattttgtacaaggttttgcccaacatgtctccagaactttgattttgtgctatgcttggtcataatatatttttcaatatatatttgcagaatttaattcaatagagagcttaaaactgatttaaattactttatgtaaggcatatatgacaaatgtaggtgggatgattataatgtagattataggatcgacttagaggctgaagggatttcagattatctattccaggaacctcattttgcagatgaggaagttaaaaaccgagatataatagtttgtttttcatgcatgcttgaaggatgaataaaggactgatggactgaatcctgctgaacgttatgtgagtttttttgtggcacagcagatctctgaacccagttcttggtccagggctctttcatccccacctgtgatccccaaatgcatgcaattagaaacatctggggatattgcaaaacatgctgggaatggtgttctgggactcatatttttataatccccttcctccttaggtaattctgctgcacagccaaatttgggaccactatgtacgtgatattattagtatatgaatgtgcctcagttttaactgaagagataaggaggttccatataatgtatggagaataccatttgtaggactttcaaagaaaccctctactttttgcttagctacacagtaccagtctgagctaaatctcaataaactaaagacttgcttctgacatttaattaaatccaacagttattgactatgagagataaaaaatgaataagatatacttcttaatatagattatttaaatcctgcttaaatagaggacaataaattacagaaccttgatattcccctgaattttagatactcatgatttgttgggctgtcagcaatgtgtcttataccttgcaaggtgcacagggatgtttgatttgttctgatttactctcacatgaaagtatcagctttttcacttaaactgtcatggaattatctaccagtactcaaagtactctttcattatttacattctctggatgattggaagaagaaatggaaaacaagcatcatatattttctctcccatattttcagattgagcagtgatatatttcattatataaaatataataattataaaacagatttaatttttctatggaggtagcaagctgtttccatagcaagctctgcttttcctgaccagctttccctttctgtaccttatattttatccaaaattatctgtcagcagtaaaatattctatccatagacaattctctatatgctcttcacagaatgttcagcctaacatagtttatgtcagggggcatagacattcatttctcacatttatggagaggagaaagggaaagaaacattttagacggttgttagactccaacagccattgggagatccaatgtacactgggtgcaatatatatttttatatttgttttttaatgctctaccagaaatgttttatagaaagaataggacaaagattcaactgacagaacaacatatgtgtgtataatttttccccagaggaaaaaactagggattttaaggagagggaagtctgtgtcattgttagtgtcagcgacagttgtctctcttatctgctatggcagggaagatgcaggggtgggtgtggagggcaagtgatgggtgcgggtaataattgggggtggaggggagctgagtgctggatgagtgaggagataggaatggggcgatttgccttgggttcacgctaagcttccaataaatgtaggaatctgcatttcttgttcatactgtgttacgggcaattaatacagcacctggcacatatgagctatttttttaaaacatgttgaataaatgtatacttgaaaatgtatgttgaatatctgcttacagaattatgccatactttttgggaaaaattaaggttaataaataggatgagtggtatttagatgtgtgtattgcttctagcataatattatggatacaactggcacataaggaagttctgtggcccaacctctagcatggatgttgagttaagtcttacatattttaatattttaaatacatttgaaataactaaccacacctttttttaatttttaggaaagcgtgctcttattttcattttccattaaacaatttttcctgagaatgagaaatttcatccaaaatcaaagttattccaaaatcatgactttcaattcctaacatgtcgtgttaactttattattctttcttttatagatatcaactcttggattgaaattttaaatgcaaattcaatgagtctttcactgagtggtatgtgtttgtgtttgtgggaacagaattgaagggctggggaggtgtgcttcttttctgacagcacgtaggcagcatgtagagcaataaataatttccctcggcagctgtaaagttgggtaatatgtggttttacatttataaatcaaatggaatataaatgattgccaactaaaatgaaaacataactgtaatgaaataacttgaggaaatggaagctggattgccagtagggaaagaaatgtgtatttactttatttagtgaattttaatgaattgtatttatacacatatgcttattaaataaaaagtcaaaacaattgaatttactcaattactaaattgatttgaagggaagcagttagagactaatcagtgagaagaaccctccaactgattcattggttagttaacatatttactgtttacatgaattcagtctcacttaaaaccatacaaagaatgctttcaaaaatagccagattagaactcatatttctcatcttggtggcataatgggaaagttgacatgtttggaatgcagtatctttctatataattagctattttaaaaagtttatttttctaaaactatctcacacaggacaatctggacacagagaccacaggttctgacatttacagggacacacaggtgaggctacaagggtaactgtgcaagaacctgagtgagtgggaactggcaccctctccagccaactgtggtcatgggagaaggtagacctgctgttgccaggtctcttatttaaagaaaaaaatagaaatcagaaattgtatgtgaaacgtccctgtctttacattgcagcaactaattaattttttgaaacaccatatagacccaacaaagcctaactgtgcccaagctgctagtttgagagcactgccttagatagtcaagtgtagtggcaagaatacaaccattagaactggacttcctgggttctaactaagcaagaatttaatgtcgaaccttcggcatgtcacgcttttactcagggccttctcatttttaaaattagggatttgtgccaagtgatatgtaattgagtagcttttaaactttcgcaacatctgtgctttcacaaggaacagtaactgatcttcagtcattaacattttcgttttcactgtgaactatgcgatttctccaaatatttgaaatctgcctactattggcttctctgagagttgtttatgaacatttgttgaaactgaccagagaaaatactgtcaacttgtctctgagtctaagcaaattgttagcagagtttcagtacttggctatctcctgctgtagtaaacatattaataagctctcaccagaagaactgtgaacagatgcagttcttgaaaacacagtgtccttgtcacatttacttgtctgtctctcctagtgagcaagccttgcttgtggtatcctagtaaatattctgttttttatgtcatagccagatcatagttcaattcagtacaaaaatcactgtaaccagtaactttgatacacagagcctaagtcataagggaagatacacaatgccatgtaatgagaagactttttatctttttcatcctgtcacacaatttcttgtattctgtgacacaattccttggagccagaaataagaatagtacattgcctttgtagccacttttcaatgtagaacttcagatgcttcaaatacgataaatgcctctacacaacatcttgtatcataaattgggaactatccccagtgtagcggaataacctaggcatcacacataagcacctctgtcttcactgataactagctgagtaaccttgaaaacggcacacctttttgaatttccattttatcttttataaagatgctacattaaaaaatgtgatagggtagttgagaggatcacaagaaagcaattagatatgaaagtgctttgcaaaaacatagagcactgtatatcagcgagataacataccaatcaatctcttaactcattcaaacataaggaatagaagtacaacttgaataaagcagcttgttgaatcctaaagaattgcataattctttgggatttggaattgacctccttgttctcttctaccattccttctttccccattttaaaccatgtcttatttctcaaccatttaattaatttgtgacactgagtatatggaatcaaactcagaatctcagagaaaaagatttgatatgttccctgaagaactctaaagaagattactttggtttgactttttaattttttttaagaaattttttattttcattgggttttggtgaacaaggagtatttggttacatgagtaaattatttagtggtgatatgtgagattttggtgcacccatcacccaagcagtatacactgaacccaatttgtagttttttggatttacttttttaaaagagttatatatttaatattcattttttccgtctctctggacttcttccagtttttccacattagtgttaaaattgaggacttcgggtgattgtaacatcacatacagaattatgtagataacgagctgtcatcttctttttgcgtattcttacatgataaacagtttcctaagtttctacctagtctcagtattcatgatttagagtggtggcatgatattctataactggctatacaggtgtacctcagagatgttttggattcagtcctagaccactgcaataaagcaaatattgcgataagtgagtcacacctattttttggttttcagtgtatattaaacttatgtttacactatactataattttttaagtgtgaaatagtattatgcctaaaagtgcataccttaattaaaaacagtttactgctaaaaaatgctaatgatcatctgagctttcagcaaattttaatcttttttggtggctgaggtcttgccttgatgttgatggctgctgactaatcagggtggttgttgctgaatgttggggtggctgtggcaatttcttaatataagacaacaataaagtttgccacatcaattgattcgtcttttcattaacgacttctctgtagcataccatgctgtttgatagcattttacccatattagaacttgtttcaaaattggagtcaatcctctcaaccctgctgctgccttgtcaactaagtttatgtaatggtctcaatcatttgttgtcatttcacagcatcttcaccaggagcagattttgtcttaagattccattttcttagttcatccagaagaagtaactcttcatctgttcaagctttttcatgaaattgtattaattcaatcacatcttcagcctccacttctaattctagttcttttattgtttccaacacatccgcagtgactttctccattgaagtcttaaacctctcaaagaccttcatgaagggtggaatcaacttcttacaaactcttaataatgttgatattttgaattttgatcttctttagtgaatcccaaatattcttaatggcatctggaatggtgaatcactttcatacggttttcaatttactttgcccagatccatcagaggaatcaccatctatggcagctatagcttcatgaaatgcatttcttaaataagacttgaaagtcaaaattactctttgatccatgggctgcagaacagatgttgtattagcagccatgaaaacaacattaatcttcctgtacgtctccctcagaactcttgggtgaccaggtgtattgtcaatgagcagtaatattttgaaaggaatcttctcttttctgagcagtagatctcaacagtgggctttaaatattcagtaaaccatgctataaacagaagtgccgtcattcaggctatattgctccatttataaagcacaggcaaagtagattaagcataacttttaaaggcctcagattttcaaaatgataaatgaacattggtttcaacttaaagtcaacagttgcattagcccctaacaaagaaatcagcctgtcctttgaagctttggagctagcatcgacttctcctttctagctttaaaagcccaaagctttatgtagtttgtctgcattcaaaatcacttgtttaaagtagtcactttcatcaattatcttatgtagatcttgataacttcctgcaacttgtacatcagcacttgcttcttcatcttgcactttgatgttatggatatagcttctttccttaaaaatggtttctttcctcaagaaccaaccccttctagcttcaaacttttctgcagaatctttcttacctctctaagccttcatagaattgaagagagttagagctctgctctggattaggcttggcttaagggaatgttgtgaatggtttgatccttccagatcactaaaactgtctccttaacagcaataaggctgtttcactttcttatcatttgtgtattcactgtggagtagcacttttaattcctttcagggactttttatttgcattcacaacttggctaactttttggtgaaaggggtctagcttttcacttatcttggctttcatcatggcttcttcaccaagcttaatcatttttaacttttgatttaagaggaagatgtgcaactcttcctttcacttgaacacttagaggcaattatataggtttctgtgtttttttttaatttttatttcaggctcaggtgtacatgtgtaggtttattatataggtaaatggcatgctgtgggaatttggcgtacagattatttcattgcccgggtaataaggatagtacccaacaggtagtcttttgatcctcaccctcctcccactctccaccctcaagtaggccctggtgtctgttgttcctttctttgtatccctgtgtactcaatgtctagctgccatttataaatgagaacatgtgacatttggttttctgttcctacattagctcacttaagataatggcctctagctccatctacattgctgcagaggacatgatcttgtttatttttatggctgtatagtattccatgatgtatatgtaacacattgtctttatccagtctatcactgatggacatataggttggttccatgtctttactattgtgaatagaactgtaataaacatatgcacatgggtgtctttatggtagaatgatttatattcatctgggtgtatactcagtaatggggcagctgggttgaatggtagctctgttttaagttctttaagaaatcactgtgctgctttccacagtgtctaaactaatttacattcccagcagtagtgtataagtgctcccttttcaccacaaccttgccagcatctgttattttttgactttttatagtagccattctgactgatgtgagatggtatctcattgtggttttgatttgcatttctctaatgatcagtgatgttgaccaattggcctaattgtactattattgtgtctcagtgaaaggaaaggcctgtggagagggagagagatgggggaatgccgaggcagtagagccatcagaaaacatacaacatttattgattaactttattgtcttatatgggcatggttcatggtgtcccaaaacaattacaatagtgacattcaggatcacttatcatagatcatcataagagatataataataatgaaaaagtctgaaatactgcaagaataacccaaatgtgacagagacacaaagtgagcacatactgttggaaaaatggcactcatagacttgttctatgcaggactgccacataccttcaatttgtaaaaatgcaatatctgtgtttgcacattgatttattgtgcatcacagatattgcattttgaatgcctgtactgaaatgccctttattaagccaaaattgacaaatgggacccaattaaactaaagagcttctgcacagcaaaagaaactatcataagagtaaacaggtgacctacagaatgggagaaaattcttgcaatctatatatctgagaaagggctaatatccggaatctacaaagaacttaaacaaatttacaagagaaaacaaacaaccccatcaaaaactgggtgaaggatatgaacaaacacttctcaaaaaaagacatttatgcagccaacaaacatgtgaaaaaaagctcatcatcactatgatgatgagtgatgagaaatcactatgatgatgagctttttttagaaatcgaaaacaatgagataccatctcatgccagttagaatggcgatcattaaaaagtcaggaaacagcaaatgctggagaggatgtggagaaataggaacacttttacattgttgatgggagtgtaaattagttcaatcattgtggaagacagtgtggtgattcctcgaggatctagaaccagaaatactatttgacccagcaatcccattactgggtatatatccaaaggattataagtcattttactataaagacacacacgcacgtatgtttattgcagcactgttcacaagagcagagttggaaccaacccaaatgtccatcagtgatagactggataaagcaaatgtggcacatatacaccagggaatactatgcagccacaaaaagggatgagttcatgtcctttgcggggacttggatgaagctggaaaccatcattctcagcaaactatcacaagaacagaaaaccaaacaatgcatgttctcactcataagtgggagatgaacaacgagaacacatgaacataaggaggggaacatcacacactagggcctgttggggggtagggggctaggggagggatagcattaggagaaatacctaatgtagatgatgggttgatgggtgcagcaaaccaccatggcacatgtatacctatgtaacaaacctgcacaatctgcacatgtgtctcagaacttaaagtataacaataaaataaaataaaataaaataaaataaaataaaataaaatgctgtttgttttaagaattcaggatgtttatagtttttggtttgtttttgtttttccttcaatttatccagtactgtgcatatatcttttaaattttgttttattttctcatcctttctaatctatttttgttctgtattcaggtttctccacttcatcatcaatttatttttctgtaatgcctattttgctagttttcttcctccagtgtgatttgtttttggtcgattactctgtttttcatttgtctacaatctgctcttattctggcctgccctcaaataatacctgcttgaaaacctcatttttgaacattaagtagatattttctaaatttattttatatttcttcaaaacactatttttgaggttctccctcacccttgccatgcctttacagagtttttcctttatttttgtgctataaatgttcttttatggatccttgcaggctattttttctttttccttcgcattcatctttgagtgaggctaagtccaatcggatgtgatagtccaaagcaaccaacagtcacctttgcttagacttttcttagagctaccattgtctgctcctctaagagcaacctcctctggcagatttgaggttggagagcaggctgatttcagcgcacccagcataggctccagtgcaaagtaccaccagagcagtgcctcaacaagttttagtttatcttcctggctgtgaatgaactaattagaattcaagttaacgggaaaattttttgaaatgggttaacagaactgtgattgctagttatgctgtttttaatcgagtctcatcaatttggtagtttgtagaaatgttgattagattcagcattgaagattattgaattgaatattcaattcaacattgatattgatgttgaagattattttatttgtgttaattgctttcaagacttactaagattttttctcaaatcagacattttcttggacatcttaataggcatttgggaagggagatttcttacttttattttcttgtttctgtaacttagtttctacataataaaaaaaaccagaatttcatttgtttgcttttctatgtcacattgtgatttttttttccttatttaattccgtatgcacagtgaaaacaggtcatttcttaaggctatagtttaggcttttgagcactgaagccattcatagactgcatgatattaatactatatattaatatcaacattatgaatccatatggtagctcttctgttgcatactgaagtcatgggcagtcacacatatcagaatcattgcaaatcctgtattaatggaataggagttcatgatatttaaatatattgcatactcaagtacagccaaattattatctatgctaattaagagatgcaaagtcacagaaatacaatgaaatctggaaactatgcattattttggattcatttgcattataacttttgactttcttcatatttagataactagaatctctcctaaacttacatgcaaattaacttggattttctgaaaatataccaattgcctaaattagcatgttagtttgcaacaaaaaaatagaaatccaggatatataattcgaggtagataattcttaaaatagataatccacaaatagttaagaattagcaagtcttctttatgaatctgtaaaaattcctggcgtgatgtgcatgtgtgtgcacatgtatatgtttatgtgtatcaaaagtataattaatgtaaggattgcagctgtgtattttccatagtgttaagttgaacaatagaactattacctggttttcatcttaatactttaagtctacttttatagttactttaacctaacttaaaattatttcataaataaatacattaaccaatatgaaatttaatactaaaccctgcaattctgtaccaatgttttagccatgctttctccattttcagaaaatattaaaacatatgacaacatttgtgtccaaatccatttggattattctttttgctaaaatatgataatgcttttcctgattatcagtatatagtatctgttctacttccttgatccactaatttttaatttctcacaaagaaatcaaaataaaaaacaaggggtcagatttgttctttttttttttcccccagctactggagaggttgaggcaggagaatcgcttgaacccgagaggtggagcttgcagtgagccgagatcgcgccactgcactccagcctgggtgacagagtgagactcagtctcaaaaaaaaaaaaaaaaattttgttctttttatatcttctctttttcttaatgaatatttgatgagcctaatagttacagaatttttttcgagattgagtcttatacttaacaaaccatcaatatcatcaatatctaaatactagatggcagtttgcacactgttttaccttattgaagataattgtcaaagttgctagataatcttcaaagccttgaatttttatattgatttacacttaaagtttttccttataaaacttttaatattaaaaaaatataatcactccctaagcctgtgtcatctttcagttatgaacccttccttgatctctaaacaactactttaaatgcaggagaaagccttcttaatgtgtaccctgtaaaaaacatattcaaaattttctttattattatgttctctatgaattcctggtgttgattttggaggaaaatgtaatggtcttgtgctggtgtaggttcaggctatgtgtgaaccacgttcagatctagctgtactcagtgtctcaaaaccacattaataggtagccctgcaaagtggtaatgagcagtttctgaacgcaggtggcctttggtccaaatcctgaccctgccacttaccagacaagttcttgaacttctctgtgcttccgtttctgaatctgtaaaatacagataataatcatacttatcttttagggtaattgactgacaagtacatgagataatacctggcacacagtatattgttacagagtttgccaccatgattactacccattcagtgcaagtgaggtaccctatataaactacatagcaaaacaggacatgtgatgctgggcctgagctgttcagccccgtaaacaaggatagaagcagggtagacccctcctgatccacgtggaatgagattttcaaagtaaaagaagggaattgtccagataggagaaggcggaaggaatgttgggtaagtacaagcaacagatgtccactccctatggggaaatgttgaaggaatcataaaggggaaaaagattgtattgtcattttcattagcagaagtactattttgcaaaagagatgttagtcatgctccatgtggttgtataagttcagaataggacatgcacataagacaggcaagaagtcagattcccatgactcaaaggaaaaaaaaaaacctgatcagaatttgaaattgaatgaactgtattgtaaggctgtgagatgcatgttgcttgagacggcttttatttcttattttttctttttcccttttccaacttttattttggaaccagggggtacatgtgcagatttcttacaaaggtacatgtgcatgatgctcagctttggagcacaaatgaatccgtcacctaggtaagagagtatattacccaacagacagttttttcaacccttgtcttcctccctccttcctctctcttgtattccccagtgtctattattcccatttttgtgactatgtatactcagattttagctcccatttataagtgagaacacatggtatttggttttctgtttctgcgttagttcatgtaggataattctttccagctacatccatgttgctacaaaggacaagatttttttaatggttgtatagtactccatgcactacattttctttatccaatccaccattgatgggtacctgagttgattccatgtctttgccattgtgaatactgctgcaatgaacatatggttgcatgtgtctttttggtcgaacagtttattttctttggggtagataccagtagtgggattgctgggttgaatggtagttgaactctcagttctttgagaaatctccaaattgctctctatggtgaatgaactaatttacattccaccaacagtgtaaatgtgctcccttttggaggaagtttttaagcagaggtctaaatcactccttagagaacaggttttacataataatagacagacaggcagagagagagagagagagagagagagagaacacagtaaatgcatagtaaatatgcctaaatctatgacttctacaaatgtgggacatttagggaaagagctcagatctttgagaacttgctctgttattaatggttgtatgatactcaatcttccaaatttctagtaaaaatgttaacatatttattcagttcttaacttttctaagctatagtctggatgtaattttatttttgtcttcacatttaaccacataagtataatccatgcttactagagagttcagaaacatagctaattctcaaaacccattttagttaatatttccaattgaactggtgagtttctgtattatacccctcactctggcattaatgaatttcgctgagagaacaatttgattgattaattgatctcacgttagcaaaataactaaatttgctcgtcagcaataagaaaggctgtattccttagagagtagcacatgaattagaaacttggttatttgtctattgcttatttatgtttccaatatgatatatgccttaaatctcctgtgaaggtaggcagtgtataaactaaatttatgttttattttagacacattccaaccactattattgtaaagtcttagacatatattttacttctgggtaattatttgacagtaatttagagagtcaattactaaacatataaatatccttctgaaatctttaaatttttttggaatggaataggacagttaaagaaattaactattatgcttatctaagtaggaaagagttaataaataaataaccaaacatgatccttagtaaagtaatttaaagtaatcttaaactattaaaatgatttcaaaatacctatctatcacaagttcattgttatacaaataaaagcctaagataaggactgggtttagatttttcttattttttaaaaaagccttcttacattcttaaaaaaacaaaacaaaacaacaaaataagtttccaaagataaagactttgaaagagaattcctcaagttattatgcaaataattctcaaaatgttgtgaaaatagtttcccaaacctgataagtttatattgtgacgtgataaaatgaaatataacttttagaattctcataatagagaaaataatctggctttatctttcttttcactgattttattttgatcagctctaatcacgtaatttcagggttttaggggaaaagttgtaatgcgctttgcattttaaaaggtcgcttatagcttacctacaaaacaactctgatatttggcaataattgttagaattcatggaatgtgtagattaaatatcattgaaccttcaaataatttttttttttttttgagacggagtcttgctctgtcgtccaggctggagtgcagtggcacgatctcagctcactctgcaagctccacctccggggttcacaccattctcctgcctcagcctcctgagtagctgggactacaggcgcccgccacctcgcctggctaattttttgtatttttagtagagacgggttttcaccctgttagccaggatggtcttgatctcctgacctcatgatccgcccacctcggcctcccacagtgctgggattacaggcatgagccaccgcgcccggcctcaaataattttttaaaagactttgtcattgtgttaaattatgtctttgcatccacaattttaactttattcccccattctcctgagggtaaaactaaaatctgtccacaagatagagagagaagaccaaggaatgtggcaagtcatgaggaggctccttaaatttcaggccagagctaatctacagaatgaataatcaggtaattgttaaatgatttgtcttggaaaataataattgctacaaacctatggtacagcccatccagttgagagtaatattagaaaagcctcatttatttcatgaatcagaataaaggcaaaaaattggcttgaatgtcttgaggacaattaaaaagtagctaaatgctactttgtgattttaattacttatctgaacaaaataaaatttttacgtaatagcacctcctcatttaaaaagctacctacttaatccaacaatccttgaacatcaattgatacatatttaaaaaatcatactttgaaaatgtaagccacatttccttttaaatttttaatatgaaatttatgtttcagattggctatgtgaatttttctgcttcttgatctatgtgtttgttatgaagcttctaaattcctaaatatctgaactgttaaacttatgatcttttgatgtcagtggtccccaaacatcaaatcacattttgacttttgaaatatagagattatcagacttctttgtggacctattgaaggagaatatctaggagttgagtcccagcattctattgctttttatgtttccttgtgactgtgatcacttatatttgggagaccttgatcctgtacaacactgagcatctctgaacttactggttattttgaacattttattcaatatctttcatcagtttgtaagcttctgaatggcaatgctcatattacattacattacattacattatgactgagtttcaaaaaatcttctaaagtaacttttatatgttaaatattttaaaaacttatgaccatctctagattgtgttatgagtaataggaatatgaaatcttttaaaaatatacagataaggttttgatatgtttgaaatgtcttttattttatttgtaattgttaacatattattctgactccctggaggccagttttcagctgtagttggtacccgatccataaaattcttttcaaaaagtccatgagttaagtactcttggctgtgtttaaataacactgtcaattccaagttgaatttaaaatatgccacaacattttcatatgatgaaagattcctaacattagcttaagaaagttatgaaaactactggaaagccaatgaagcaatctatgttgtgccttttttgtactaccaccactatcatcaccactatttctatgaccactattttttactatatgctaaatgctgtgcaagttgttttaaatatacaaactcattttatcttcataacgactccactcaggaggaagaaattgagcattagatagtttcagtagcttagccaaggtcattcagctataagatggaggagatgggatttaactaaatctccacacctttatctcccataataaataccccaaaagtctaataaaaatgtttatctgttatgtgccaatttctgtgtttggctttggagaaaccaaaataaatagaacctggttgctgcccttgggaagcataaatctcagaaaagtttctgaaaacacttctttatctttcctccagtgctcttaaagtcatttttttttctctaacaagtttattgctcagtggtggtcaccaactccatttttttaatgttatttaaaaatatccaagaaagctgtcatacagctgaaagtatgcagaatataagtgagagaattacattaggaaaaaaactgggcacattttgagcactcaatacgcatgattttattgaatacttaggacagtcttatggtatgcgctttatataagatttatgaaggggaaaaatgagactcctagaggttaagagatatgaccagacttgtaagcagagatgctgggatttcagtcttatctagtgatatccaaagcttttgcatttccaattggatcacggcatctcccacgtagttttggtacctgatttctagtctgggagaaggttccctatggaacctgaggtttatagagcagcaaattttcctactataccaggtagattagtagaatctatgttaaaataggttcactgtacaaatatataaaattaagaggtagcaaaaccagacttaaatacatttggttagaaatccttccagtaaggagtgtttcttaacctattttgtcaatttttggcagcagaatcatgaccttactagtcattcaggaatccacttgaattatcaggaaagacttcttagcttgggactttacaataaaaatattagttgaaaatggctaaacccacaccctgtaataaccattaacacttcactgaaacacaataacttgtagtaattaaagtactacaaggcagtacctattagcagtataaactgctaattttaattcactaagaaactatcgaaataattagcctatggggcttgggaatcacttgctttttgtgtatctggatttctcttccaaatttgcgagtcattctgtttgatcatgctgttcttgtctcatcttggtctgcttctttgcatcaagtttattattacattgacaggaatttcttgggttttgtccacgtgattattattcaaaggtcacttaagtatagtctttgtctcttctctttaaaaggaaaccttctaagatactttctgttaggcagcttccgtctagttctctttgctatagtgcactagcactagcactgtgctgggttgctacccgcggcctgcatattcttttctgtggtagaaggaagagattttactctgcttattttctggtagaagaagaaattccagatagaaatctaagctagaaatggatctcctgttatcaagaaccatggatgcattatcaacttcatgcttaatatagttatatatcttcacttacttaggcagttttactctttaatcatatttctcctaaaatcatgtaggcttgaaaggcaagactttttggaagagcatggtttctttagaaagcatgaagcattactaaaatctgttactttttagttgtctcatcctgggtctctgagatggagattagcctgcaggaaacttaataggaatgtttttgagatccacacttattagggatgggaaggaagggagacaggataaggtaggggactgtgatacagtcatgataaaaccttgaccaacccaatagcaagctctgaaactgaaatactgtacccatcagagctgtatttggttagggcaaggagctgggcctttaatcctgtgtgtttaccagtcattcaatggaggctgctactgaagttagtatgaccttggctgaggcaactttttcaatggagggaattctggaaacaaattaacagctgagagctgtcccagtagctggggaataaatccctcagtgctaaagacaggatcttggcagcacaatgcagcattcgtgacactagtgtttcatgaagaggaaataatgacatagattaggccaatctgtctcaaccatttcaaatcattctttttgataaacataaagcattattttgatagacctccctgaggaagcagtggtgttgctctggttgataatctgcattctttgtatctatccgctggacaagaatacaccctgagccctggtatacattaagagatacttcttttcctttgctttccttctctcttaattgacctgctcagatacttccattagggcatctgagctgtaacatttcctaatacttttctgcaaaatgaccaagataatatctgtacagtgatgttgtgatacccctccctcctttcatgcattattctataatatcctgcactaaatgctcacagaagatcaagtgattgatgtataaagaagaaccaatggataaaactttttactttcaaaagtttttagcaagattccacatcaaaagcaaagtatataaataaacaaaacttaaatgttattgtcctgaatagagtactaattctttttttactgtatatatttaaggtgtatgacataatttgaccatatttgtgaggtcaaatggcatatatagctattagatatagattatataggaatatacgttgaaatatggggattattaatttatgccagatagaggaaggaagagattgtgtgggtgaaagaattaattataaagcaaaagacaataaactgctaaggtttcaaaggaaaaattggtgataaaagcagaaactgtctataaatttctgaagacgcttgatatattctccagcaaacattcattaagttttcttgatgcgctgtgctatatgctaggtgcctgggatatgaagattaataagaaatgggacttgctgccaaccaaattactatttagtggtaatacacagggaagatgtgcacaggggtctcagtggccacctgaatatgtatactcagatgcttacactcttaggtaacgctcctcaaactttcccagcttctactctatctttttttggggggagatgatgatgattataggttagttaattatctataaaggaaattgaatattatgtaataattataataacatatctcagggtgtgcttattgggacgggatatgtattactctgattgcagagactagggagaaatgatggatctgtagggaagaagataaactcatcagcatgccaaaccctacggtagtttgttgtctttgttggctagaagggggctgaggcttaagaagtcaaaacattttcaatgtgggttagaacacacatagttaaagcatactttcttgtaaaaggagaggattggactttaaagtaaggcatggtgtagtaaaatgtggatctgagataagagtcaaaagactctaccacttgtttgctatgcaaatggccaacttgttaaactttacttttcatttgtattttggtactaatatttggcctatttatataagaagaccaaaggacacaaccatatacaaatataattttaaaacttttaagtataatgaaaatgcaataaattataaaattatagattataacccaccaagtgtcatcaaaatccaagtggtattgtagagtgttgtctgcaaaactggtaatgatgggggaaatatgacaaaaaactttacaagtattataagtgataattaaaatggccacaagaatattaggcattatttggaaaggcacagggaaaaatagctacaactgagcaaaaccttgtgtatctgtatctggaatgatgaaattctggaattgcattgtgaggaaaaaataaacgtgtggatcacaaaagtaactggccacgaatgtaatcaggtaaacgtagagatgtccatatgtggagaaaaaagagatattgacactatttagaaatattgatcctaaatagtctcaaaaaatggtagttaacataatgtatgaattcaagtctataaaaatcaccaagattaaggatcatgtgaatgttttatcagtacaggagtactggatttgtggaacagctatcccttgatttctgaaagagataccgagataaaaagacctgcttaacataggaggtcattatcctgggggaaacaatgtaccaaatgttgatggatgagagatatcaagaccagattgcctcacatttcttctcctcctccctagcatggggttggagtggtgtgggcaagattgtgcagccttcatctcgaaaaggttgcagggtgtacatttctgtgattttgcctggttgtttcctagtcacctgcttttccacaggaggagtttaagaagagtaataaggatgatgatgtgtgacttccgtgctcccttgcctctcagtcctcaggcatcccccatgcctgagaactcacagggttattgagattccctcaaattcagagtcacgaatctgtgcctacattagaccccacccagagacctggaagtcttttcgtctcagaatggatttgtcagtcgtgggatattttgtgagcatttctcctgtgcccaggattgcagtcacctttggcttgggtagccacttcctggcaggtttctttattaataaattgttgtttgcttatagaagttagtctcaaatgaatattgcccaacaagccttattcttaaatttctttggccccttttgcttttggctgggattacttggactttttgtaacaacaatttttattgaatactagagagtcataaatccgacacaaatatcccacaggcaatgcttatttactttcacataacagtttaatgactttaaaccatggttctgtgacaagttagagaagtccaaaatacctgtgcaaattacatataatcaagggctgtggcagcttagtgaaataccgttatgctgccaaataagagcatttaattcatagaaattacaatttgcttttctatgcctattttacatctttttgccttttatcatttgaatgaggatcaattttccagagttcatatgctatgaaacaatgtaatcatatatcataaactgggtttctttgatctcagtgctctgttgcttcctgatagtgttccatcaaaaagaattagatatttgccctttgcaaataacaaggagatatttgatatactccataaaagaagatatattattaccttgattgacaaagcaaactcacagcacaattattgttagaaagcccagtgttacactctaaaataataaaaagcacaactgttccttatttatttaacaaattattaattgatcatctactatgtgtcagacactgtgctagctctgacagttcatcagtgaacaaaattgtttgtcctcagagagctgatattctcctggaaaaaggcaataaagtaatagataactaaattgtatgatattttgtatgctaaatgctgtgagactacagagcagggtgaggatgatggggagaactggagtggattacattttaagtaaaatggtgaagatagctgcaatgaggagatagaatctgcataaaggactgaaagtgagtgtattagtttcctagggttgccataacaaagtactacaaacagaataatttaaaataatagaaatggattgtctcacagttgtgtaggctagaagtctgaaataaaggtgtcagcagggccatgactcctctgaaacttgtaggagagaatccttccttttttcttcccagtttctggtggctcctggcactcattgacattccttggcttgtagctgcatcactgcaatctctgctccatctcttcacatgggcctctattttgtgtgtgtctctgaatgtccactcctctttttataaggacagcagtcatattggtctactctagtgaccataatcttaacttgattaaatctacagagaccctatgtctaaataaggtcacattcataagtactgggaattaggacttcaacatatctttgttgaagatcaaacaattgtgtccctgtgggggacaaagttcaatctataactatgagataattagcaatgcaggtatttgtgtttggggtccagggaccagtacaaaggagctgaagagggtgcatgactggtgtgtttgaaaaacttcagggagctcatttatcttgcatagggttagtgatgagtcgaatagacggcatgaagtctgagaagaaccaggagacagcctggtgagggacttgtaggccactagtgatcttggctttttaatgcaaagtggaatagggagctttagggatttgatttatgtcttaaatgcttcactctgtcagccgtgttgagaataaattacagaggtaaaggaagatgcagcgaatgtgattagaagcaatctgatcgcaatattccagtgaaggatgatgtgggcttgggtcagggtggtggcagtagaagtggtaaaaagttactggatggattctgggtagattttgaagatatagctcgaaggtttgctgattgtttggatgtaggtgtgagaagggagtcaagggtgaatccaaggattttgacatgagtaaccggaaggatggagttgcactgagtgatatgcagaagccagtggagcaagtttggaggcaggattagaagccccatttaggtcatgtaatgtacaagatgattggagtggagaggttggatggtcagttttgcataaacagttgaagttgaggtgagagatctgacagaagagctgcctcttgctagatagtatttgtgcaaattagcaccaggcagttcttcaggaccagtgactctctgggtcaaatacattaacccagcttctcctttgcctgaaagtcttcaggctgtgttatccctgcgtataccctccgtgggaactatatccaacaggctgcttctttcttcccttcttcacaggaagccaggtcctggctttttatccctctagtcagaatgaccttggacaaatctagagagggtaggtgtgtaaaggcagtggatgacagagactgatagtaggatatttcgttattttggaatttgaatgaaaaataataatttacttttctcattttcaattaaatttgttatggattttgtgattgaagctacagtatggagtgatggatacatattcaaaacaaaaatatttggggcctgattttccaatcactagacttgaagaccactgtgaattctggttcaaatacaaacatgagctatgtgtaccaccattgctaacgcacacacagacagatacatgcaacacctctattccttccaaattttatttggatggggcacttcctggtggtacaggatggttagctccaccttggtggtttcagtcagtggctgctttgttccagaggcacccttctgcactcctctccttacactgctttttctgaacttccctttcccatcttcaattcagcactcaggagacagacattttcctcaacacaaagacaaattatgaagcagagtggtgtggtagaacaagcactagctggactgagcatcacagatgtcaacagatttctgctgaactttggaaaggaaaaaaataatagccaattaccgactgattacaaatattggaaaattaattttttatctggatagtgaagggggaaaatcttacttagtgtttattaccaggcaattcagaataaatttccttatctttaaagattatttctaatttatctagctcattcatttccacaagtatttgctaaatgccctcatacaccaggccctggtatgggcatagaggtaattctctatttcactttggtggaaggacttggtctaagaggtcaagacagggcagaggcaactcaatgctggctctgctgcttcaggtgagccaggagggcagctaatgaagatggcagaaccagagtagatgtgaagctgagaaaaggaaggaaatgtagacagcccgataaaggtgcgccatattaaaatgagactcagttttgtttcagctcctttgacaaagcagatgttagcttagttgacacattcaacaaaatataagcaaaagaacactattggaaaaaaaagatttcctttgtcgctctgtgtgatgagaggagtaagcattgtcagcagaattttcatacgggctgggaatgtttcctagtgtttagtgtaacatcacattgacagcatcttcattattattcaggctgagatctgccggtgtgatggaagttgaaagacaggatttttgttgctaaattctttgcctgtgccatgtctgaactgccttccttatgtgttgtttttaatggcagtctgaaagacctcaagatgaataactcacttgaaatagcagctgtggaaatacattgttaagaaagaaagagaaaaagaaaaagattctggctgttcagcacaagtgctagctagaactggcatttggatatgtggggtccactgggcatgattgatagttaatatgctgggaaagaaatattaaagaagatgaaggagatgtatgtgttaccattccactggcataaaatgtggatatagaggttaagaaagactgattatcactagataatttataaatatatttggatacatatacttgggtaaaattgttctattattatttatagaatgttatacagtatttaaaatgaataatttcagcaggaacttaataaaacaatgcggtgggatcactttagtgattccaatcatgtagtttgttcttgtaattttacgatactgttagaacatagacaacggtgtgttctcctctctctgtaaataggctgtttctggccttccctttcccatccccaccatccccactgttgtaggaaaaaccaggttcttgtcacaccaccaggaaagatgaggctcgcagacactttgaagggtgggggagaatggagtttattgggcaaaaaggaaaaatctccacaaagtgggaggggttcctgttaacaggcccccatctcacagattgaatcccaggttagcacacaggaaccggaggggccaggctcctcctccctgctccctgcaaatctcatgaacttcctgaggcatcaccctgtcttcccagtgcacaggccagttggagatgatcaggggagccctttttacttggctgtctcaataccataatcattatcactgtggttgcccagaagcatttgttgcaatgcccgtgggctggacattaggttgagcagcatgcggtttcagaagtgatttttagtttaaaggcaacattccattcagcacctcggatgtgtgatatgtgagatccagctttgaggggataggtggggataagaaggccatctccattgagtgcaagagaggaaagggttaaagtaaaaagggggtactctgccaaagaagggaccccaaatttatcttctttattggagcagatggatggagaacagcttttgtgtttgtttttaagttgttgaaactttataagaaacacctccattagtaaaaatttattgtcctgtctcaattatcgaaaagatgatacttttctttaactctatgagagaaaactttggtacagatgagagtgtgtcgaacctccctcctcccattttgtatggtacctgggcatggagagcaagtactccaaggtattgaaatgtctttttcttcctaagcagtcaatgaaagagccttgtcttttcaatcacgagaatatagaacattagtggctcatgaaatgtcaaaaatgaaaaccagactgatgtttcataaagccaggcgttgtagaggaactatcagtggaattttcattttcattgcccgtgcaggcaaatccaccatatctctttaccactatggatgggttaagaggttgttaaaggtttaaaagatgcctggatttcattttgtattttgctctcatcctcttcagtgaaaatggggcttggaaggctttcagaattcttcactataggtttgccccagtgacaacccataattttaaagtgagcatgcactggcagattgtcaccaataaagtaggtaagtgtgagattttggtggccgaaggactcggagcatcttcaagaaattattagtcagaggcagctttataattttcattggggatggtgatttgactctgttactgtgtagaagaggctggtgtggagggtgatatagcaattaagtttacctaccatgttagaattgtgaatgtaagaattttatgtacactagcctatgggttgcataataatactttcaaatattactttcctcttttttcctcttctgaatatgctgtcttctgccttcactgcttcaatgaagggatgatactacaaaacacaaaaacagagaaatcaggtcttactttttgtgtttctaatgcctaggtcctggggagacaggatgtaaaaatacacgtgacacagggagagccagttcttcattcctcatactagaaaaggtccttaactgatgagagaagggaggaagttacaaggtaagcagaagagtaaaagatgttgagggttcctaagcaaggggcccctaccctagttccctggtcagagtctgtggtcctcaggtaattcaggggaatctgagagcagagaggatccaagcctcgttggtgtgggatggggttgggtgggaggacaagagcagtaaagggagtagaaaggggaggaaatgcacgtagcaagactaatttttttgtgtgttcccaactgtgggtcggaagcaataaagtagaagtggctgcacgtggtgtctgggcagacaaggcttagataatttcataattctctgtatcccccaaaggatggggacagcacatggctgtgcatgtgcccaaacatagccttacacattcctactgaatttcccacacccacggtggagtgggaacagctaaatgtttcccaagtgcccaagggggatgtgggaatggctcagagatggcaggtcctggagcagccttgttgctggcagtgaagcatgatggagtaacatccatgaatagatgacccaagtccaggaagaataaggtccgtctcagcaaagcatcatttaaaagctgtggagtctccaaagtacttggaaataaaagggcatcttgactgcaacttgctctaagtatgagagggtgtgggtgggagaatgaaaaagcaactgtgataaaatgttaacatttgggaaatatggggaagggtatacagaactttgtattttctgtaaatctgaaattatttcaaaataacaagttaagaagctacagagagaggccaaaaaataaaataaagcaatgtgtttagagcagactgggtcatgtttgagatctgcagaatatcatttattcaaaaagagcagccctgcagtactgaattagtaatagctaggggcccacctcttcacatctgaaaagagaaaaagaggaacggctcacagaagcttggggacatgtcacggcaagagtggaagcagagtgttaatttgttttaagctgaagttaatataaagtgaagtgaatggcttggagcagcccgtagtttgcagaaagatgagttttggaaaatcttgagcttttggtaagtaagtggcaaaatgtctgattttacctggaagcactttttcaaattaaatttaatgcctttctttattatttaattcatcgatgaattgtacattaagcagtgtataataggtgttgtgcgagctaggttgtagctatgaagattttccttcaagatgtctttgagtctctggagtggcaaacatatgaatccaatcatgaaataatagaatttaataataactatacaaagtttataagtaaaatactgtggcaacaaaataaaaattatttttattggagggacaagaaaggttttgtggagaagtgacattttagccagattttgaaggtcagtgggattttagcgagtagagacggggaagttaaagttagttcttaggaagaacatatgctgaaatgcaggcatcaagaaatgggtagatgggggcattcttcataatgctgctttgagactaggaaataggtaggtggagtggatctcaaatctagagacattaactcccttaaggaattctgtgattttttgttcggttggtttctttttttgagacagagccttacactgtcacccaggctggagtgtggtggtgcaacctcggctcactgcaacctccgcctcccgggttcaagcaattctcccatctcagcctcccatgtggctgggattacaggcacccaccaccatgctgaattaatttttgtatttttagtagagacagggtttcaccatattggtgaggctggtctcgaactcctgacctcagttgatccacctgcctcagcctcccaaaatgttgggattacaggcatgagccaccatgcctggcctgtggtttcgtctttttaaacatttatcttctttcctatctgggatttattttgatatctgttttgaagtaagaatcccatgtcattatctttaaccccttcctttctctacctcttcccatatccaatcaatcaccaagttctatcaaatccatctctaaatgtttctcaaatatttttattttccctatcctcatcctcacctgttcaagttgcaatcattttttaccgaattgctccaacagctagaactggcactcatatttcatcctcctctgatccataataaaaagtagtttttttctaattctgtgaagaatgtcaatggtagtttgatgggaatagcattgaatctatacattacttcgggcagtatggccattttcatgatactgattcttcctatccatgaggatgaaatgtttttccatttgtttgtatcctgtcttatttcattgagcagtggtttgtagttctccttgaagaagcccttcacatcccttgttagctgtattcctaggtcttttattctctttgtagcaattgtgaatgggagtccactcatgatttggctctctgcttgtgtattgttggtgtatacaaatgcttgtggtttttgcacattgattttgtatcctgagactttgctgaagttgcttatcagcttaaagagtttttgggctgagatgatggtgttttctaaatatagaatcatgttgtctgcagagacaatttgacttcctctcttcctatttgaataccctttatttctttctcttgcctgattgccctggccagaacttccaatactatgttgaataggagtggtgagagagagcatccttgtcttgtactggttttcaaagggaatgcttccagcttttgcccattcagtgtaatagtggctgtgggtttgtcataaataactctttttattttgtgatatgttccatcaatgcctagtttattgagagtttttaacatgaagggatgttgaatattattgaaggccttgtctgcgtctattgagataatcatgtggtttttgtcattggttctgtttatgtgatagattgtatttattgatttgtgcatgttgaaccagccttgcatcctagggatgaagccgacttgatcatggtggataagttttttgatgtgctgctggatttggtttgccagtattttattgagggtttttgcactgatgctcttcagggatattagtctgaaggtttccttttttgttgtgtctctgccaggttttggtatcaggatgatgctggcctcataaaatgagttagggaggagtccctccttttcaattgtttggaatagtttcagagggaatggtactagctccactttgtacctctggtggaattcagctgtgaatctgtctggtcccaggcttttcttggttagtaagttattaattactgcctcaatttcagaacttgttattggtctattctgggattcaacttcttcttggtttagtcttgggagggtgtatgtgtccaggaatttatccatttcttctagagtttctagtttatttgcatagagatgtttttagtattatctaatggtaatttgtatttctgtggggtcagtggtgatatcccctttttcattttttattgtgtctatttgattcttctctcttttcttctttattactctagctagcagtctatctattttgtcaattttttttcaaaaaaccagctcctggattcattgatttttttggagggtttttcgtgtctctatatccttcagttttgctctgatcttagttatgtcttgtcttctgctggcttttggatttgtttgctcttgcctctctagctcttttaattgtgatgttagggtgtcaatttgagatctttctagctttctgatgcgggcattgagtgccataaatttccctcttaacgctgctttagctgtgtcccagagattctggtatgttgtgtcttcgttctcgttggtttcaaagaacttcttgatttctgccttaatttaattatttacccaggaatcattcaggagcaggttgttaaatttctatgtaattgtgtggttttcagtgagtttcttaatcctgagttctaatttgattgccctgtggtctgagggattgtttgttgtgatttcagttcttttgcatttgctaaggagtgttttactttcaattatgtggtcaattttagaataagtgccatatggcactgggaagaatgcatattctgttgatttggagtggagagttatgtagatgtctattaggtccatttgatccagagttgaattcaagacctgaatgtccttgttaattttctgtcttgttgatctgtctaatattgacagtgcattgttaaagtctcccactattattgtgtgggagtctaagtctctctgtaggtctctaagaacttgctttatgaattttcctatttttttctagattagcccacaaatcctcaggattatacaaaactgtactttgaagagaaatgacaaatacttacttttctcttacagaagcatgttaagtgtctccatttagtcatgccattttttaagtctcaaaggaatatttgtaatttttgaaactataagaaagtataagtgcatatttatttaatctctgggcagaaaatgattttctaaatattaaagcaatgaaagaaccagcaacagaaatggctgattgatataactacataacaataaaaatatcataatatttttaaatacaatagtgcatgtttaaatacattataaataaaattaaaagaaaagggagaaactgggagaataatttaagggtgatgctaaatggcttctgctttgccacataaataaatgacacaaaacagtaaaagaaacactaatgcctcaaagaaaaatggagaaagaacttgaccagttttcggagaagaaatttaagatggtatagactattctttcacataattctgattcaaacatgcctctgcatgaccagctgtttttagatcactcgtaagtctcttttctttaggtgaataatacctactaggtttttaagctgactagaccctttgttaaatataagtgacaagctttagaagttttatttcagtatcttctcagtgctttttaatttagatctcttgacaaaaagaaatagagggaagtggtatcttctatatttcataaaaagaggagaaaaactttgctacttaatcgactgtagacatgtataaaccactgttcttttcgattatacattaatctcaacaccctaagagtgtactggcatttttctttattgtcatcaatcagtgggttacacatttagttgctttgaggatttaggatttagttgctttgaggaattaggacttgagtttttttggataacttccttttaaagttgagaattatactctgatatgactgctgaaagttcatggaatttgtgagtttatttaatagaatttgagaaagttattgctttgtgctggcatactctatgtgacggggatatagaaatataagttgtgccagctacaaagacaattcggggtatatgagtggaatagagtgcattcttatgtaggtgatttgatagtggaatagtatgtattattattagatttgaaaggagcccacacataataactctgtacctctttctagtttggaaatgattaccaaggaatgagggagccagtaattaaagtatcattttcgtaaaggctaaattagttatttgacttgacctatggtgatagctatacaaactctgatttgctcctcttgcccaggtcatttcactgaatcgcacatgtctgtttaaaacttcagctttctctctgaggacaaaacctgtcctcatgtttacaatataagctacaacacaactttacaacagattagtggaaaagtatgtgtctcaaggccagactactctgtaagagaaagggtgctcatttgctcattgccaaagctgctaatcaggtaagtcactcctcttattttggagaggagtgaaagaggggctgggtactatttacacctctggactggcattttctttcctggataggatataaaaagtaggagataaatatattgattttaatacctaagtttcaggtcatctgggggtgtgatgtctctctctcgggggagaagatcattaatgcgtcctgctcttcccttcatgaactccttttcccagtaccaacaattgacccttagtctgtcttctgggacaactggtaggcagtgcagatatgcagtggatcagaactgcacattagttaaatcaattctcagaccttgctgttagccagggatagtagtcattccctactctaattctcatcccaagtatgtctagcctcgtgatcaatatagctccaggaatgttattcagggagataaatggcagcataaagatactccagtaatctattatgatggcaatatataaatgtccctaagtgcagatttcccccctttaaaaaattcccatgtcaaagagacatgaaaattatctttcgtctgaaattctaagatccaaaacttttatgttaagtttaaagaaatcaactttcaaaatttatgttatccagtttttctttctgtccaatctcagatagcggcatgtattccacagtctagacagaattcagttttttaatcagcttcagtttgagctgccttgtattggaatgagtaaggttctttcatccctaagcctctcctgtgtcttaattattttatctttttattttgacctaattgtagattcacatgcaattccaagaactagtatgaagaggtcctatctgcctgcacctagttttccccagtgataaatactatcttacataaccacagtaccatgtcaaaaccaggaaactaacattggcgttggtaaaatccatagacattattcagatttcactagctttacgtgcacttgtgtgtgtgtgtctgtgtttgcgcgcatgtgtgtagctttgtaaaattttgtcacatgtgtagattcatgtggccctcaccacaatcaatgcagactgctccaccatcacaaagatcctctttgtttgtccttggtggtcacacccacactctccacgcttacctcatctctaaccccaggcaaccacgaatctgttttccatctctataattttgttatttaaagaatgttatataaatgaaatcatacagtatgtgaccttttgaaactgaagtttttgagttggcatcatgcttctgaaatctattcaatttgttgcgtgcctcaaaagttcattcctttttttggttgaatggtattccatcacatggatttacagtttgtcttaaccattccctgttggaggacatttgagttgttaccagtttttggatattacatgtaaagttgttatggacatttgtgtgcatgttttagtgtgaacaaactgtacatttctctaggataaatacccagaagtgctattgctcatttgcatgctgagtatatgtttagctttttaaagaaactgccaaactattttccagagtagctgtatcattttacattcccactagaaatatgaatgatacgttttctctacatcctaccagcattggttctgtcactattttttattttaactattctgatatgtgtactaataattcactgaggttttgatttgtgtttccctaaaagctagtgatagtgagcatctttccctgtgcttatattttatgtgtatattctttcagtgtaatgtgacaatatatttttttctgattttctaattggattgtttgatttttgttttctactattgagttttgagagtttgttatatattctaaaaatatgttctttgccaggtatgtggtcatgtgcctcatttttaaagttcgaaaataatactgaaacacctgatatttcaagaccaactccatagccatgaaattttaagagccaagcaaaaatttgagtgattggagctgtaatcccaggcaaaataattttccagaacccagtgtttagtctagtgcagattcctgttattgttgccaaagatgctaatggaaattccttgatatttgaggaaaggaaggtggacagagacaatcttgttttaagtcttaccaggatgccagtagatgtcattggtccaaacaccatgatctaaaaatttaaactgaactgtaagaaattactaatcaagatgcatttaccataaatggggagaaaatccacctatctataagcaggtctcccatcacagtagctgcccccgtgcctctggctataaaagaggcctatggaatcttcttgctaggggcagttttcccttgtccccacatctgttaaatcaagtgctacatccctaatgtattatttgtaatactttatagtaatcaatataagtataaacacataccaatttacctagcctccttgaatcaatgaaattcaactttagtggaggtgcagacccatgatggccattcttgatgtcccacctttgtgtaatttcttcttcttgagtgtgggcagggtctgtgactggcttctaaccaacagaatatggcaaaggtaaagggaggtcacttctgttattgttcattatgtaagcctctgtctggctggcagactcactctgagactctccttgctggcctgatggaataagtggccacattgatgaagcccatctggcaaggcactgtggacctactacaggtaaactttgagaggtgagggcattctctagccaagaaccagcaagaagccagagagctcactcagtccttcagtatcaaggcaatgaattccgccagcaaactgagtgagtctgggagcagattctttcccagtcaaaacatcagatgagaatacagcctggatgagacctcaactgcagccttataaggccctaagcagaggccttaactgtacctctcaaatcatgacccacagaagctaagggataatgtgtgtgtgttgcttcaagtcaccacatttgtgataatttgttacccagcaatagaaaatcaatacaacttcacccctacccagattttatttatttttgccacggaaacaatactgaaaaatatttttattcatatatctttatatattgatgcctttattttatggatagattttctaggagtgtggttactgcatgttcttttaaattttaataggtgatgccaggttgctttctaaagaagctctaatgattcacatgctaccagcaatgtgtaagcgtatcctttttcttttattcttactagcaatgggccctaatagaggtttataaatcctttcagtctcaaaagaataaagagatatcgcattgttactttaatttaaatttcactgcctaccagtgagtttaaccattttttaatgtttccggttacaggggttatctcttctgcaaattgctttttaaaactctgccaatgtttctcctctattttttatgtctttttttattgtaatatgtattatagatattaaacttcagacctgtatgttgcagattttttattcaaatctacttgttttctgttgactttgtttatgaaaagttttttattgtaaaactgaaaatttttgttaatagcatccatgtaccttctgtgtgtgaagctatagtagacctttgaaatccaagccctgttttttggttgttccaatagcaaattgtagcctccttgaggccatgggtttagagagcaactcttaaaaccttgccagcagtcttcatgatgccaataggttaatttatcctaaattctatttttaactcttgttgtatttcaaaacaaaatagaaggaaatgcaatttggggcagcatatttagtactatttacctattcgtggtatgagacatactttagtaggactctgtggactgtaacatagctgcttctgcattttaagacccagcctatagatctgattaagaaatacaataaaatcagctaagcttgagcttctcataagtgcctacaaagtttttacactaaaatgcggcctacattaagattagcctttattggagcaaaataaactctcttaactataatgtaatccctgccccattgggtggctttaagccatagctgtgccagcatgagtcagggcaagttcagccacagaaaaccacacagactatgattgctaagccccacactccctcaacagttaaaaatcagccacacagtgacgataaaagccacagaaatccaatgaagtccaaacccaggtggcttaaggttaccgaggcattgagagcttctagcctccttccctttctttctaagcatggcccacattctggcccatggtttattactgagaatttccaatccctgaacctttaagttagggctgaagagaatcaatcaatgacattcctcttcacctcctgagtttgggaaaaaaaaccaaaaagagcatacaggagtccaaacagatgatggggaaaatatctgatactttattgatgataaattagaaaatgccacttgacctatagccacactcagtctttctattctgctcccccaacctgtgaatcaaacttgcctactcacaatatcaggccttaaaaagacagaactgccctggtcaggaatgggaagaaaagatgtgtgtcctgaagactttgctgtctgaaaaaagagaaagaagctgaactgtttgtctgagttccttcttcccattggcaggatcaaagaagtctttcctcccttgggctagtgtaggcaaggaggcaaagagtaccttttcaggaagtagagctccctctccactatgggaaagtgaggaggccggggtgagtgagtgcccctcctaatattttgatagtgtattcatgaaagcctcttcatagctgatggggtccttagctctaatagggatttaggtggaaggttgggaacagatgtgtgacattgaagctgagctttaacagatgagtacaagtgtgctagatgtttggtagctagagtggcattttagacagaagaacaacataaataaagggagagccataaaattgcccagtgtgttcagggagcagccagggaatccagtgtggcaaggacatgggggaaactggctggagctgaagttttgagtaaggaaatcatttttacagtatttatatttctgaagaataattagtagctagagtgatgaaggacagcttttaaatgtagatatgggactcagcagtttgtcatgaagaattgtgaaaaagtctatctgaagaattgtgaaaaaatctatctctgcaatcttaatagaattcagaaacaaaaattcagattaattggggggagttaaaatagttaatactatcatatgtgattggagttgctttgcaaactcagagaaaagtcaagctcaagaaacacaaacatggtggcatctttggactgttgagattccatgctgtcatctttcatttacccagtatctcatcagttaaccaggctgtgaatttttctttgaaataatttcaaagacatgcttcactttcccattccccgaatgtcttcattgttttggctgctattacaaaaataccgtagtttgggtggcttaaacaacaaacatttatttgtcatagttttagaggctaggaattccaagatcaaggctccagcaggcctggtatctggtgaagccctgcttcctggcttgtagtagacagctaccttccccttatacccttacatgaccagagagtgagctctagtatatttctcttattgtcaggacactaattccatgaaaggatttgcctactgacactcctactggggactagggtttcaacatgatttttgggagaatacaaacatacagtccgtaacatcaactatcttcaccttttgcaggtatctattacctcaaaccttggtcatttttgcctgcattagtcattttaaaatattaacatttttatgtggttttggtattgtattatctttagagattagactcatggtacagtctgtccttcccttcatagaactggttgagaatttacacatacagagtcacataggcatggagtatgggtatctgttttactcaatgtgtgcttggatcaaggacactagcaggctttctgactctccccacactgaatttatccatcttgtcacaggtcagaggctgtgatgcacatctgagagggcttactgcatggaagctggaagcctggcccctgctgcatctgaagaagcagaaccaagaggaagcaagggaagagcacagagcctatttctaacttttgaggcaatgtgactcccactggaaacattgttcaatgaaagttaggatcttattgatttcgccaaattgatttgtttttctctgtccaagaggaggaacaatttacagagtagaaatagagtatgaaacattgctggtaatatcactggttctttctcctttaagagatcggaatataattttaagttttgattggggaaagaacatggggtgagcaggactagaattttccaccacattattcgtcttaggtattattctctaagttttaggtatatgccttttatttctaatttggaatcttcctgagactagagcccatgtatattgcttcaggttattcccataccaataaatattcagaaaagaaacagatttagctggaaatatgcaaaatgccatgtcagatgggaaagccttgctgtcactaaataactatgtaagattggcttgaatccaatgcttccacgtctttggaagatttctgtcagtttccctctttcttgtgatctcctctgactgccagactcttgtttccacctttgctgtcttggctgtgcatgcagttaattcagagatgattctcagaatattggttggttggtttacacacactcagagcatttgtgagtacactggattttactgttgctagttaaagggaggagtcccttgatgcatagctcaaaaacagcccatattctggattcctcctctctaacatcctttgtggctggccctcactgaagtttcctgtcttagttctagccccatacatcacactgttttatatccttttgtgaacctctctttttttcttttattgtctcacataccctcttttcattttttcctagaaattctaaatacttcagtctcaattttactatgaaagtgagttttctccagctccttttctcaaacatgcatatacaaatccattaaggtgctcaataaaggactgccaggaacaaagagccactctccttaggtgcttacatgccctatgaatataattagcaggtttttctattataattagaatattatcctcacatttctaggtcgattttctcctactcgaataacaggggaatgaatattaaaactgtattaagaagtctcagagttcatatcatatcaggcctcctaaaatatagtaagaaaatgagtttgataataagtaaaattttgcagaattttgtttagaggctcagaatttaaacattctctttcgttgatagtgcttataaaaacaacccctaagtattttctgataataattggctacatgactttcttagatataaataaaactagggacaatgaagtctttaacagaaaagaagaatttgttaaccgtattaaattaggattaaacacaatgaacaccaggtctctacaagctagagaaagtgcaaagtatgagaatgtagcacaaaattgttgagaaagtgtgagtgcttggaatggtaaatctgtggtgactgtctcttttcctggctggggagcctgtccctctaggttataagcaaccagtagtcctggtcaggggcatagcttttcctggtcattactacattaacatggaactgaggccttacaattctctatcatacttgtaattattagcatttctatgccatatgttctggaatcaatcacaaaatattatctttgcatgactgctatagggcgtattactcgattttctttactattttaattatactatttggtaacactagcaagtctgaattttaaacaacttccttaggttaccctgtgtatgtgtaattaatcatttcattgttaatggtatgatgacaaatactgaaagaaagttattctaaatggagcatagttattctaaatggcaaagactcagagactcattttagactataattataatcttgcagtggaataggagaataatcaatactcattagatatgtcattgagaatctactatagattcatgactaaactctcaaatcccagaaaatgtgctgagaatcatgcactagtttaaagagggagaccagggcagttgttatatttttaaaaaggctgaagtcatatatgagctgccacaagacaattcctccaaagatccaaaggtaaagtttcatagataatcaaaataaaatgctattagtgaattcagatgttcatagagttgtatattattcaataaatgatcaagcagataaagatgcacatatgatcagcactaatatgaatgtatatgtgtcactgaaattgaagttttaagtcactgtccatagagtgagtcttagataaccctataatgtctttataaaactcaatcttgccattaaaattgcatgtgatgccttaagtttgctggcatcacccaaagacaaccgacatgtgattctgattccacaccagtgtgaactcctgttcaggccccacttcttctgatagcagggtgtaccccactggctcttgcctatttagtcccttatggtcaaatggtgagcagattgatcactttaaggcagggggaaccaacatatctgtgctcattttcatggcattcttagctatttagtgaagcacatggaagctcaggaatggcagggttttagaagccatttgttttccctctgctccctttgctttccttaaggtgcagatctttcctatcttccaaaaactctgcatgagtgttccatccttgctctgtgaagctagaaatagtatctccttttctcagaaatatcttcatatttcttctgtgcttcttctttatcacttatcacgacctgcctggtagctatcatgttcctctctcatcccttagtattacagtgtattctctgaatcatctttgtatgcctgataggacttgcacagtctggcccagggtaggtttcaataaatgtgttggatgaatgatgagctgcaattctgccatgagattcatgagagtaacagacactgaattattgtacagcagcttatggtggcgttttatactctaaggttggagggagcttgacttagaagcttcttagcatctctaaaacatctctgccaagtgatctcccagctttttcttgaacatctccagtgatggttaacttgactcctctagaggcagtcttttccatttcagacatgttctaatgtggctctcttctcctctttcctgacaatattttgacctcaagacgcagatttattaccaactcagctaagggtactttaacttcataaggctgaaagtagtctcttgttttaatcagtctcaagcctagaactatccagattcttcctgtctttgctgaaatttccttcagatactttagtttttgtagttttgttttttcaaacagatttatggagatatatttgattttataaacaaaaacctgcacacatttaatgtatataatttgatgagtttggaagtatgcatatgtctgtgatgctatcaccattcttcttaaactgttatttcccttcatggattcaaagggttggaagagacctggagattagctagttcaacttaattttctgatgatccaatggagcctaagtaagaggaagggacttgctaaaggtcacacaccttactttcagccatcagctatacaggaaaggagggtgcattcccagctgctggcctgcttaaaggacccagtggctacttattccacaaatttcttatatgcagtaataccgtatgctccaacagaagcttttcacttttgagctacaatattaatctcatgaacttaatcacaagcataacaaatggtttttccctcttaatcccttacttgttcacttgctggtgtatcacccatgaccaggcagacaactgttttgtcttctgtcaactgattaaggagtgatattagatgggtgctaattcttaggaagatgagagaatcagaaattcatcataggaacatgcttgagtaataagtttgatgatatcatttttagctgtgagatagttttggttctcataaaaaggaaaatttgttataattttaagtagcatttaatgttatctactgaaatacatttgggtttagtacaggaaacagatgatatttggtctgaaaacactctgtgaatttacttttttttcacagattgttgcttactttttttaaaaattttatgttctactatgccagggaatgatagttatgttagattatgtaactggcaatagtaaattgaggaaataaaagatttgggttaaaaagtggttctgcttatgaggaacatactccaaaaagttgatattgtacatacctaaactttattcaggaactaaaatacagacaatctgtgggataatataataaattaaattttagggagattttgcttaatggggggtttccaaagtaaattatgattttactcttttccttatctttcagacatgccacttcagaaaactctttgtatctgcattttaaaatattgctttattttaaattcatattctggataaattagttgatttttgatgattctaaaaatttttagtagaaaccagttttaatcctgtgagtagaaaaatatgtatgaagatgtgggataggtgtttgctagcacagggtaggaagtacctaaaataacaagtaagtgtcagtgaggaaaatttgttaaatagaatttcataaataattctggaatgcatttgcaaaactacatgctgggtcatatttttctgtctcacgttatagccagtttaaccctcttactctagaaaagctagagctatttctgtgttctcaaagttgggttccaaattacctatccagtatcttccccccctacattttccacaaaatgaatgctccagcttcatcaatctcctttaagatccttgagcatatctacaacttctgtcctctgctatcgcagtttcctcactgatgtgcccaaggagcttgttcaaattcatgcatcgttgagggccaaatctggatcatctgtcagtttcattcaatgacaacctgtcctgatttacacagtcagaattaaatattcctacagcatattactaacacctctatttattgcttataccagctttgccttgtgattagttatttcatattgatctactgaacttaaattctgtgatctccttattgaccacagattattcctctgttcagcactccttattcttatccctgttacaattcttattatggtgcacaagctccataaatatttataaaactgatattaattgaataaaatattgtctagaggtctcagtcattcttcaatgaaacggaatgattattttagctgatttgacaccattgtaccaaattagtcttcaaaattgtatactaaagaaccagggagacaatgaaatatctaagatagaatcatttttaatatattggcatgctaaactttagaatgtatgatcaaaccacttatttcaataggataacatttaaccaaatgccttggtaagttgcttacccatctcaaaaggatattgataatattgttctatagagaatttacataaaaaggctatgattactgttaaccacaaatagtcctaagtagtaaaaatattgcctgaagtatttctgagttgaaataaaacatccagattataataacatttttctttttttttaggtatggtcttttaaaataaatactttactattataattgtcacgcctgttgttttgcgttagatgtataactaaacgtgttgtatagattatggtcaataagttattgggtaaatgttattttcctactattacctaaagttaatcttaccacctgatatggtttggctgtgtccccaaccaagtctcatcctgaattgtagttctcataatctccacatgtgggagggacttggtgggaggtaatttaaccatgggggtggctacactcatgctgttctagtgatagtaagttctcatgagatctgatggttttataagaggcttttccccctttttcttggcacttctccttcctgccatcatgtgaagaagggattgtttgtttcccctcctgccatgattgtaagtttcctgaggtcttctcagccatgccaaactgtgagtcaatgaaacctttttcctttataaattaaccagtttcaggcatttttttcatagcagtgtgaaaatggactaatacaccacctatacttttttcacacttttcattgagaaatgtaactttcacaaagaaaagtacatacaacccatattaacagttttacaaataactataaagcaaatatctgtgtcggttgggtgtggaggctcatgtctgtaatcccagcactttgggaggccaaggtgggtggatcactttgagctcagaagtttgaaaccagcctaggcaacacagcaaaaccctgtctctagaaaaaatacaaaaattagccaggtgtggtggtgtgcacctgtggtcccagctactcaggaggctgagcctggagaatcacctgaacctgggagacagaggttgcagtgagccaagatcactccagtgtgggaacagagcgagaccctgtctaaaaaataaaagcaaataatctgtgttaaaactacccagaccaaatagaacatttcatttaaaagatctggagtatctactgagggtagagggagaggaagctagccaagcacaagcatctccctgattatccctgccagttgcagactcattcctttcctctactgcttatactatcctggctttatagtgttaatgtcttctcttatctttataatttccctaaggaaaaagataaatttttctgtttttgaactttatataagtgggaccatttatatgtattcttttgtggcttgtttttcttaaccttaggttggtaaaatatattcatgctgttgtatgtgactttagtttgtccattcatttttaatactatacagtgtcctttaaatgaatataccacagtttatttatccattctacttctaaggcaatttggactgtttgcattttggggctattttgaacaatatgtcttggtgcatgcatttctctaaggtatatacttagcagtggaattgctgggtcaaagggtatgtgtgcctcaactaggctagaaaacaccacactgtttccagagtgcatgtataaatttatatttctaccagcagtgtatgacaattcctactgctccaaatcctgaccaacaacttgtatttacttttgcattttttttcccaatcttaagagtgtttagtgctaactcattttgtttaatttccatttactctattaccagttaggttgagtaactttttaaaaaacagaagtccattggtaatttggattttcacttttgcgaagcttttgttcaagttcagttctttgcctactcttctattgaagtattgttttatgtgtatttctcattgagtttactgtgtattgagtattgttataaagccatatgataagcagatgttcttaattttaatgtagttaaaattatctctttttctttataatgactactttttctgacttattaaagaccccctgtcacaaaattatgaagatatttacttttactctctcctcaaagtttaaaaattttgccctttccactctggtttttaattgattttatatatggatacccattattacagttccaaagattaaaaagtggccttccccattgctctggagtgctaatttattataaatcaagtgtccttgtgtgtgtgaagttgtttctgaacttaaaatatatttctttggtctaaatatctattcctgcaataaacatccactgccttaattaccatagctttatataggtcttgataactgggcaagtcctttctgccttatttttcttggttaactttggcctttttaacatacatatacatttgaaaatctacttgtgaacttccacatgcacactaaaataatctgctggtaatatgaaattcattgaatctatacattcctttcaggagagagtagttgcacacatataatcccagcacttttggaagccaatgtgggaagattgcttgaggccaggagttcaagactagcctaggcaacatagtgagatcctgtttttagggaaaaaatgtttttaaaaagctgggcatgttggcaggctgccaagtacacagggggctgaggtgggaggatggcttcagtccaggagttccaggctgtagagagctatgattacgccactgccttctagcctgaatgacaaagtgagaacctatctcataaaaaaaaattcaggagaaatatttacagtcacaagtttttcaatatgtgaatttgctatatatttcatttttctgaagtcttctttaatgtaatttaatcccattttatgattttttctgtagtagccttatatatccttgttggacttttaccgagtcacctgatacattttgatactgctatataaacccacctttgtcattgatcatagctcatcaaaatcttcctagactttgcttatcatttcttttcactaacttgtattctcactgttttttcttccactgagctactctctttattacatgaacataatttgaacccattatgtacccattgttaaaagcccttcagtagctccctatatactctatgtctttttcctttcatggccaatgatttaggcatgatgggccacgcttctgtctcttccttcttacctttcagccagtcattttccaacctgctgcgatttgattgcttccaccaccacactgcaactgctctgccagaggatcctctcacaattaaagccaaggactatttttcaaggtccttatgttgatttttcagcactgtagaacattgctataatgctaaaagtattaatagtagccatagtaattataactggtatatatcactggtaaatatcactggtattattatgactatacttatagctataattataattatagtaataataacactataattatatattattactgtaatatataattactataatataattataataatacataattatgttaataataatatgagtgataaaattaataccaacttactgagtatcttttgtggggcagcactttagagccactacttttacaaaccagatattattatcaaagatgagatggcctttccattgtccaaggtcatgaagagtaagttctacagggaagtcagcctcatgcaagagtctaaactctgcccaatacttgtctctgccttaaatccacagatctcgctcgcctcttgttctcctctagtccatcctgcctctttttcttactctttttctctgggttctcttccactgcccatatcctcaatctggctcctcaccagggtcttgccattggtccttttctcactcttcctatccttgcttatatgatatcctctcccacaacataagctttcacttaacataccaacttcattatatctaagacctagcatggtgcctgtcttgtaactattgaatggtaaactatcttatatcttcattggttggagtctagacatcccaggtcaatatttacaaaactgagctcataaatctttttctcctaaacttccttctcctcctgtgtatcttatcctggttaaaagcatcaccctttatccatttgctcattccagaaaactggtaatcatagaactgtttttatcatgccagcctcagaaatctcttctaccaatgcagatttctttgcattctggtctttagtgacccatctcctggtgctgtcccatttggagcacttatcagcttgatatgttgatgatttgatgaactaataactgcagattttaccctttttgggatacagtaactattttttcatatattgaaaaataattctttcagtttagcagcttacattttgatattgcccaacagagtatcatacaagtactcacttactgatttttttcaacacttttaggtgtctaaaattatggaagagaaaacttgtaaagaaactgatattcaaatactttggaacttagttgagatttttgcaatttctttttcaatgttcacaaaagtgtggctgagaacatcagactgtgcgcttcattaaagttaatgggtgaacaaccaaatatttggggatacctcagttttttcaaatggagtcacattaaattcttgctgcaggggtttctctgtgcagtttctgtgatggtttttaggggtctcttggatggcgtggctgtccttctgcagtgccacagggaacaaaaccgaagttgttaagttagaacagatacttttataccaaacatggtgaaattggcaattggcatttttgcataatgatataagtatatttgacggcattggaaatcctaaccagcattatatataacttaggagattggttaatgaaaaatttttaacagtgttttatatagtgagggacaccatgatgtgtagtttgctattgacagtgtcactcttggctgtcagagcccttcagggattacccaggccaaaggggtcatgctttgctttgagacaggtgaagggacacgaaggcccagctctgtcacactctcttggcacattctgtcctcagaattccctatagtgtcagctaaggtttctgttgagactgtcacagcttgacatcgtcctctgcccaatcttccttctttctctttctttccatttccttccacaggcactgattctgtaataaacatcctgtatgctaatcttcatcttagagtctgcttccaagagaacctaacttgcaactcccaccatgtaaaagtttgatgcagctttgccagagaagcataacattaatgggaatgctgtgaggcttttccctagaacaggaagctcacaaaggttaccaagtaaacagattcattcatcctggcaacatttacacatccttctcagggatgcagagatgattaaggcaagattcctattctctggtgagggaggtaggcacaaacaagtgttcacaatacaacatcgtaagtgctattgtggaggattgcacaatgcgcttagggaacacagatgagggggcaattaaaattgcccaggtatcctggaagatgaggaaacatttgatctaaactgaagaaaaaaaccatctgatctgaattctctttcctaggaaagagaatggtttgggagttgcttgttttgcagctgtgtaagatgtctggggagaagcaaagagctaggctgggatgaggatgaacaatggcaggaagtaatgaaaaattgagctaggaaatagtttggggccagagctaaagaaggagtggttgccagctgggcgcggtggcttacgcctgtaatcccagcactttgggaggccgaggcgggcggatcacgaggtcaggagattgagaccatcctggctaacacggtgaaaccccgtctctactaaaaatacaaaaaattagccaggcgtggtggcgggcgcctgtagtcccagctacttgggaggctgaggcaggagaatgacgtgaacctgggaggcggagcttgcagtgagccgagatcgcaccactgcactccagcctgggcgatagagtgagactccgtctcaaaaaaaagaaaaaaaaaagaaagaaggaatggttgcctagtgacaatgtgtaaaatgaggagataacgaaagatacctaaagaagaccaatgtttcatatgggggggcattaaggaagagcagctagtgaaccactggagaaccatcaaagtggaagaaggaaaactggaatattgctggagagtagagaatttccgaaaggcaaaggtcaacactgttacatgctctagagatgttcagcaggttgagaacttcgaaataagaagccctcgagctctagcgaaatgaacacacaagtggggatacattcataaatgcaacaccatactgtaaaaaatgactacaggttcatctgagaaaaaaggataaattttgcaacgtgatattgagtgagaaaagttagatcttctacaaagatgggtttagttaaacatgtagtgcttggggaaacttgtataggtgacacaaacgtaaaagaaagctagaaaaatgggtctttgtaaggagagagggggtaatgatctgaagtaggcatgaggggatctgctgtgttctggtaaagtcctctttcttgacctgagtgattttttatggatatttcccttgggataaacctttgggctgtatgtttctgttttgtaaagttttctgtgatgcaattcatattttccaataagtagggttttaaaataagcaattggaaatgattaatttcagaatcattgtgacttttgatgagaagtttgagtagaatgtttgatggtagaagtctgattgtcctgggttgagaaactgaaggaacaaaatccagaaatgtgaattatttcttttgtatgttgatgggaaatagaaaaagataatgtagccctttggagtaagtagcctttaaactagtaaacttagtactcccaaggcaaatacccttagttaaaatctataactcatacaagtagataggagtaagttataaacaaccaaatgaaacattagtagtaagtgatgaaaatgcatggtggcaagcaaataacaattttttataaatcaggtttttgaataaactttgttcatatttgtcattttgtgaatacataaatgattcctagaaacttggagttgtaacatgggactgcttgaaaaaaaagataaactatctaaaaggacaggcaattcaatatatgtcaataatcatttcaaggcactagaatctttgctatattagtgtttttatagttttagcatagtatatgtattttgtgatatttttgatacagcaaaatatgacacatttaacttcattaaaaacagaattttgaagtccacacttcaaaatttctttagagtcaagaaattaagaataacaggagacctttaaggtagttcatttaacttgcttatttgacagattgggactccacaggcttggagactcaatgtcagtacccaggtcacacagttagtggaaagcctaactaaagcttgggtctctcacctctcagtctagtgataattccactcagtacctttgagcaatatctcataaagcaaatcttgttacctaagattctaaacagggtctagggcattgttataatagaatttggtctgtacatataaaatgttctgtatttggaaattgttttctttcaagtcataattctaaaaaggtttaatgcgtcattaagcataatttgtattttgtcatggggtggtaacatttatttagggggaattatctcttttgtaaaatgtgattagaacaccacttgattaatggaaattctctttaaatgcaactcataatacaggcttaaatcctgatatagaaggtcaactggatcaccttgtcactttctattaatattacaatatgaaaactattgtgttgcttcattacagacccttaagatacctttgtggatggcaagtgcttctgctttcatcatagatagtaggaaatgaattcttggctataaaggtggtgggccccagacagtactccccaaacaaactgcggccttcagagtttatttacagttgcccctatgcttataggaaagttatcctctttgaacagtagtgtcccacgtgacacatcataaaatgcaaggcaaaacttaccaattcagttcacatcaggatttttttgtaaccattgattttgttataaggggctacatctcttaaaacaagaaatttgtattcagcagcctgaaggtctttatagccattgaccttcccagtgactgccaacaaaatcctttagtttatcacttcactgagccatgtcatcactgagaatgctcagctcatttaaatttagttgacctcgtggtgtcattccttatgtataagaactaacaaacacctttgccacactgtaggtgccttgaaggcaggtgatgaggctgggtaactcagctatttagcatgacgatatgcacagagtgagctctcagtaattattagccaaacaatgataagtgctttttacttgtatcactttcttgattctgtacttccaagagtagcgaacttactcttcgacctctgggtagcatttgacaataggattataagtgctttctcctttggcctcagtggccctttactgtgcctttagtccagtaggttgaatttgcaatctctcccttgacatcattcctgcaatgttttgtgcctgttagcaggaagacggccttctatgactccttctgttccctctcctctaagattaaaatgcatttagcacattcttgaattttttctatgaatatttatgtcaaatactactattattgtatataagacaaagtaaagaaatataataaaggtacaatacataaaataaatagaaacatccaggtgtaatgtagtagtatgctcaattaaatacatattttgttgttgtctttccaggtagtttttttttttttatggttttaacattccttgacttacttacaacgctttcagacactgaaaaacagccacagggcctggctaggctgagatccctcagaggcttcctgcaggcaattgcagctttgcctattactggcctgaggtggctgttcttactggagacttcaccccttcaagcccaaaatggaactgcagttgtcccccaaattctgagctctcctgggaactcaagaaatccctctcagtagttattgatttctattccttttaatcatctttcatttgcatttatctcataaaccagtagatgtttgcacatttgacaggtaagtttggggaaaatgcatactttaatgtatccatggagtctgcgagttaccttcctattcccctcatctgagggcctcattttcctaaaaagacttgggattatctgagaggccacttccctaatataagggaatgctttttccctccttatagttctctctttttgattctctaattattgagtcttaatcataaaagtttcttattatgaaattatttacttatatcagctggcattaattgttttctactatctatctccaattcattttctctactttatgctgaagatgtctttggctttcagagagatttacatttttcagagtgctttcaaatataaatgtatataaatatatgtgagaatttctcattaaccttcacattgacagtgtgaaataggtaaagcaagttttacaaatgtgaaaattgagagtcagagaagttatgcaactgctaagttgcctagctgataaatagatatgttcacgctgaaatttgggtgtaaggattcagaacacagtgttcttccattatcttctaccagcatgatctcaccattatatggtcttgctgtgtccccaccctaatctcatcttgaattgtaactcccacaattcccatgtgtcatgggaggaacctggtgggaggtgattaaatgatgggggtgggtccttcccatgttgttctcatgatagtgaataagtcttacaagttctaatggttttaaaaataggggttccctccacaagctctcttttcttgtctgctgccatttgaaatgtgcctttcaccttccgccatgattgtgaggcctccccagccacagggaactgtaagtccaataaacctctttctttcataaattgcccagtctcaggtatgtctttatcagcagcatgaaaaatggactaatacagtaaattggtaccagtagactggggtgctgctgaaaaggtactcaaaaatgtggaagcgattttggaactgggtaacaggcaaaggttgggacagtttggaggtctcagaagaagacaggaaaatgtgggaaagtttggaactccctagagacttgctggatggctttgaccaaaatgctaataatgatatggaccatacaatccaggttgaggagatgatgaacttgttgggaactggagtaaggtgactcttgctatgttttagcaaagaaactggtggtattttgcccctgcacagagatttgtggaactttgaatgtgagagagatttagggtatctggcagaagaaatttttaagcagaaaagcattcaagaggtgacttgggtgctgttaaaggcattcagttttataagggaagcagagcatacaagtttggaaaatttgcagcctgacaatgcaatagaaaagaaaattccattttctgaggagaaattcaagccagctgcagaaatttgcataagtaatgaggagccaaatgttaacccccaagacaatggggaaaatgtctccagagcatgtcagaggtttttatggcagcccccccaatcacagttccagatgcttagaaggaaaaagtgattttgtgggcagggctcagggtccccatgctgagtgcagtctagggacttgatgccctgtgtcccagccactccagcctgggctgaaaggggccaaggcacagcttgggctgtggcttcagagggtgaaggcctcaagtcttggcagcttccacctggtgttttgttgagcctgcgagtgcacagaagtcaagaactgaggtttgggaacctctgcctagatttcagaagatatatggaaatgcctggatgaacaggcagaagtttgctgtagggacagggtcctcatggagaacctctgctagggcagcgcagaagggaaatgtgggatgggagcccccatgcagagtcactactgtggcaccgcctagtggagctgtgagaagagggccactgacctccagaccccagaatgatagatccactgacagcttgcaccatgcacctggaaaatccatagatactcaattccggcccacgaaaacagccagaagggaggctgtaccctgcaaagctacaggggtggagctgcccaagaccatgggaacccctgtcatgcatcagcgtgatctggatgagagacatggagtcaaaggagatcattttggagctttaagatttgactgccctgctggatttctggcttgcatggggcctgtagccccttggttttggccaatttctcctatttggaatggctgtattttcccagtgcctgtaccctcattgtatctaggaagtagctaacttgcttttgattttataggctcacaggcagaagggacttgccttgtctcagaggagactttggactgtggatttctgagttaatgctgaaatgagttaagactttgggcggctgttgggagggcacgattggttttgaaatgtgaggacatgagatttgggaggggccagaggcagaacgatatggttttgctgtgtctccacccaaatctcatcttgaattgtagctcctgctgttcccacatgtcgtgggaggaacctggtggaagataattgaatcatgggggtgggtctttcccatgctgttctcatgatagtgaatgagtctcatgggatctcatagttttaaaaatgggagtctccctgcacaagctctcttctcttgtctgccgccatgtgagatgtgcctttcaccttccatcatgattgtgaggcctctccagccacacggaactgttaagtccaataaacctccttcttttgtacattgcccagtctcagatatatctttatcagcagcacgaaaatgtactaatacaccctactatcccacagatggcatgtggcttcccatctgtttgtgctcacctagctccttctctcaatgaatcagaagacccactttccaaggctccattcaagtctccctccttcctaaaagctgttcctgacaaaaccagtctagagttattttctgtaaatgcttgttatttaaggcatttattttgtatttcctcataggctgttttgtatggttatttaactatgccaaactagatgtttagagataaggaatcaaactgaaatcaaaccaggcaagaagtacctagttactgacatttattaggggtcttaggaattgcaatttgggagacataaactcaatatgacattgaattgtgttcctaaaggaggaaggagagagaagggttttaaagaagaaagaaggtgaaagtttaaaacattacaaaagttgcttttcaaaaatcatgattggctagggcattgtaaagtacatgagtccatacacagctggctgcaagagtggttggctaaattaagcaatgttccagggtgctgtggtctttgtgatttggaccagttctaaagttcacaagaagttccaggtacacctgtctgtgaatgtgcagaagtttctcaacaaaatggctccaggctccattttagatgttctgaatcatagcacagccattttggagataagattttatggggaaaaaaagtgggatttggagccatctgggtttgggttcaaatcctgactgttacctaccagctttcacgaccatgggtccctgctaactgatttgtaaagtggggatttattcagaaaaacatttactgaatgcatactatatcccaggtgtgcacaccaatgaacaagacacacaaagactgtgagagagataggcaagtaaaacagattgtcaagagttgcaagcaatattaaatgattttaaaaataaaaacagttgataacatagtcacagcagaaagaatccacattagagaaggtggttgtagaaggcctctctttgaggaagatgatactttacctgaaacttgactgacgtgtaaagccagccttgcaaagatgtgatgaggagttgttcatgcaggataacttaaggcttgagatagcctggtttattagaggaatagagagaaggccagtatgggtagttgctgaagaaggaggcagcatatcatgtggggattttaagcagtaattaggagtttgggttttattctagttgcaataagaagtcaatgagaagggtaacaaggctctctggctgttgggggtgttgaatggattaacacagaaaagctcgtgatacaatgcttgatagttaacactttaactgtttaacatatttttattctgctttcatatgtgttttattattaaaactacatcattaacttctcaaatacagggcctatatatcatgctattgcatgcacaatgtggcactctatgacacacataacttgatcaggcttgttagatgtgagtgttaccccagtgcaccactaggcaacagctttttccatgcagatgacttgcactgttctgagtaattcagctaagctgcctgattctgcccatttaacatcatctcatacacatgaggctatctgatgagtctgtaataacaacttgcacacagtggagtgtgtaagcatgcataattctcagcttgatctatatttaattaccattctggaataacattcacttttgtatgattatctaaaaaaaaaaaaagaacaacacaagtataaggaatgaagaatttacttagcattttggaaagggactatcttcagaaaagttttttttttctttttatttgccacaccatctgcttttgagataagcagaactagtgagttctctattgagatacatactgttacttagattttgaaggtttatttcttcttagaaatgccaagtgtttagatttttctgtgctttatagcatgtattctttttctctctgacagaatagagatcaagatagagacccctctatctgggctcccttggtaaaggtttcttcctgaatggaagtctcccaagaggtatttgtcactgtttctatgcataagaagtaggaagatttttatatttttcctttgtatgttcacattcagatcactcactcagggacatgcactgatttttaaattgtctgctgtttggaattagagatgcctcttgggttttatgcaacttcaaatctgagccaattcagctcccctttgaattggtggccctttttgttgtttattctcatttttttcatagaaggtcaccttcaaatgattaataggtgcactagcttgagcgtcaacacacatttaaaaacatttgtttgattttcagccatctagctcactttggaaacaatcaatagacagggtaaaactttaataagttaaaggcaacccagtattttgtattattctgttttcctcctcttaagtcttcaagctccatatttcctttcgacaaaaacatcaaataaagtccaatagtaagaaagtagcaaagagactaaattaaaagtattcttattcctttgatatactcagtctttaatttaagtgtgatttaatttaacttttgtcttctaatggcaatggaaaattcctgggggaacagatcatggcatgtcctcgtgtttcctctacactgccaagaaacacatcgtagattgaatagacactcaacaaacacatagtaaattcagtagaatattttgagacactagatttgcattgttatttgatgactccctgctgcaacttaaagcttcatgatattccacttgtgacagtaattaaactatatttaacttcggagcccttgaatttggcatgctgcaaggatagagcactaacaaggccttatcttatgctgagtacactgctgcatttatgctgtataattcaggccctccagaagaaagtatatgtactccttattttaaagactgaagacttcaaaagtgagaatgcaaatgaggatagcttcatttcgttcctcttaaatctgtgtagtgcagtacagcgttttttgaagccctttactgaaggtcactcagtgtgaggctagtgatgttttgatgtctagagcactgacagtttttcctctccaaatttttgaaacaaagcctataaatgacagtgaaacaaattatacttttcagagaaaaggtttcatgaaaataaaaatatgattcatttctctcagaggtattgtgatagattttgacaaaccattagcctgtatctttttctcagaagaatgggggtgagttcatggctgtttggggagaggttctttgggccaccggtcctcaatccttgcttaattctttgcacactgagaaacactgtgtggacaagatttcttgccctaaaccttgaactgagccatgtactcctcccaaatcagcttcccttaatacagttttggatctacatgcatgaactcctcctacataattactatatttgttgacacgtgttgaaattgaaaagggagaggtagatgatgtatatttaacattttgacctgtggactctgatgcgtaatatttctacatcgagaatttggaaaagatgatctcatttattaaaaacagttatgctgttaggagcattgtttttagatttcagaatagaatactaatggttgtttagaatctattaaataggcaaaaaactttaaataatcaatactcaaagttacaaagagtttgaagatggtattcttgtatattgatgatattattgcttttctaataattggaaatcaaactgggatttgttctaaaattaaaaatgtgtataatcttttcccaggaattccattttctgaggaaataactgaaattatggagaaaactataagcatgaacaaactgtgtgaggtgttacgtgcaattgcaaaaccaaaccaaatcaaaatccaaataaataatagttgtagaatgattatgaaaattaagatgccttcactcagttgtatattatgaggccttcaaaatcatggtaaattggtatcataaacatggtaaaactgtttattgtacaatagtaagtaaaagcaggctgattttcaaattgtattattctaatactataagcatcagactggatagaaaggaatgtattaaaattataatattagttgtgtttgggtgatggggttattcatttattcatccaacaaatagactatataaactacatatattttcatttaattcttgtaagagctctgcaaatttgcattgctatccccattttaaggatcaaaaatacacaaataataagaaatttagattagatgtttagtgttcaagtttgttgttcagtgatcattccaatactgtggatataaggtttatcaaaggcttacctaaggactacaggacatgaaaattctttcaaacaacccagaaaatctacactttcagatactaagattatagttcaggtcaaaaatctgattgagacaattgctatttgagagagaaaactgagtaacctccttcaaacctacagatttgaaaagtaattgcttttgactttaggtatgttattttgtttctctatagttcaatttcctcatcttaaaatgctcataagaatcacagggctgttttgaggattaaatgcatacacacacacacacacacacacacacatatatatacatatactatacatgtactatatagtacatatggaatatttgtaaatatagacttcatatataaaatattatatatgtatagtctctcacaccagagcagtgcttgacacatagcatgttctcaacacgtggcagctagtattgcaattctgttgctttagttgtaactttactttatagtatgctatgcactaccattctttattcaatatttcttgattaaattatctgcttattcctcaaattaacttcagtcctaactgccaaatttcattttaaaaactgggagttaagctatggagctgttaaaatactgttttaacaactctataccttaattacataaatatataattttttaataccgtcttcccattcatataggtctggcatatttttggtgtttatttctaggagttacaaatttgctactccaattgtgaagtggagatttttcatagtattttacattgatttattagaaaagctattgattttgattggatattcttgtatctggtcaccattatgtgctttcatttcagttctagttggtttttgagattattttcttgtattaatgaatagacaaacaagtggtctgcaaaatgacattgattttcctttgatatttaatgattgatctctgttcttgtcttattgtattggctatgtacaattctttgtaattacattcatagtagatatatttgtttcatttaaaatattttctgcccaggctggagtgcaatggcgcaatcttggctcaatgcaacctctgcctcctgggctcaagtgattctcttccctcagcctcccaagtagctgggattaaaagcatatgccgtgatgcttggctaatttttgtatttttaataatagtagagacagtgtttagctatgttggccaggctggtcttgaactcctggcctcaagtgatctgcccaccccggcctcccaaagtattgggattacaggcatgaaccattgcacctggcccccattcatcaatttaagagagatatttatttattttttaattcagtgtaaagtttaaaactaaggaattagccttgaattttatcaaagactttttcctcacttccaaatgatcatgtcagtaaacagttacaacactgaatcatattaatacatttttaatgccaaatgatcattatatttctagaataaaccctatttggtaattgaataatattctctcaatatccttctatatgtgctttactcatatattgtacttaggatttttacatgtgtttttcataagagataaaatccacagtgaattgagtgtgtatgtgtgtatatattatatttttccagttttgttatcagtttcacatgcttttatagaatcaaagaatgtattaactttcatttcttatcattggttgaagattgtagctttgataaaatttaccagttaagtcatctaatttcagtaaatttggggagagataagtcttttacatttttcaatttttttctacccatagtgatctgtggtcactaatctatgaaaaatttccaacttttgttttgtcaatgtgaaaatttacattattttttgtaccatatagaatttcttattttggcataaaattttatctaatttttaagcacttgactatctttaccataatatttctcaccacccccactcccatttttatttccaatgtggtttacttgcattttctttttatttccttgagtaaatctggaagaagtttgacaatatttttaattttttaaagtcttctattggttttatttttggtgtgtttattttaatatgttttttattctattctatgaatttctgtgtttttgtttataagtttctctttcaattttccttggatttatttatttatttattttttttttagtttcttgagtttcatgcttatctattaatattttgataatgctgaatttggatcaaaaattatatttattgtattctctgctatattacaataaggaatataaaatatttatctttctatataattctttttgctctaaacacactttgttattaatatatggctattactccctttttaaaattgttgttgctggtattcatccagtggatacatctaactcttcatttcttacctttctgtaacatttcattttttattgacctatttgtttatttattttataacttgcatatagctggatgtttgttaagccaatgaataagtttctgtttaataggaacatctaatttatttttcttgtgatcacttctatattttattttctttttgcactttcattttatgacttcttttttttgtttatttttacttattttaaggtcaaactgattatgtttcactatctactacaaaatagtttaggtattcttttattacaattctgctaatgtatatatttgtataaacatactgagttttcctatcagtttcaaagctcaatatctatagcctttataagacccccccatttgcacatgtacaatagagctttaacatatttattttcctttccctttgttctctgcaggattttgttaaaaaccaagaatttaagttcttgattgtcattcttttacattatagatattttactttgactattattttaacatgtaactacttataaacaattatttattcagctttgtatacatattacacaacttgcttaccactattacttaatactctgtctccttttgttttgaattcatttttgattttgctgcaatgtagtataaaaaattttttttcaaaaaagatgcatgagtagcaaactttgtatgtctttatatatctgacatacatttatttatttattttttattctttttttcttcttttctttttttttttttttttgagtcggagtctcactctgttgcccaggctggagtgcagtggtgcgatctccgctcactgcaagctccacttcctgggttcacgccattctcctgcctcagcctcctgagtagctgggactacaggcgcccaccacgacgcccagctaattttttgtatttttagtagagacaaggtttcaccgtgttagccaggatggcctggatctcctgatctcgtgatccacccgcctcggcctcccaaagtactgggattacaggcgtgaaccactgtgcccggcctatttattttttattatactttaagttctagagtacatgtgcacaacgtgcagggttgttacatacgtatatatgtgccatgttggtgtactgcacccacccattaactcgtcatttacattaggtatatctcctaatgctatccctccccactactcccaccctgcaacaggccctggcatgtgatgttccctttcctgtgtccaggtgttctcattgttcaattcccacctatgagtgagaacatgcggtgcatggtttttgtccctgtgatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgttattgtgaatagtgctgcagtaaacatacatgtgcatgtgactttatagcagcatgatttataatcctttgggtatatacccagtaatgggattgctggatcaaatggtatttctagttctagatccttgaggaattgccacactgacttccacaatggttgaattagtttacagtcccaccaacagtgtgaaagtgttcctgtttctccacatcctctccagcacctgttgtttcctgactttttaatgatcgccattgtaactggtgtgagatggtatctcattgtggttttgatttgcatttctctgatggccagtgatgacgagcattttttcatttgtctattggctgcataaatgtcttcttttgagaagtgtctgttcatatcctttgcccactttttgatggggttgtttgtttttttcttgtaaatttgtttgagttctttgtagatcctggatattagccttttgtcagatgagtagattgaaaaaattttctcccattctgtaggttgcctgttcactctgatggtagtttctttggctgcacagaagctcttattttaattagatcccatttgtcaattttggcttttgttgccattgcttttggtgttttagatatgaagtccttgcccatgcctatgtcctgaatggtattgcctaggttttcttctagagtttttatggttttaggtctgacatttaaatctttaatccatcttgaattaatttttgtctaaggtgtaaggaagggatccagtttcagctttctacatatgattagccagttttcccagcaccatttattaaatagggaatcctttctctatttcttgtttttgtcaggtttgtcaaagaccagatggttgtagatatgcggcattatttctgagggctctgttctgttccattggtctatgtctctgttttggtaccagtaccatgctgttttggctactgtagccttgtagtatagtttgaagtcaggtagcgtgatgcctccagctttgttcttttggcttaggattgacttggcaatgtgggttcttttttggttccatattaactttaaagtagttttttccaaatctgtgaagaaagtcactggtagcatcatggggatagcattgaatctataaattaccttgagcagtatggccattttcacgatattgattattcctatccatgagcatggagtgttcttccatttgtttgtgtcctctgttatttcatggagtagtgctttgtagttctacttgaagaggcctttcacatcccttgtaaggtggattcctaggtattttattctctttgaagcaattgtgaatgggagttcactcatgatttggctctctgtttgttattggtgtataagaatgcttgtgatttttccacattgattttgtatcctgagactttgctgaagttgcctatcagcttaaggagattttgggctgagacgatggggttttctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgccaattcagtatgatattggctgtgggtttgtcataaatagttcttattattttgagatacgtcccatcaatacctaatttattgagagtttttagcgtgaagagttgttgaattttgtcaaaggccttttctgcatctattgagataatcatgtggtttttgtctttggttctatttatatgctggattacatttattgatttgcgtatgttgaaccagccttgcatcccagggatgaagcccacttgatcatggtggataagctttttgatggctgctggattcagtttgccagtattttattgaggatttttgcatcgatgttcatcagagatattggtctaaaattctctttttttgttttgtctgtgccaggctttggtatcagtatgatactggcctcataaaatgagttagggaggattccctctttttctattgattggaatagtttcagaaggaatggtatcaactcctccttgtacctctggtagaattcagctgtgaatccgtctcgtcctgggctttttttggttgttaagctattaaatactgcttcaatttcagagcctcttattggtctattcagaggttcaacttcttcctgggttagtcttgggagggtgtatgtgtccaggaatttatcagtttcttctatgttttctagtttatttgcgtcgaggtgtttatagtattctctgatggtagtttgtatttctgggggatcagtggtgctatcccctttatcattttttattgcgtctatttgattcttctctctttttttctttattaatcttgctagcagtctatcaattttgttgatcctttcaaaaagcagcttctggattcattgattttttgaagggttttttgtgtctctatctccttcagttctgttctgatcttagttattttttcccttccgctaggttttgaatgtgtttgctcttgcttctctagttctttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcatttcattatgtacccagtagtcattcaggagcaggttgttcagtttccatgtagttgagcagttttgagtttcttaatcctgagttctagtttgattgcactgtggtctgagagacaatttgttataatttctgttcttttacatttgctgagcagtgctttacttccaactatgtggtcaattttggaataagtgcaatgtggtgctgagaagaatgtatattctgttgatttggggtgaagagttctgtagatgtctattaggtctacttggtgcagagctgagttcaattcctggatatccttgttaactttctgtctcgttgatccgtctaatattgacagtggggtgttaaagtctcccattattattgtgtgggagtctaagtctctttgtaggtctctaaggacttgcttccaaagatcaaaagagacaagaccataatggtaaagggatatatttattttttaacttaaataatttttgtctagataaaaatctttttccaccggaattttgtagttggtctttgcccccttctaggcttttattttggagattatacaataattatgatgccagtttgatttcagttcttttgtagtatttttttcttccttggcaagataatgtttgtttctccttatctttggagttttcaaattttattaggtggtatctagattgcattccacaaatttgccccacccccactgcaacattcctataaaaattttatgaagtgctcactctctgaagatgttagtgtttcattatttccagtaaattttcttttatgaatttcttcatcattttctgcttcttacttttctcttgataggtgtcagttcctttggttctctcctctgtgactgcttttctcttattatttaatgttttcattctgttgcactgaacactggagaatatctcagcacaaacttccatttcacaaattagctttaagcctatatcattctgatatttggtattcattttaattttacatttaaattgtcttatttttaattgcttctttttaagagtaacctcaatcatttttgtgggtgtaattcttttcaaatctctaagaattctatttagtttaaagttttctgtgatttctttttttctttttctttcttttcttttctttctttttttttttttttttttttttttaactgagtcttgctctgtctcccaggctggagtgcagtggggcaatctcggctcactgcaacctttgcctcctgggttcaagctattctcctgcctcaggctcctgagtagctgggattacaggtgcacaccaccacatccagctgatttttgtatttttagtagagatggggtttcaccatgctggccaagctggtctccaactcctgacctcgtgatctggccacctcggcctctcaaagtgctgggattacacgtgtgagccaccgtgcccggcctgtgatttcttttattaaccttgtttcctcagatattagctccttggtttggtctaacaccagttttcacattgttagattttctgaaacatacttttgtatttctaattgaaggctgagattggtaagcagtgatggttagagatgatcttcccagcgaaagtgattacaattcttgcagagagtgaatttatattctaattttagagcagctttgtaggcagagagagtgcatgtttggaccaggcaaaccttcttctaggttacccagagagtttgcctgatggatgcaggggctgcctcttcacaaagggaccagaagttatctggagcaccactggagtgctctcactcttttgccccaaaaacatctgtacgttttctatggtagagtctccattttatttacagaactctaggctagaagctcatgatacaatcagcagtacagcaattctgcagctcaccatccaatacccaactgtgcctccagtccctgctgtctttgatcttggtgttcttcatgaattctgagaggaacactcactttgttagtagccttccctcatgtcttttcaatgctacaggttcagctctattcgatttttaccagcaatctgatcccatctgcctcaaacattctagaaattctcccactgttctggtctctggctggcatccttcccaggtttctagcgctaccatggattcatccttatttttaaatctctgctgttatttgagtggcatcatggaaacaggcaagattgatacatatgctcagatatccatcatgaagcagaaaaactctgtttcgagttttagtaataaaacttgatttcttctaaggaatcagcatagtcgagtttacaaaactcatcatttttcttttgatttcagctttgaataacagtttcagaaatattaagtgttttgtcacatgtttgtacacgtatttctatatcttcataactatgcaaattcaatatttttccattttacagatgaaaaaataaatacttggaaagttttaattagtaagtgatttgaacaatgtaatgctttccaaaatcgtacttttccaaaggataaattgattcaaatataaaacactgaagacttcatagcataacttaaactactaagttttatggtttagtaatttcaatcaggactagttctatataataattcagtaataatttcttcattgctgatttcgaagaggacattaaatgtttgcactgattttggcagagattgtctctaaattcattaaatatttagtttttccacacacattattctattgaccatttttcttatccttttagagacaatgatcactacaatacattaataaatgtgtatatgcttataatatttatatctgtatcacagatataaggtgatatattggcaacaattatcttcatgatcttagtatcaactatacctatttctgtggcataagaattggttatactacaatatggtacaaccatatacctatatactacaaaattgatatatattacaataaacatttctggaaaactaaacaaaacagttaaatgataatattcatcaatagaaataaaacagagcatttttataactttaaatgcatgcttatctttttaacaactcatctgtggttatctaaaacttcaagaatccattgcgatgcacttctgcaggttgacattaataaccacagagctctgggagagaaacattgcttaggtttcttgaaatatgaaaatttttaaaattccagttcctcatttaaactagagaaaactgttagtgatgtgactaaaaactgtgttaattatgaaatgctaatgacatcatgtaagtgagttaaaaggattcttttaacatgctttaccattggtgttacttgttgtcactccaaataggtttgagatcaagaatgacccaggctagtttttatatttctttggtaactgccacttgccaaatcatggaatctggaattaagcttgaaactatttgcacgttctctaagaaaaaaaatggagtagacgaaaatatctttatcactcccaacacccaaatagttaactttttattttcaattgatatttcaactgtaacaattaaacatacacaggaaacatatcttaatttagttattaaatgtgactatatgttttctctgctttcttgtcatgttcagccattttcaaagccctttgtgtgggtatagctggtatttagaacatagggatattttttcctcctcccttcctccattccttccttcactcctctttcttttctttctttctctgcccccccctcaactttctctcaccttttccacccttgtgtactttctctccctctactttcctcccattattttttatttctggctgtcatcatttgattcttagacttaaggtataaattatacattaagagtgtaggtctatatgctaagtatatttgaggctaaggtaatcattttgcgtttatcacatttagtagcactttaagcatctaaactcttttattcttcccccctccttttctccattctgagttgctatttatgtgagtgcttatgcttgcatgtgttttttttctaattcacttactcagaattcttagtagtggtcaattatttcttcattttatcacctggttcttgaaggaagcagcctattctgaaaatgtttaaaagaaatgaaaatcaaaataaactgaaagtgaattcatggtataatttgactgatcagagtactatttgtcttattttcttaaagttcagattgttttctaattacatttttgtttttaatctgttttttaaaattctgacgaagtgatatatttctattcatttctagttacagccagaaactagagaaaaatgattttcagaaccaaaaatttctgctttatatttttgtggagacctttagggaggcatcttataccaacaaggatcaaacgttgaccaaaattgtggaacaaattgaattaatcttaatgaagactgaactaaacacaaatatttgaaccaccacttgaaaaaatacattcttgacaatgaatgtttatcttttatttgtgattatgaacatagttcatattgatgacataatatttctaaagtagagaaaaatataaaggaaagaaagagcaaccataacctcatcaccaagagatatttactacaacaattggatatactgcttttctatatatttttggtgcacatatatttgtatacaagtatacacatattttaaaacttgctgtgtatatagccaagcctttaaaaattattaatataattggttcaactggaagcaagctcgttttctaaaatcactaaaccagagaatcaaaatattctttgaactaaacaattatttcattttaaatcgatctattacagacacatttttcaaattcttaagtattcttctaaatagtctcattagttgtatcatatcattgtaattttaatcattaagggacaggagaaagattctcctgtgtgttttgttgttggaatcctaattttattcattaattttagaagctctttttaaaaaattgttatgaaatctactgttgaagaaagttttaaatttgctctgaagaaactattttaaatttgctgctgccaaactgttctaagatctcaaactaatgcaataacccttcttatggaaatagaacttaatagctgtagtgtgtgatccatttgagctgagcctctcaggagtaggtgtggattcaaggttgttaggtatgatttggagagccttttaaaataaaaatatacaaaattatattacacttggtgaaggtaataaaaaaatatttccacaagtacattgctagggctcctcccagtgtcttgaaaagagcccatgtaagtgagcagccctgaagcttagagctttcttcatattaaatttgccttgactcaggagttaacattagttttcatttcaaaagcatagttacattttacaaattacattactgaaaattgatttatagtttccgtggaaagaaatggtgagggcatggtggggagagccaggggctacactgaacatcctgcagccaagagtaagagaggggttatgtacctgaagtttcaggtgatggcctcatcagtgacatattaatagagaatgattggcaaatattcagaaatcagaaaaggcagtataagctggtagtgaaataagggggaagatctgaagcagaaatagaagtgcccatctcaggatttcagaaagtaatcagaaaggcctttcccagggaaatgcaggtgatattgttcatggctggtgctcactcctgaggtttgatgggtgggaggtccacttgggctcaaaggatcagacacggggtgcaatagacctacaatgtaacaatgaaccagaaatattctcagtttagctgggcattcttgagtgagacaactttccatcttctaaattgctgaagaagcaaaatttgaaatcagaaaatctgggtcttagatctcctgctaactcttaggagctgtgtaatcttcagcaagatttcaatctccccaaggttcagtttccttatttgtaaaataatgatattaagtatttttctggttgtctattgatatgtaacaaatcactcccaaatttagtggtttaaatgataacatgcatttttgtcatgattgtgtaatgtgagcagggctcagtggcatagcttgtctctgtgctactgagagttagctggggtggctcaaaggctgggggatggaatcatcatcatttgctgagtttgctcacaagcctccctggcagttgacactggccatctgctggaacctcagaatgtggctggaaggtctacacatggcctctctacgtggctgcttggcttcctcctagcatggtggctactttccaagggcaagtatccctaggtgtacaggaaaaacctgtagcaccttcatgacttagcttcagaagtcatccagatcacagtcacagacccactatcatttaaagggagggagcagggtctatgtctcaatggaggagttataattcacgttgtaggaagaacatgtggaaggggatatatccctggggccatctttagaaaatgcaatcctgctgctaagataataataggatatgtttatcaagagcatttaatatgtatcaagcgctaagagatttacatacatacatcacctcctttaatttatcaccaaacactctgaggtaggtactgcaattatcatctctatttttgagataagaaaaatgcagcatagggagtcttatttcaccaataatatatttaaggtgtggagttgagatttgaacccatggctctagagtttgtacttttaatccttcgcagcagttattttcaggatcaaacaagaacatatacataaaaatgctttgtgaattctaaatttgctatccaaatttaaatctttttaaaggaaaaactttgggaaactttttcagaaatattaatattttagatttcagacacacaatgaatgtgtgtctggttggctacaaaattaatataacaaataatattgtaatatttttggtgtttccagaggtaaacttctgagaatctttcgttttaaaagaattgtctatgatcattccactctctcatcccagcatccttggccatttccctaaaagtacagaccatcccttgcattttcattatgaaatcagagaatgttagttaaagctgtaaaaaccctaagattttacatgacccaactcgcttttgtattcctagagtctttagatgtggtttccagaagcttaaatgacttttgagaataaataatgatttcggtcacttttcctccctgatattttccggtacatgtaaaatttctagcagtttaactttacagccctaaagaatgactgacttggggtgaaaattttctttttaatttcttttggtggttaaatatttgaacattttattggaatttttcttttttcatctattaatatttaaccaaatagcaatatatgtgtagtacaggaaggagaatagaagataacattcccatgttcctacagcttgcattatatagaagcagcctccagaagcagtgactggtttcagagtagcaggcacttactatctaggatatatggccttcttcttgaagtgcagtgtttcattaaacaagacaaagaattcccgtgtgtgtgtgagtatgtttgcggcagggaaatcaattccaattataccacacaataccacattcttgtcctacgtgaagccttctataaagagttgtgggcaggaaaaagccagaacctccatggcaggtgttactgcagttcactgagaggctgcacagagcaacttgggaagatgacaaggacttgtggcctttgattcatcttgagctgaaccttaggctgagttcttagtgaagctaggccactctaaggctgtttgagatagaaggttgtgatttgatggcaactgcacattgttaaaggtcccaaactctagcctgggtctgttttgcgtggtcattattaggatctccctatggcagacacttctgcaacagaaagggcccaatttgatttctgaatgttgtgccagtcggggcttctctgactccccagggaattcaagttatcatctcagtatcatggtgtgtcctgagcctggactcctaaggctagagtcatagatgttcagattttttattttgtttttctatccagagcaaaaatatcactcagagcaccattttgcaactagacattcttggtggtcagactataaaatttcagatgtattggctttagaaaggcaattgtaggaaaaaaatgccagttgtcaatactcaacccaatgcttcattgtatatttaagatgattagtgtaattggaagtcatggggaattctaccaccatatagttttaactcacactgcaatggctgaagatcctgatacttcactaaaattttacttttattcccactgttgttttctgagactctagatttagttttctctttctttccctccctccctccctccctcccttccttccttccttctttctttctttcgtaagaaaaagacaaataattttgtgaagaattttatcagtcagtacacttatgagttttaacaattgtgtatttcctgaaagtaaataatgaaaataaatttcttaagaaaaataggtggaggatgttagatagttaagagaaagtgaatattgaacagttgagaattagctaactagttttattttatatttttaagttttaatgtttttatttaaagtaccatggtaggtaaagctcaatactgtgctaagatttaaagaaaactttatgatatgcttttctttcacctcagtgaactcaccgtttactatattttattaataataaatttattcagtatttccagaaggtaaaactccagagaatcttattatttttgtactaaaatttcactagtttcaccaagaagagtctgagaaaggagacacctaatttttgagaaatgcaatattaggaagcaaaaggttttatctgagtttaggctgtgacattgtagtgcaatagtaatgcaactgtaaggctagcccccctctcaagttccttctaatttctagaaggagataaatatatgcacgaaaatttatctaccatcatgagtcttcaaccttctttgttaagtaattcttcttagtgtagaattagcaccatcagcactactgatgatcacagatggaagttcttgccactttttgagtcaacctaacaatagtaaactgggagatccaggtatgttctctttcccccaaggcctacctcttctccctggagcaaagttactccataataactattaaaatattacattatgtttcaggagttagaataattaaacaatgtctacttctctaggtgctgatttactcagttaagacctaggcactaagaagacagcacacatttcattgattatgtcattgagcagtggctgatgatgaatttgtctgtactgtcctagaatgttgtaattctcaagtagaattttagactttttttcatttgctttatttcccgttttgtataaaattctgaatgacaacctagaattttttgtgtggcaatgtggtagaaaaggtgttatccccaaaattaggagccctgggtttcaatgtgatcttgggcagatttatttttctgcacctcagctgtaatgtgaagattatggataaaataatctctaagtctcttcaagttttaatattatatatgatatggtatatatataatatatataattttaataaaatgcagaaaatacacacatacacactgccacttgcagaggctctagaagggcagtgatacctccactcggacaaagagtttgtccagcagactaatcatatatttgctgactgaattggtcaacaattgcaggagagtgaatttattcatttaacagaagttattgaatggaaactttgtttaggcactgttctggacaaaggtgatacagacatgacccttatctttagaaagtgcacacaccagtgtggtatgcaggcatcaagcaaacaaccacacatccatggttatatatttatctatgtccaaccataagtgctgtaaagagaataaacggagtgtggtgaagaagccaagataggggccactttatataggatggccaaggaggacctctatgaggaagagacagagctgaaacctggatgatgaataggagtaagcctagcaaagccaaaggaaacaaatgagtgaagtctcccggcaaggaaagaacttgtcacatttgataatgaaaagaagtccaatgtggctgtaaaagtgaactcacagagcggaaagaagtaaggctggcaaaacagggatactggaagtcacatggaacatcttaagctataaaggagttttggactttatcctaagtgtcaggggaaaccactaaagagatctgagccagtaaataatttgatccaattatgtttaagatagctatgatttctaggttgagaatggatcggagaggaaaaacagtggatgtggtggggggggaccacattgaaggatatggcaatagtcaaggagcgagccaatgaagacttacattaaggtaagataatacagatagattcaacatatcattaagaagttgacagattataggtgagcaagtgtaaggaaataaaatgatttcattatgaatgggcatatggaatatatctaagttaacttccattaaagacaactttttcatgtatcacatgcacaggtgtgcatgtgtgtgtgggtgtgggtgtatttggaattgtcccacattttattgtgtattcctctcctcttgttttgttaactgaaaagatctgtaatttactcctattttagaatgggtccaggaaacagacatatgatgaaggtacagttttgatgaccttatttcctaatccttcagaatcaagacctactttaaaacctagtatagatttttttccctggggaagtctgtcttattcttaactgggtgtagatattctctcctctggtctgcacttcagcaccctgtacacagctacaatcattcctttgcaggtctcactcttccagaaagctatgaatttatctagtgcatgggatttcttccatttgtttgtctccaaaggcctagttctacctggcatgtacatgctggaaaacattgaacaacaaagagatcatattgattcataggatgtaatagttgtctttctatgtcctctggtgatagtgtgaaaactgaagactaaagagtggcttacctgagtttttcatttctgctatcatctctctgaaatgagtcagagacattggaggctatcatatggcaggcagtcatagagcttggcaaactgtccttggaagagctaaatcaacaatacctatgtggttcattaatttaaagcttttggaattggaaggagcctcagaggagatctagtcctacaactgactcactctgtactgcaacattacagccgaatttgtctaaaatgctggattcctaattttgggcttctcagaaataatgtctcttttcttagtttttattggtgaaaactaatgatgacttaatagcaaaaaggaaaattagacactaacacattctcattttttggctactaattaattaaattgcatttgtacacaaggacaggggaaaagatatggcatatagattaggggagatgacagaggatgatttccattctggttctttgtgaactattcctttctattttatttatgtatatctttaaccttcatattcttatgaaaactacctgtcttccttgcccatctttttccctctcaggagtcctcttgtcaaaatgtgctgtgaagattttaaataatggccattagaacttcccatcagagagtgtttgataatgatctaaggatgatcaaagcacctgggacccaactgcatgtggaattgacaaaatcaaccttttgtgcaatcctgtgctttgcagccctcacctccttggcaacatgacgcctcagctgcctgctgccttcagaaggatctgtggaaccaaagcacgttaggatatcagggctttaatgggttacctctcctaggatcatttttcttttcaggagcaagagaaaagtaatatcttgataatggtagaatttcttaggttagaagggcccctgccatcattttcgataacatcatatgtaagtcttatcctcaaaatcctggcctgtggagcagataagatgcccagtgacatttactggcttgtattcttggcacttcattgacttgggcttgcccagtgttccacacaggcacagtgtgtcacccctccctgtggtctacccgctatagatgcctactcatatgtctcattctcctgcagcatattgaataccactgtgggctctggagtctcactgcctgggctgtgttctcctctctcccatttactacatgtgggaacataaggaacctttctgagccccagttttattgtatgcaaaatggcatgttgtgggtttctgaagacaaggagataatgaatgtaaagggcttaatttggtacctaacacatagagctcattaaatgtttccaaaacaaataattacaaactctcatatggtactgtattagtccgttctcatgctgctagtaaagacatacacaagactaggtaatttataaaggaaagagttttaattcactcacagttcggggtggcttgggaggcctcaggaaacttacaatcatggcagaagaggaagcaaacatgtccttcttcacatggtgtcaggagagagtagtgcagagcaaaggggagaaaagccccttataaaaccgtcagatctcttgagaactcactcactattaaaagaacagcatggaccgggtgtggtggctcacatcggtaatcctagcactttgggaggccatggcgggtggatcatgaggtcagaatattgagaccatcctgactaccacagtgaaaccccgtctctactaaaaatacaaaaaatgtagctgggtgtggtggcaggcgcctgtagtcccagctactcgggaggctgaggcaggagaatggcgggaacccgggaggcagagcttgcagtgagccaagatggcaccactggactccagtctggatgacagagcgtgactccgtctcaaaaacaaaacaaaacaaaacaaaaagaacagcatggggggaccacccccatagtctaatcacctcccacgaggtccctccctcaacatatgatgattacaattcagattgcaacttaagataagatttgggtggggacacagagccagaccatatcagatacttactatatgataatatttgcatatatataaattatttaattcttaatgataaccctaagaggtggttactattatggccattttataggtgagggagccaaagcacaaggagattagctgacttacccaaagtctcatagctagtaaacagtagggagttagaatttgagcccaggactctctgctgccagagcgcctgcttatcaccattctgcaatgctatctctcctatagatggatgacatcactccaaaagtattggcaaagccattggaaaactcctctgcacaatctgaatccaagtgaaatgcaggtctgactaaggctctgtgatgtgaagtggtgtggaatgagcctttcctaccatgatgcagaaaacctgggctagacttacagacacatagtaagagatgtcggaggttactcagtgtaactccttcacttcacatataagaacactgtaacccagggcagtgcaagaacttgcacacagtcatagttacattgaggcagaaccaaccactggttaggtttccaagggcttttattttatttttaattttagtgggtgcatagtaagggtatatatttatggagtacataagatattttgaaagaggcatataatgcacagtaaccacatcagggtaaatggggtatccatcaccttaagcatttacccttcatgttacaaacaatccaattctactctttattttaaaatgtgcaattaaattattattaactgtaatcaccttgttatcaaatactggatctcattcattctttctatttttttatacccattaactatccccactttcccctcaccccccaactacccttcccagcctctgggaaccatccttctactcactatctctaagagttcaattgtttgaattttagctttcacaaataagtgacaacatgcaaaacttgtctttctgtgcttggcttatttcacttaagataatgacctccagttccattcatgttgttggaaatgagaatatatcattcttgttatggctgaacagtacttcattgtgtatatataccacattttctctatccatttgtctgttgatagacacttggattgcttgcaaatcttagtcatggtaaatagtactgaaataaacatggtagtgcagatatgtcttcaatataccgttttcttttcttttgggtctatacctagaagtgggatgctagaatatatggtagctcagtttttagttttttgaggagcctccaaactgctctccatagtgattgtactaatttacatccctaccaacagtgtatgagggttccctttccttcacatcctcaccagcatttgttattgcctgtcttttggaaaaagccattttaactggggtgagatctctttgtagttttgacttgaatttatctgataaccagtgatgttgaacaccttttcagatacctgtttactatttgtatgtcttcttttgagaactgtctattccgatcttttgctaattttttaaaaggactattagatttttttcctgtagagttgtatgagctccatatatattatggtgattaatcccttgtcagatgggtagtttgcaaatagagctgataaagaaattcagtaaagttgcaggatacaaatcaatatttaaagcattagtactatttatatatgccaacagcaaataatctgtcatgtgggttgtttcttcactttgttgattgttttctttgttgtacagaagctttttttttttttttttttttgagacagagccttgctctgtcacccaggctgaagtgcagttgcacaatctcagctcgctgcaattattgcctcctgggttcaagtgattctcctgcctcagcctcccaagtagctggtattacaggcatgcaccaccacacccggctaatttttgtatttttagtagagacagggtttcgccatgttgtccaggctgattttgaactcctgacctcaggtaatccacccgccttggcctcccaaagtgctgagattacaggcgtgagctaccatgcccggccgcagaagctttttaagttgatgtatcccattagttcatttttgcttcggttgcctattcttgtggagtatactgaagcaatctttgcccactccatatcctggagagtttcctcgatgttttattttagtagctttataatttgaggtcttagatttaactctttagtctattttggtttgattattgtatatggcacactggggtctagtttcattcttctgcatatggatacccagttttcctaatgccatttattgaagagactgtccattcccccattgtatggtcttggcatctttgttaaaaataagtttattgtagatatacagatttgtttctggattctctattctgttacattggtctatgtgtctgtttttataacagtatcatgctgttttgattactatattttgtagtgtattttgaagtcaggtaatgtgattcctcaattttttttccctcaggatagctttggctattctgggtcttatctggttccataaacattaggattgtgttttccatttttgtgaagaacattgttggtattttgatagggctcacattgaatttatagattgctttgggtatatgaacattttaacaacattaattctttcaattcataaacatataatatttttccattttttgtgtcctgctcaatttatttcatcagtgttttataattttcattggacagatttttcacttcttcggttaagttaatgcctaggtatttaatttcatttgtgactactataaatgggattactttttgatttctttttcagattatttactgttggcgtatataaatggtactaattttttaaatattgattttgtatcctgcaactttactgaatttctttatcagttctaatagtttttttgatgaagtctttagatttttttcaaatataggattgcatcatctgcaaacaaggataatttgacttcttccttttcaatttggatgccttttatatctttctcttgtctgattgctctagttaggactttcagtactatgttaaataacagtggtgcaagtgggcatccgtgttgtgttctagatcttaggggaaaagctttcagtttttccccatcagtatgatactagatgtgtgtcagttgcatatcgtttttattatgtagatgtatcgtccttctatactcagtttttgagatttttttattatgaagtgatgttgaatttcatcaaatgctttttcagcatcaagtgaagtgttccctcctcctctattttttgtaatagtttgagtaggatgggtattagttatttaaatgtttggtaaaattcagcagcaaagccatcagctcccaggctttagttttccgggaaacattttattacagttttgaccttcttacttgttattggcctgttcaggtttgggatttcttcctggttcaatcttggtgggttgtatgtgtctaggaatttatttatttcttctaggttgtccaattattggcatatagttgcttatagtaccttctaatgatcctttctaatctctgattttatttgagccttatctgcttttttttagtatgtctaaaggtttgtctatcttttcaaagaactaactttttattttattgatcctttgtattgtttcctttgttttaatttcatttatttctgctctgatcttcattatttattttcttctactaatttgcggtttgatttgctcttgttttctagttctttaagatgcatacttaggttgtttatttgaaatgttcttttttttttaatgtagacacttacagcgctaaaatttcctcttaatactgcttttgttgtatcccataggttttggtatgttgtgtttccactatcatttgtttcgagaaatttttcaattttcttcttaatttctttattgacccaccggtcattcaggagcatactgtttagtttccattttatatagttttcaaaattcctcttgagttctagttttatttcattatggtcaaagaagatactttttacaattacaattttttgaattatttaagatttgttttgtggtctaatatatggcctatccttgagaattatccatatgctgagaagaatatgtattctggagccattggataaaatgttctgtaaatatctattatgtctatttgatctatagtgcagattaagtttgatgtttctgtgttgattttctgtatggatgatctgtccaatgctgaaagtacagggttgaagtctctagttattattgtactggaatcaatctctctctttagctctaataacatttgctttatatatctgggtgctccagtgttgggtccatatatatttacaattgttatatcctcttggtgaattgaccactttattactatataatgatccttgtctctttttatagtttttgtcttgaaatctattttgtccaatatatctatttctgttcttttatgtcttccatttgcatggaatatagtttttcattcctttatttttagtctgtgtgtgtctttatgggtgaagtgtatttcttataggcaatagatcattgggtcttatttattttaatcctttcaatcattccatatcttttgattggagtgtttagtcgacttaacattcagtgttattactgacaactaaaaacctactcctgccattttgttatttgttttctggttgctttgttcccttcccttcccttcccttcccttcccttcccttcccttccctcccctcccctcccctcccttcccctgccctcccctccccttcccttcccttccctccgcttccctccgcttccctccgcttccctcccctcccctcacttcccctcctctcccctttgcttctttcctctcttctcctttcctctcctcttcttttctcctttctttctttattctttctttctttctttctttctttctttctttctttctttctttctttccttccttccttctttctccttccttccttccttccttctttcctgtctacattttagtgaaggtgatttttctctggtggtatattttaatttcttgctttttattttttgtatccgtattattattatgattattattattttttgagacaaagtctcacactgttgcccaggctggagtgcagtgcacgatctcagctcactgcaacctctgccacctgggctcaagtgattcttgtgccttaaccacccaagtagctggaattacaggcatgcaccaccataccaggctaatttttgtatttttactagagatggggtttccccatgattgccaggctggtcttgaattcatggcttcacatgatccacccacctcagcctcccaaaattctgggattataggcatgagccgccacacccagcctgttatatgttttttggtttgaggttaccatgaggcttccaaataatatcttataacccattattttaaacggatgaaaacttaacactgattgcaaaaacaaattaactaacaaacaagcaaagagaaaactaataaaaactctacgcttcaattttgtctgctttttaactttgttgaaaaagtttttaactttttttaacagaagtttaaaacctttttgactttttgttgtttctatttatatcttactgtatcatttatgttttggaaagttgtagttattaattttgattagttcatcttttagtctttctacctaagatgtgagtcgtttacacaccaccattacagtgctacaatattctatgtttttctgtgtacctactagtaccagtgagctttgcaccttcagatcgttttttattgctcattaattttgttttctctcagattgaagaactccctttagcatttcttgtaggacatgtctggtgttgatgaaatctctcaacttatgtttgtctgagaaagtttttattttttcttcatgggtgaaggatatgttcactgaatatattattattccagagtaaaagattttttttcgtcctgcattttaaatatgtcatgacactgtttcctggcttgtaatgtttccactgaaaagtctgctgccagacatactggaactccattgtctgttcttagtttttttttttttctcttgctgcttctaagattttttttttgtccttgaccttgggaatttgattattaaatgcctcgaagtagtcttctttgggttaaatctgcttggtattctataactttcttgtacttgaatgttaatatctttctcttggtttgggaagttctctgatattatcctgcgaagaaactttctacacatatctctttctccatctcctctttaaggccaaaaactcttagatttgtctttttgagactatattctagatcttctaggcatgcttcattgttttttatttgtttgtctcctctgaccatgtgttttcaaataatccgtcttcaagctaataaattctttcctctgcttgatcaattctgctattaagagactctgatgcattctttggcatgtcaattgtgtttttcaactcggatttctgcttgattctttttaattatttcaatcagtttgttaaatttgtctgataggattttgaatttctactctatgttaccctgaatttcagtgagtttcttcaaaacggctatttggaattctctgtccaaaaggtcacatatttctgtctctccaggactggttcctgatgccttatttagttcatttggtgaggttatgttttcctggatagtcttaacgcttgtggaattttgttggtggctggatattgaagagttagatattatagtcttcaaggtcttggcttatttgtccctgtctttcttaggaaggctttccaggtattcaaagggacttgggtgttgttatctaagtttttggtcattgcagccatgtctgcattagagggcacctcatgcccagtaacactgtagctcccgtataagtaccacctcatagaggtaccaccttggtcgtcttggataagatttggaagaattctctgattaccggtaagaaaccctttttatcttcccttactttctcccaaacaaatagagtctttctttctgtgctgagcttcctggagctgtgggagaggtgacacaagcactcctgtggccactaccactgcaactatgctgggtcagacctgaagctagcacagcagtgtggaactcacacaagacccactgtaactactacttggctactgcctatgtttgctgggctcacaattggtatgtgacaaaacaagtcaggctgtgtccttcccttcagggtgatgagttcccccaggcctgggtggatccagagatgccatctaggaggcaggacctggagtcagaaaacttagggatttaccttgttctgtagtctacaccagctgcgctggcactcaagccacaagacaaagtctttcccaccctaccctccctttccacaagcagaggcgtttctccgcatagaccaccaccacaggcctgcagacagtactgcgacgctactgcctatgttcactcaagccctacagcccttcagtcagcttgtggtgaatgctgtcaggcctgagacttaccctttcagggcagtgggctctcttctcacccagggaaggttgagaaattctacccaagaaccaaggcctggaatcggtaaccccacgagcctgcttggtactctaacccactgtggccaagctggtacttaggctgcaacacaatgtcctcttcacttttctctctgcttttctcaaagaaagtagtctcccatcatagctaccacagctgggaatgtgctgggtcacacccgaagccagcacatctcagtctcccccaaggcccatgatgtgcgctaccttgctagcactactgattattcagggcctaagagctctttagtcagcagataatgaatcctccaggactgggtccttcccttcaaggcaatgggttctccaagggcttttaaattcactacatttacttcaagaggtcctcacgttctttgaattaaaggaaacttttcttccataccctaatttccttttgaccctgggtaaaatctattttgacttagctaaatcttattttctactgatgatgtaaaagatatataaaatgtggggttaaataggaggagactgagagcttagtaatagggttgaattgatcccaccaagcataaggtggctaaaagtagctgcttggagggataggagaacagctggatcctgatgaatgtcagtccaatgatgctgggcagtatgtctttctgttagttcaggttcacctgatgagcttgttctggaagtggtctggttttgtcatatgttgggtgtttctgcagggcagtatcttgttccctgtttttcagtgactgcatacctaaaaatgaatattggcaaaaatgaatctgcaggcaagatacattttaagtggctgcacaacaaatgctttctcctcccctacagtaatacacttgtaaaagaaatcatattgggaaagaaaaaagctgttgaaaaaaatctgctaagcaggtacttactttgaatactgagaatatgaaaaatgttttgacatgaggctacagattatgaaagagtgctgattcatattgctctagaatcaccaaatgcttatgctataagaaaccttagagatttcctagtacaaaccctgtattttgaacatgaataaagaagacagaatgatacccagctcaaggtcatagctagttagaggcaatcaagactcctggctctcattctgaaaattttattgggaaatttcatattgtattagcctacttgggctaccaaacaaaattattacagactaggaggcttaaaccatagaaatttattttctcactgttatggagcctggggagttgaagatcaagtttccagcaaatttggtgtctggtgagagctctcttcctggcttgcagatgggtaccacttgctgtgccctcacaggttctcacatacttggtttctgctcataaagagtgtgagcactttggtgtctcttcttagaaggcttctaatcttattggatcagggccccacccttatgacattatttaaccttaattacctccttttaggcccaatctctaaatacagctacattggattttaaaacttcagcatatatattttgtttgggttatgatgggagtggaacttgtggctttatagaaagaagagagacttgagctaccacactcaacctcttcaccatgtgataccctgtgctgcctcaggactctgcagtgtccccactagcaacaaggctcttaccagacgatgcttctcaaccttgaacttctcagtatccatcattataagaaataaattacatttctttattaattactcagttttagatattttgttataagcaataaaaaacagactacaacagaaaattggcaccaggagtggggttgttgccaataatgaatacctgaaaatgtggaagtggctttagaactgggtaagagactggaagagtttagaggagcaggctagaaagatctgtgtctttatgaacagagcattaagagtgattctgatgagggcttagaagacaagaagatggggaaaatctgatactccttagaggttggtttagtgattatgaccagaatggtaatagaaacatagatcgtaaaggccattgtgttaaaatttacagtgaaactgaagaaaaaagtataggaaactggagtaaaggctatcctttttatagattggcaaggaatatggtagaactgtgttcatgcccaagggctttgtggaaagtccaacttaagagtaatgatctagaatatctgtcagaataaatttctaagcaaaacggaagaagctgcatggttgcttttggctgctaatcccgaaattcaggaaaaaaggaatgatttaaaaacaaaatacataattaaaagggaagcagaatgaaaatatttggaaaaccctcactttggcacataaagagtgaaaaagtatgttcagatgaagaaaccaagattgtagctcagcaaccatatggtgaagatattagcacagatagaaggaagctgcatgctactcctcaggacaatggaagaaagaccccaaaggtatttcagatatcttttaggctgtccccccatcacagccccagaagcctaggagagcagaatattcccaggggacaggcccaggactatctctatgagctagctgcccagggccacttcagaactctactctctgtccccaagcacactgcgcagctgctcaactatggctcaagtagccctaggtacagcttgcactgcagctctggtaaatataagttgtaaactttggtggcgtccacatggtgctaattctgcaggcttgtagaaagcaagagctgtggtggcttgacatcctccacctagattctacaggatgtcatggaaaggcaggagttaaggcagatacttgtcacagggatagaggcactgcagagatatcccactagaataataatgaacagaaatgttgggttggagcttctgcagagtactcactagggcaatgcccattggagccatgagagtgggactgccactgagatttcagaactatagagctaccagtgtgcagtgccagtctgggacagctaggtgtactgagcccagtcaaaccataggggcagggctgtcctaggtcttgggggcccaactcccctcactagtgtgcaaaggacactggacatatagttaaaggagattcttctgaagtcttaagatttaacgtctgctctcttgggtttcagactttcctaaggcctcttaacactttcttttggcttatttctttttggaatgtaaatatttgccctgtgcctatgtactaccattgtatcttttttttttttttttttttttttttttttttttttgagacgtggcgccatctcggttcactgcaagctctgcctcccgggttcacgtcattctcctgcctcagcctccctagtagctgggactacaggcaaccatcaccacacctggctaatttttgtatttttagtagagacgggatttcaccgtgttagccaagatggtgtccatctcctgacctcgtgatccacccacctctgcctcccaaagtgctgggattacaggcgtgagccaccgtgcccggcctactattgtatcttgaaattagataacctgctttgatttcacatgttcccagatgaaattctagactttggacttttgtgttggtgttggaatgaattaagactttggggtgatgggattggaatgaaggtatttgtgaaggacatgagttttggggaccgtggtggaatgttattgtttgaacatcccctctgaaactatgttgaaacttaatccccaatgtggtagtattgagaagtagagcattaagaggtgattagattaagagggactgccctcatgagtagattaagcctgagctagcatgttagcacatgagcacacacaaattactcaccatgtgatgccctgtgccaactctgggacactgaagtgagtctccaccggtaaagagactctcacaagatgctcaccatagaccttggacttcccagactccatactttaagaaataagttccttttctttataaattacccagtttctggtattattttataagcaacagaaaacagagtaatacagtcttcatatttgaccctccattgttaccacatggctgctacacctccaggctcaagtccatttactggctaaaaaaagaagagacaaaaggcttaagaagcagaccatctgccatctgactttttcaaaaatttcccagaagcttcacttgacaacttctgcttaaatctcattgcctggaactgggtcactttgcttctctagctacaagggcatctgggcaggtaggtgtttttggctatgcccggtcactccaaacaaaagtgagtattttttattaaagaagaacagaggaatagataatgtatagaaaactactggagtctgaaacatagaacgtgttgtaggtaaataattaagagccataggctttagagtcaggcacatctgaattcaaatcccagctccgacagtatctgggcaagttacgtaagttctctagtcctcagtttcctctgtaaatggagagaattatgacaaataaggcgacgaagttgtggtaaagatgaaagatgataattaagacataaggtctccataaatgctagtgttcacattataccaccgttttaggatcacaaggcatttgtgtttcttatcctccctggacaaagtcatactttaatttcttttaactttagtgagacagaatgttcagaataccaagacacagaagctgatgaaacaggttttattcagcattatttcctattaaaaataattattctctctgcttctagccctttgcctaaagagaagtcctctatgagccagccatcctgtgctcaagctgaagtgcttccttgtgttggagaagtggtgactaggcctgcagcctagcccttgtagggaatttacaacaaacagagagggggtcctgagtcctgtatattttttcttaaggcagaggctcatagatcaataaatctacatctcccaaactcagtctcattgagtcttcaacttaaaaaaagaaagaaagaaaaagaaaaaaagaagacaaatttcttctttagtaaattagggctctcacatcagatttcaggatttctatcaagaaatctgtatgtattacacatggtcttttaatctaagtatgtagatatcacagaaagtggcacatagcctatggccaactttacttaaaggcagtcactacaacattagtatttcttatttcctttgggaagaaaaattgttatgtgggcattatgagcggttcaattcccttctggaaaaatttcccaaataccctgtaatagctgtgcttggcatggcattcagttttcatccctatgtatttttatttcaaacttatttatattaacaaattaataaatgattattgtagataacttagaaacaaaaaatattaaaaatataaaaacacaattacatataattctatcgtctaaataaaactattgttaacatttttatacttgttctttaagctttatatatgtaaatgtattgatatatatttttaaaaattggatttatattttgcattctattttaaaccatgctgacatttaaaaatatgacataaatattttccctgacattgagtacaattttatatcatccttgaaaatgtttgcatgcattatttttataaatacataccaacctcctattgttggacacaaattgttttctgtttttattatttctaatatgtgctgtgataatttttgtgactgaaacttcgtggaaaatgaaattattttctgagtcaaaggatatgaacataatttaacatacttcatagtattgatattaatattacaaattttttaccaaaaagatgagaaaaatgtattacaccattaacatgaactcttgccaacagtggatattatcattaacaagtatatatagttttgtgtgagcgtgtgtttgtgtgtgtgtgtaatttggaggtaatttttctgaacttgttgttgctatatacaaccttcctgtttttgattatataccaataccacataggtaaggatagtggacaggtgagatagaattgctcctgtgaacctgtttcttgcacgtggaaaccacagtgggaaatgctgggtttttttccaagaatgatgatctccttttgtatttttataccacttagattttgccttctcttaacttctttctccatttcataaatagctaactgaagttagagaatcaatgaagtggatcattgtatgaagctctaaaatggatacagtgaggcatgagtgtttgtaacttaaagaagactcaatgacagaggctggatatagataaatgtagactttcaatacatctttaaacctaaacactaaaagccccaaaataaaaaagagaaggactttctttgtgcaagtgtggcagaaagtcatggacacaaggtgaccatgagtggacagtgaagcactgcagtaaagaaacaatcatgagcttgggttttataaatagcaacatgggcataaagctaaagctactgggtcagtgctaaagccttatgtccactttcagattctacagctgtagaaagacgtggagaatattccctgcacttttctttgttctgggaaatttaaagttattatcacatataatttaataatcatgatgagttttttggatgtgcattatgacctccattttacacaaaagggaccaaaacttagaaaagaaaatactttagggttatccagctctttactgaggatgcaggattcaaaccaggttgatttgcctttaagtctcatcctctcaatcatttagctgtaaggcacaatgggaacacgatgctgagaacacagtgaagcaagaggacaaagattacttggcctctatgctattacctaaagaaaacacccaatttgtagtaaatccccttcttctacttgggtgctatacttgtgcctgccaaagctggaacagaggtgaggctggaaaattgcttgtaagattcttttgttctctttgattgcccagtgtgaggcagctccttcactgaccttgaatataaatttccttatatgccaccacctgggaacaccgggacaggtgatgattcactcacctctgactgaccagacccatcatgctgactgtgttagaggactcagcagatgtttggatggaggcaggaaacccataacattttctaggtattaagtggcagagcagaaccaaacaaattaaaaggctgccaggaaaagtgaaagtaataggggttgtttctctgctggggaagagaaatctgaattatgacttccagaaggacaacctcccctctccccaaagaataatttaaaccagctgatatctgtctgcactgagaataaagaggaaacaaacaaatttagattttatcataagaaatttaggtaaaaaagaatttcctgatagttatagatgttgagtattacaatagttttccagaaggtgctgtgaaatcaattttattcacagaaattcttatttttgttttaccctttattactaatttaaaaaaattatttttatttttggatacataatagtttcccatatttatggggtacatgtgatattttgacacagtcatacaatgtgcaatgctcaaatctgggtacttgggatattcgtcacttcaaccattgatcatttctttgttaggaagattccaattttactcttccagttattttaaaatatacaataatttttgttaactatagtcaccctgtggtgctactaaatagtagatattcattttatctagctgtatttttgtattcattaaccaacccctctttatcttctctccccactaccactcccagcctcttctgaccatccttctactctatctccatgagatttaacttttagctcccacaaatgagtgagaatatgcaatacttgtttttgtatgcctggcttatttcagttaacataatgtcctccatttcaatccatgttgttgcaaatgacaggtttcactatttattggctgaataatattcctgtataaacacacacacgcgtgtgcgcgcacacacacacacacacacacacacacactacattttctctatccattcatcccagtgaaattatacttcaaatatgaaggagaaataaagactttccaagaaatattttttaaatgcgacattctcttgtttgtccaagatgtcataggaggcaaagtagttggttgacagggagtgatctgtgacccaagggaccagaccaggaatggattcatcatcacaggagaatgagagagactacatgaaataacccaggaattaagagtgtctagagtataagatagcagattctccaaaggaaaaccatttattttttagtgaaagtgtacaaacaaatatctacatattttctctatatgaatgtttcccctgatttactgatgtgtaaatatgcaggaatgagcaatgttgaatacagttgtttgaccaagaaagtgtttgaagatgcactgacaggatttgaactaagtgctacatgatggctgaaatgttacttgagccaccaaatggagctcagatggttttaaatatatcctcaatattttaggagtggaaaaaaaatcaatttaaagcctagttttcagtgcctacttttttgccatgatggcagttcgtacaggtgattatgaaatgcaacacaatctgtttcatgggtcaatgaaacttagccactaagtcactataaatcaatttttctgaatacatttccatttttccagttggataattatgtctgacttttcaaaatcataccgagtttagagaactcagagttgcagccattattttctctcctgagatcccattttacccccattttcagtgcctatcttaactttactctggtataaacaatcatgtccacttctattattttaaagtacttttatgattattcaaataataggatttctttgtaagctccatgtgttctccttcataaatatcccatcagttctgtctagaagttagttttagagcatatcttgatgtaacctaccctctgtaaatattgtcacataactaagataaaaattaagatttttcaacatattaaattgtgtatgttatggactttgtcagacgctgctcttccctttctcttgtactctctaggttttaggcaggatcttaacagtgataaagtctgttataaaatcttctacaatgcagcaacatatagcacattaccacgttgcaatcttgtaggggtatgccagaggcctcactaaagatcttgaaacagagtgtcattctgtaaatcatgaaccttctgctccagtggttcttctctacttactgcctctaaaaatacctcttatggattcacattcactcccattcaccctgaatgccaatgccttgcttggcatcaggcccactttccttcttacttttctgaagaggtgttctctgattatctctgctctcccatccttaaatctaggatgacggtagtttttatttttcatgtagcatatatggctcagtactgctgctgtattttgtgtgcttgtgtcatgccttcacacctatactgtaagtccatggaggaagcagtacaaaatggtggttatgagcaagaacttccaattaagatcctagatccaccactgtgtccctttgggtgagttacttaacttctttgagcttccacatcctcacttgtaaaagaggggttataacttctatatggagttattatgatgaataaatgaaatgcttaggtgtttatcccagtgccagacacatagtaaattttcatcaaattgaagggagagtcaatgtctaacatttcttggcaactcttaaagggcagagcacagggaatttttcaggttaagagttcaataaaatatttgctaatccaaagaaaatatgcagctctctaccagccctgagtgtttacaattacatagcctttttatttcttaagtgttttattataggtcacttttttatatattcacaactttctttcagagctacagatactagacacagagaattatctagataaattcttcaagccagcaaaagcaggaagaagcctaagtggcagaatgggattggggaaaggcagagggtgggctcgtggctgggtgtactatcttcagcctgacattgcttgctcatgacctggtagatagccaaagagcacatgtcccctagtttctttctctttatggagaatctgcttatattttaagactcagaacaagcgacactttctttagacagttttcctgattcttaacccatagcacctctattagatacttgcagttgtccttgtcatgtcattagttctgtttttagtaaatgaaagtaatagaatgttaagctcaatgggaggtggtttccttttcagtttgtatgctctttgcatctaacactgttgtcaataccatgagtataacagggttgttttgagaatcaactaagataatgtgtacaaatacaatttttaaagtaaagattgataaaaggacaagttctttctacattagtgctgcactcatgggaatttatatgtaagtttggagccttttaggtatcatgagagaaatggggagtttaaacatagtcaaatacgtaatactcagctgtctatcaatatgtgtagttaagaattgctgttcagatgagaacacgtggacatatgctggggaacagcacacactagggcctgtcatgggaagcggtgcagggagggagagcatctggaagaatagataatggatgctgggcttacaaggtgatgggttgatctgtgcagcaaaccaccaaggaaggtgtttacctatgtaacaaacctgcatatcctgcacatgcacccctgaacttaaaagttgaacagcaacaacaaaaagaattgttcaaacaagagcatataaataaagaaattgggacaaacatttcatgaaaccagttaactcatccagacattttagattatgaaacatacatgtttaattgctttttgctactaacagaaataagaagtaacctaagaatcaggacagagctgttccagttctcacatcaataagcttcgtgcccattggtgagatatttcacctctctgtgcctcagtttccttgtctataagctgatctgtttttctgagtatgcctaagggtctttattaggtttaaaacacaaggattttcttattctaatgcaaagagcattcttgttcgtttaacctgcatgtgttttcaaaaaggagcaaaatcttttctttattgaagtccaagggtgggcaccctgcaatttaaaatcattctccttgtaacacaatcttctgacaggccgacagtgacttctgctgagagggtctgctagtgatgtctatttaccttgcagattcctgaacctgcatgtattgtgagaaagtggcatctgacttccttcctcgcgccctcttctgcagatgaataagccattcgctggccagctgtgtgtggttttctcccttgtaatcagtcaatgcctgtcttttgagtcgtgacatgtttccacagtctttggagctgaggattttgtgatgtgttaatgcttcgtttgggcttcactggactgaattaggttactgaaggtgtttgaattaagagaaaaatgcattaatttgatcatttaatgttatgaaaaaggaaataagaaagcttcttttaaaaaatacaggaatgtcttattagatttaattacaatgctcatgaaacttttacagatgttgacattgaagtcccaagtcctttctgaatactgtcatatttttacaattatttgcttaaataattgctgcatttacctgatatttatcttaaaaaattttgaaaactactgccaaattgtgcaccaaaagttagaactgctttcacaaacagtgtatgtacttataccttgccaacactgaatattattaatctttgaacttctagcattctattaggtaaaaaaataatgtttcattttaaaggtactctattgatagcaaatactgttcagtgatttgtttcatatacctgttacccacttttacttattttgtttaaattgcttttgcttataacttttgcccatttttccattgggctgatacaacaaatgcacctttgctgtgcatttaagtatctggaactatcatgagtacatcattgaaaaagccataagaatattttctcgtggagattacattctaggggaaaaagaaaaataaagcaatcagtaatatgtacagcaatgcaccagtaatgacattttgggaaacagtgggccacccatatatgattgtggtcccacaatcataataagattataatatggtacttttactgtactttctctatgtttagatacacaaatacttaccactgtcttacagttgcctacagtattcagtacagtatcatgctgttcaggtttgtagcctagaagcaataggctattcgatataccataggtgtatagtaggttatgccatctatgtttgtggaaacacactataatgtttgtacaatgacaaaatcgcctaacaacacatttctcggaacatatccctgtggtaaagtgtcacatgactatattgagataaaagcatggggaatgaccaggatttacttagaggttgctttaagctaactgatcaggaaaggcttttcaaaggaggtgatatttctttcatgatatgactgataagatcacccagtagcagagcatcttttcaggtgatggaaatagcatgcatgagtttggggtattcccccaacagaaaaagataaaagcctcctgggatgaaccttccaatttctccaacttcatctcttctcactttccctccctcaccttctccagtcttatggagaagcccatgcacagcctggtagtccagggaaaggagtttccattttattccaaacatgttggaatgcaagtgtagctttctgtaaaggagtgacaaaatcagatttacactttaacagattactctggttgctaggtgtgaaatcaatcactgagaacaagaatggatgccgggaggccaatcaggagcctacggcacttgtctagggaagagctgatatttacttggtgtagaggatactatgctttgcccacccagatttcctttacctgctgtatgtgccagtctcctagctaccatgaaagtaggcttctatcggccaggcacagtgactcatgcctgtaatcccagcactttgggaggctgaggcaggttgatcatctgaggtcaggagttcaagaccagcctggccaatgtggtgaaaccctgtctctactaaaaatacaaaaattagccaggtgtggtggcacatacctgtagtcccagctgctcaggaggctgagacaggagaattacttgaacccaagaggcggaggttgcagtgagccaagatcgtgccactgcactccagcctgggcgaccaagagtgagactccggctcaaaagaaaaaaagaaagtaggcttctatcagtcccagttgccagcttcctgggaggcagtacctggtcttccttcttgtggaccttagccaatgattgactgacaaggggatcccttgcctggaggtggggttaactctctggtgtaatgtgctctagcactttattgtgttgtcagcctgaagctattctttagcttaaatgatgtttctgcttagctctttcctactgttcttccctgcttctctttgccttctcttcctcaataaattacttgaacaataatcttcatattaggctctgtttttaaataacctgacctaagacacagtttagagtggcagaggctgaaacagaggagagagaaaggattaagaatgttctagagataagggctacaggaatggtcctggaatgtgagaaaaagacagaaataaaagtagttctcaaattttgttattgcacaacttggtgggtaatggcatcatgtactaatagatgtctggaagaagtagatttgcaaggtagagaaggaaataattttatttcaaatatgttaaagtgtctataaatggataccatcaggtaggtaaataaaccaatcttttgatcccaagggcagttcagtctgaagatctatatttgggattcaacagggattcaaatatcatttgaatgcatgtgacagagtgggagtacctatggtgagagtatagatgaaaaagacaaaatttctcaggattgagtcctggtatgacaattggagcagagaaagaaaatccaacaaacatactgaggagtgaccagtgaagtgaggaaaacaggagaaggttgtatcacagaaataaagagaataaaatgtttccaggagggtatggccaactgttgaatgcaactgggtggttgatgaagacaacagatcacaagatatggaaacagggagattattgctgatcttgacaaaagaagattttgataagagaagattatgaggtaatgggtatgcctatgtccaaactcatcaagacgtatacattaaatgtgtacagtttttgtatatcaattagaagtcaactaagacaaagagaaaaaaatgctaaaaaggaaagaatagaagaagcaaatacattgacctaggcaactattgttgctataaacaggagcaatgaatgagtaactcaagagggacaatgaggtcaggggtatttttctttttgattgacactgataggaaggagaaattgattatccaagagagggaacaactgtaggagaaactccttgaatagacaaaaagtgatgggatctagtgtccgtgagcaggagttggctctaacctaaagtagacacacttcaaatttacaacagaaagattgatagataatataaatgccagtgaagaaatgtttatagatgttgtagtgggaggcaaagctagtttttggtagactgtttctatgttcttattgaaatatgaaatgacaaccaagccaaaatggggagtgggaatggttttggtagtttggaaatttgaagagagaagagtaaggatgaaatgattaatgaaatatttaatatttaatcattaatgaaataatttattccttctgtaagaaaatttacttacaggggtgatgtagtataatttccttgtgctattgaatatcatttttggtacatgtgctgatgaattttaaataaaaccattcagcaaggttgtgtcttttttagccatatttaggtgctcaggtgtagacatggaataggtagatggttgggtttaactagcattaatgtcaggaaaacataagagagttaaggaatttgcaagaagcaattaagaggtagactatgaaatctaagctgggctaagaaggaaacaagagggaggatggaaggaaaaaataggaaggttaatggatttgaaattttgatgaggttgaaaaagtgctgcagtagaggtagtagaatatatgagtttgtatgataagatgaggtagcagagatggatgtttgacatccacattcagaggtattagaaacatctgtgataacatggtcaaaagtgtgaccctggacatgtgtgggttacaggaaacatcagtggaaggggagagtttgagaaatcgtgagggcatggtatcagatgtatcatccacatacaagtgaaaatcctcaaacttcgggagaggaatagagacacagaggctcataaaatgggggctaaaatcatcagtggaatagagagacagggaacttgtaaagtgtaatatttatctcattgatttctatgagttttcagttttttgaagtgtattttattacaagaatgctataaaacaaaaatcaaaatataagacacaaacctctcataatcccatcactttgtcagaggatggtggattttgacaaagccctatagctgtttctggtctgctgatctctggcctggccaggtgttccatttattttgcttgctcattcttcgtggaaacgttgcaggactttatgttaccaagagtgtctgtctcttaacctggcagccagctgatgcaagtcctcaaataaacagagcttctcttcatgctcctttgacctccctagtccaatgcactgatctctcctacgtggttaaaatctgggacaagaactattaataatggttgtaaaatagggcagcaatccttcattttataaaacatgtctcattataggttccctagctcagatcgtctctcgttatttccacagagttgattgtctggttacatttgattactctctttaatccatccagatcttccgtcagtctcagccatatttacaaattatttggcaagtccgttctctccattcctgtgactaacaagttgttattccattgtgtaagtagtgttattgccacagttgtcttgaacatctgctgattgtttctggacagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaaggtaagtttctctctctctctctctctctctctctctctctctctcacacacacacatgcacacacacactttgaaacacatatgcttgctttcacaaaactagacttgctaactccaaagtgggagagatgtgcagtgctgagctgaacattagttctggatctcactgttaatgtgaatattggcatcttcctgctaaacaacagcagaacaaggctcaggagggaggattggttaagcccaggagtttgaggttacagtgagctatgattggtgccactgcattctagtcttggtgacagagtgagaccttaactataaaaaaaaaaaaaaaaaaaggaaagaaagaaaaacaagagcagagcagcatataacaagatactgatactttttcagaaaaaaaaaaaagatggaaagctgtttggcagaatatgtcttgatctggagaattattcgtttcacttgctttctccacacccaagccgatgcttatgtcttcctacctcctaaacatgaacatcttattgagatatcagtggataaaggacagcagtgaaaatggaaaatatgtattaagatttgaaatttacagagttggctaaagacaagtgaagatatgcaacggaactgtggaattttataatatatcatcttgtcacatttatgagatagctaattttgatgctttctgcatgtgatttctggaattgctggtggtggctcccaaaatttctgttctctttctaaatcacgtgtacttgtttggcaatagatggtcatcatcactggatttttcatagggcttttgacctaacagatatcttgtttaatttgccagcttctaatattgcataaataacctgctcagttttccccaggaacctactgagtttacctgatctttactgatcttcaaccctatcacactcatcttccgaagctctttgtctcttcccatctcttcttctgggtacactacaatcatatcacacccattaaagagcctcaaccactgatcttctgctctggaagctaggtagtactggtgtggacatgctcactggacctttcccttttgtccttgtgtttataataatgactgcaattctaggaacactaactttgccatcacctgaaattagaggtataagacacttgagggactttttaaaagaaaataggatagaaatacaaataaatgaataaagaaacagagatactctccaagcatgaggaggtgtggagccaaggtcaaattgtaattcatgattaagataattattaaatgtgggcaaaattggcacactggcacacagagtcaacttggcgtcttcaacatggtgcagtttttggaagccaataaaatgttcataagaaagcaggtcttctaaggagtatttaaataagaaatgttatttcttttaggagtgaaaagaaggtaagcagtattgttgaagtgttacacagagtaatatatgcaccaggacagagggtgtccagacattcaggcctttccattgctctgtaacatgactgcttttaggaaggttgcttgtttttaaaaaattctcatatttataatttacaaaacaacagtagtctgttttgcagaatttattccttttataatatcctcaaaaaagggttctggagatattgaaaagatgtggcaaacctgtgagcttcggggcatatagactacctaattatgaaacataattacacaaaattgtgcggtgtgtaattggagtgtgaaaaatgtatcctgtcaccattgtgagctggacaagaatgataatggcaacttaagtctttctagctcttttattttacctcctaataatgcaattgaactcatacaagtatttctgagagtcgcacatgtgtttgtttatgtgcttgtctatgaacaggtcagctacatgtgatgtctacctcttttattcctcttacctgccccacctctactggattccacatatccgagggagctattgtctcaatgaacacctgagcttctgaggacactgctttctgtgctaatagttacggtcactgatgcatggaatcattgagatgacaaagctataccatactctttgccaagtgaaggaaagtgtctctctgttcttctgggctactttccacgagtgtctatcaaaatggtgttggcgtttaatctcgaatcttagagaattttaatgaaagcagcctttaaaattttttggctcacaattttctctcccttccatgacattcagatatgagttcataaggagctgagctggggacagagccaagtagtgagacgatgccatccttagaagtagccttcccttcaggtggctgattccctctctttatcggggatggattctatcctaaatgctgctctgtcactcatgtcaatggacatgtgggcttggttccctcatgtcagcagacatgtccagaatagctacagtttaacctcaagctacaacttctagctacattagtaatgctgtcaaatatatctccctccctttctaagggattttatctaccaaatgttgaagttttttgagatcagaagccattgtttggtttctttcgtaacacacggtatgattctggctactgccagagtcacaagaagggcattgtgtaggtggtcatgaacttcttttcatatagtaaatcatggtgtagatagcagcaggagagatttggttaaaaaaaaattaggactttttaaatgaagacctacatgccctcgtctccatgtctgttactttctctcacacttcacatgcaatgtgtctggaactcgtcttgacactaccatcaaaacatattcagatgtggacaacttgtcaccacttcctctgctatcatcctggtccaagccacgatcattttcccttggcttattgtgataacctcagaatcggacctcttggccatctagtcttaacatagaaggcaaagtgatcttctaagaaattaagtcaagtagtgtcactcatcacctcacatgcctaatgccttaaaatgaccccctatttatttcataacaaagtcattacaaaggccttcaaagctccatatttgaccacttggaatgagctgctgagaatggaataatgaactatactgatagaaaaatggacttttaaaaaaggaagttctcatagagaataaaaatattatatattgaaaaaatgtggtggtaatgaaaaaacaaaacaaaacaaaacaaaacgtggactaagagttctagctatgccatgaagcaattatatgatcttatttacttagtagctttttgtcttggagcctatttttttctattaaaataaaatatttggctccacatcatctttaaacatttttccagtcctagaatttataatatattaagacaatatgactaatctaagatcagtagggatgtatttatagacttatctaatattattcattaatttgggctgatcaatttcttcaccagccacttcgttaaaaccagaattcatagaataagctggtcagtattaggataaatctgttgttatgaaatatagccagcagacccaggggagaatcaaacctttgactttgaataaattggcatagtattcttaccaagcaaattaactaatcacaatcaagttaatcattgtgcaaaagaatcatttcttcttgtctctatgaaagctttatttaagatgcttctcagaattatgctcactataataataattgtaataatgattgtgatgctgatgatgtacctgcgtctgataatacctgtttaggacttactatatataagcactgttctaagaactttgcacataactcatttaattgtcacaacaatgtgataagataggtactaatattattcccctttcaatgtacggagtacagtaacttgtcaaaaagtgctgcagtgccagtgctgggatttgaagttagggactgcaacatcagaatctgtgctgttaattagtaagtttgtggggtaatggaaaaacaaaacaaaacatgagataagagttctagatttaccatgattgttttgtttaagagatattggcattaatcttagtttccttttaacttgctctctctttcagagatttatttcacggtttagagtcaccttctttgggaaaatcagctaaagtatctcccatgagaaaattattttacatttctagttattctttatttctttgcattcttttatttcatgcttagttttaaatatttcctatgataattcattaacggataactcatttaacctcttttccagctcatttctttatcttaacatgggactttacaatgtcattctctttgcacaccaggctttatctatagaactatatttatgtagaagtcaacttggaatgagtgctatttctctaaaattctaagttataattattaaaattctaatagttaactgatggatctgttctaattcttaaatttttttttatctgaagaaagtaaaactgagaataatttatgtgtatgagcacaaaaaatagctaccatttattgagggtttggtaggtactaggctattaatatatgttgtctctagttccaaaaacagccctgaaaggttgacttgaaaagcagagaagttcaataattactccaaattcctaagtttaataagtggtggagtcaatattcaaacttactactgaaccatattatcatatacatatataggtattgaattgtaacctcctcaactgtaggaaccaagttttatacagttgtttattttccttcatgcctagcacagtgttttggtatgataactttttaataactacatcaaaaagcttgatagctagtagagagagcatgtagcctcattatgtgacccctgatttccctttgatagtctagaatcagtaaattttacctagtttggtaagggttgatgctcttcaatcagcctgtatctgaacaattcatctgtaaaattggaacaacaacccatttaggttgtcttatttgtctaatcacaaaatgcctgcttgcctggtgagtcatcactgggtctcactagtaggtcccttggcggtaccttagctccactaaagacacactattctttcagggtgagtgagagcctcctgactttagtcctttgcctagtgttggcattatcctgagcctccaccctggtttcctcatcttggaaagcctttactgtaagttcacattctgccttgttaggagtctttgactagacatactaggtgtaccatatttatttatatatttgctagccctttttactggattctgactacatctttttttttttacagttcttgcatttcaattgcttgtcccttactactgtgtgctgttttatctattgcttctcgcaactctgtgatcttctcactcattaggccaactttctatcactcctcactgcagagaaacaccacccccagccctttagctaaaacttgatccaagaaaattttattctcctgcttttttagttgaaacacaacaaacacatcaaacacacgtgtaaaaaatggttgaaatggagcaattgctttatttggaaagaagactacagtttcatttaaaagcaaatgaaatacttggtttttactgtgtaccttttggggtctttttctttcagaacacacatttgggaaagtgacctctatatccttgaaacataagattatataccacggtgttatgtttcatatactttttaaaaataaaatatgagttattttagtttcatgtttccactatggaaaaaaaatggggaaaactctaaagtttgcagcattcaggaaaaattgcaaagattttattttaaagagaatgtggactttcattgaagtgtgacatctccaaaaatggattataatcagaaggccagcaaggcagataagcattttctgatgcataatggtcatgacttacagatatatgacttggccttttctcagctcccaagggcaggaaattattacaaacctgcagacaggctatacttttcttaaaacactactgctctacagacagattaatgagagctttgtggaaaattacactgctagaaaaagactgagaaatgttgcttgggaaggagaaggaattttgtttagaatactctggagaataaatattatttgtaagatatcaacaggtatcgtgtgtatagatctctgatacagaattggtcaggatttccataacaactgaggaggttgatttaccttaaagttggtaattataaacccttcctatattctaacacctatagtctcatgtttcagataccggacatctgaaacgtgaaagattccactttcatggtctttacctgcctttagggtattaaaacattgaggaaaaggatttctggtgctgtctgcgtctgtatggcactacccaatttgaatagacggaaaaggatgtcattatgattcagctcattttgtctttgatgctgatcagagacaatatggaatttatcttaacatgttcttgtagcacttgtggcagttcctacctgggtttaaatcacaatcagcagacacacttaaaaatagattccctgatctcaccttagaccatcaatacaatttcttggtcaggactttggatcttatttctttttttattttccccgtctgatgaattagctttcagaatcactaccttatgatgcctagatcagggatttgcactcatgtggcattcactatgaattaactgcttatggggcatatttgaaagggaagacaaagtgaaaggttaactctattgtccattattctaccatttcagctctgtttttttctttcttgaaatttacttgccttcaaggtttttgtcttaaactacagatacatttgagattagtaaatagtagtcggagtagtaaaaaacaatttgcagttctctttatttcctgtgttggtgtcttctcctgctgcccaaattggcctactgacctgccctctgaaaacacagtcatgttccagttttctgactaatcaaattgcaaagtaggagcatttaaacataactcaaggttatgagtctagagttgcctggggcctaccaatgaagtttctcttgctaattaccagaatggggtctgatgactgaattgttccttaagttagactctctccataaccacttatctgtctacatcataaaactggggaggttttaaaaactttaggttttgggctccaccttcttcagattccagtttaatatgctggggaagggacttagtaatttatatgtgctcttcaaattagctttactaaattcaccaattttatgtgtttatttgatggattttgataactctacgcagtgacataagcaccaaagcaatcatgatgtagaatgcttgcacaatgtttcttagtaccgccttgcagtctctcctctgcaacccctggaaacaggcaaccacggcattacactttggctttttctagaatttcacatagaaggaatcatacagaatgtagtctcttgtgtctgatttctttcaattgacaaaatacttttgagattccttcatgctgttgggcatattactaatttcctctttattgttgagtaggattccatggcatagatatatctcaacttgcttatccatttacctattgatagacatttggattgtttctaatttgtaactattttgaatagtcctgctgtgaacattcttgtacaagtctttgtgtggacatgtattttcaattctctttaggaactatctaggggtgagattatgggtcataagtgtgtgtttaaccttgtcaattactgtataagaaattgactattttccaaagtggccatataattttgcagttccaccagcaatgtatgagagttctaattcctccacatcttcaccaaaatagtattgtcagtcttttgacttttagctattccagtgggtgtatcgtggcatctctttgtggttttaatttgcattttcctaatgactaataatgttgagcatttttatgtacttatctgacattttagtatcttttttggtgaaatatccttcacatctatgtccatttggattttcaggttgtttatcttctcattatggagtcgtaaaagttatttataatttctggacacaagtgatttatcgtatatgtgtataataaatattttctctcaatatgtgtctgaaatttgtattctgctgagtgtctttggaagatgaaacattttgaattttaacagtgtagttatcaatttcttcttttatggtttatattctttgtgttctatcaaaaatattttacctcctccaaggtcacaaacatttttctaaaagttttatattttttgccctcatattagatatatgactcatttgggcctaatttttgtatatgttgtgacttaagggtgaatgttctttttatgtaagaatatcccagtcgtttgagaacattttactagaagaaatattatttcttcactaaattaacttgacattttgttaaaaataatgtaatatatgtgtgtgtgtattcttatcttagattaattgaatttttagcattcaattttatctctatttttggcttactagctatgacaattattttatgaatagttgatctagggtttaaaatatacttctttacgttgttattgcccatgtcccaagaatattatactgcatcacatatgatataagaagtttatgatagtaaatttctatttctccctgacttttgattctattgttattatgtattttatttctatatctattcttaaactcaaaatacattgttatttttgcttaaatagtgaattatctttcaagaaataaaaaatgagaaaaattagcttctatatttacccgtataaaaactatttatgaccttcttcattcctttgtattaatccatattttcatttggattattttttttctgcctaaagaatttcgtttaacatcacttgtgggacttatctactgagacacattttcttctactttttgttttgcctgcaaatgttttaattttgtcttaatgaaagaaaaatgcctagtatagaattctaggttgatagttgacttttatggtcaatactctagagatattacttaattatactttgacttgcatggtttctgatgagaaatctgctgtacttctttttacctttgtttctctaatatgtattatcactgaatgctcttaagcatgtttccttatcactagtattgagtcattttattatgataagccttgatgtagtttttaaatatttatgggacttggggcttattgaacgttttagattaagtgtgatcaaatttggaaaaatggccattatttcttcaaatattatttctgcctttgttgttatattctttctagctgagattccatttatatgtgtttgacttcttgacatttttacatagaaattttatctatttatttattttccacttttttcttttacattttcaacagtttctattgctataactttgagtacactgatcttttgttttgcaacatctaatctgccgttaatcccatcatgtaattttaaaatttcagatattgtatttttcatctctaaaagttatacctgagtattttgtttactttctatttcttttcttaacatggtcattcttctgggatatataaaaacatatttagagtagttgttttaatgtccttctctgtcttgccaggcaggctttccactgcagtttatggggtatgtgctgttctcagtgttgtgtaagttccaggatttgtttgttctatgttttccagtgagtctttctcccgccttagatattttcttctcagatatgtgtacatcagaacttagctaaagactggagggaatccctccaaagatttgtttttcaacccacttttctcctttttggtactctgtcccagtaagtctacctgcttcaaccttcccaaactctgatccctgttttcttatttttcgctgaatttcccccgccctgttctgcagcctagagactaccaccagacagtaacatgggcaatttggttcatctctttgattttacttttctggagaattatagtcctatattgacatttatacaatgtctgataacagttggttcatatattttatttcgtgttctagttgttgaaggcaggaggccaccatttcacattcctactagcaatgtatgaagcttccacatactaaccaaggcttgttatcattattgtcctttttatatagctatcttagtgagcataaaatgatatctcacgtggttttgatttgtctttctctaatgtttgtttatctgagaatgtctttatttcacctttaattttgaaaaatatttttgctggatataagattcttggctaacaacttttttttccctccagcatggtgaatatgtcattcaactgtcttttggcctcttttgtttttcataagggattacttctgtatattactgtggttttctttttatatgatcagtggtttttcacttgctgttttcaagatttttctgtttaatcccatgtaaccatttttactatgctgagccttaatcttcttgtgtttatcttacttagagttcattcttgcatatgtagataaaagatttttcagcaaatttggaaagttttcaaccattattgctttaaatattttttcttctcctttatctttctccactttttctggtactctttttatatgtatgttggtacactcacttaaaggtatctcacatttctctgaggctccgttcatttttgtttttattgttgttctattttctgtctgttctttgggttttgtaatcgttattgattcactcaatatttcttctgccagttcaaacctacagttgagcccttctaataaactgttcattttctttatcttttcaactccagaattaattttggtccttgttttttaataacttctgccttttaattgatagtctgtatttaattagacactgtcattatatccttttttttacttctttaagcatagtttccttagttctttgaatatatttataatagatacttttaagactttgttatagctgacatctggtccatctcacaggcagtttttggttgcctgctttttttttgcatgtatgtgagtcacacttttttttaaaaaaatctcatttttggttaaaaactggaaattttgttaatatgttataacaattccagatactaatcctgttcctcttctctggggcttgattttgttattgtttatattttttgtcttgggtagattattttattgaagtctatttttttgcagtgtgaaatcacttgaataatcttttttgaatttgtgctgtgtactgggggcattttatatatgagaaaaccatggctcactgagatttgatgacttatccagagccacttacctagtcactacagcaaagatattcaaataaaaatttgtctagcttaagagtactctcctgtgtaagtagggtaccatgttgaaggttgcagaggaagtatgtatttattttctgttttctactataataaattaccacaacgttaatgacttaaaaatacaaaattttaatattgagttctgggccctcacgtgccaaaaaccacctggtgtggcaactgcacgccactctgcatcctacagcgtggatcctctgcatgtgcttttgggagatgagctcactgaaatggccatgtccagtcaaggacactttgagggaaattttgagtctctggatcttgcagaatttgctcaaaatcagccatgggggaataagatgtttggacaggaatctggatctctggctaaaaagtatcccgtgacaacccagctgttaattggaagcttcactagatgatgcatggagttcatattccaaaaggttgaaaattggctgcaacagctgtgggggggtgaattttttctccttcagcttgcaagtcatactgagtacatcaaagatgactggcaacaactagaggaggacatgaagaaagcaaaagaacagctgaagatccataaaagcaatcagatacctactaaggtcaagagcaaagctgaggaggtggtgtcatttgtgaagaagaatgttctaatgactggggaaattttcagaggtcttctgcttggcatggcatcataaggaggatgacctcatttctattgttcttgttttttttccagccaccagcctctatactccatcatagggcatagagccctgcctcttcttttcccatgacttcctccctgctgtggcaaatccaaatggctttgggaagcatctgttggtataagttaatatggtcctaccttgagcttgatggtggcagaagagacaatagatattagttctccttccagtcactattaaagatatgctttactcagaaaaaaaaagacaaaaaagctctggatgccaaaagtttgaaatgagtgtcactgggctaaaattaagatattggcgtgccttttctacgttccttggattgtagaactctgcctacattccttggatcacagccttcttcctctattttcaagccagtagcattgggctgagtcttcctcacactgccatctcccttgttctctcttctgtttccctctgctactgttaataagcattgtatttacattgggcacacctgtataactcaggacattctccctaatttcagaccaggtgaatagaaacctttattttatctaccaccttaatttctctttgccgaatgtattcactggttccagagatttgagcatggacatctttgactggctattattttgagcagaaggtcaaagagaggacaggtattagtagtctgtggaaaaagcagtatctaggaaatatttggtagaggagtgagggagccttaagagattggtagattgagggaagaacttgataaaaagtaagaatcttaaagctatatgaggtgagggatagccaagaaaggtcttagcacagtgatactcaatgtggggttgggatgagggcactatatttccacaaggcagcatatgagtcttagagggtaggttagtggtctgaaattaaaacagtattttttatagtcctagaatttgtttttgtcatatttaatggcatttggatttaaaaaattgaaaaatgtataacactttatacttttcacagaaagagataggttttggaagagtagagaaatactaactgataagttgatcagggagataggatcagaaataaatacgtaaggctggattttgaaaagagaggcgacatttcttcctctgacccaggagagtgagcgaatgactggctgggtaaaagtctggatggactttggtaataaacggattcagaagcaggtgtgctgcagtatgcaagttctttgactggaaaactcttgattttggcctgatgcagcaactcacgcctgtaattccagcactctgggagcccaagtgggtggatcacctgaggtcaggagttcaggaccagccagaccaacatggagaaaccccgtctctactaaaaataaaaaaaaatagctgggcatggtggcgcctgcctgtaatcccagctactcaggaggctgaggcaggagaatcacttgaacccggaaggcagaggttgcagtgagccgagactgcaccattccactcagcctgggcaacaagagtgaaactctgtctcaaaaaaaaaagaaaagaaaagaaaaaaaaaaagaaaaagaaaaagaaagaaagaaagaaaagaaaaaaagaaactcttgattcttccaatcctatcatatcccatctctttttgtgaataaactgattttgatgaatagtaaaataattaagagccactgccttaatcattctagacagtaaaaataaataacttctctcactgatggatgattccagagttttatctaaattctgtggaatggttgaaaattgcagaataatttttttcctgaggttctttttttttttttttcgagacagagtctcgccctgttgcccaggctggagtgcaatggcatgatcttggctgactgcaatctccacctcctgggttgaagtgattctcctgcctcagcctcccaagtagctgggattacaggcacccgccaccacgcctggctaattttttgtatctttagtagagatggggttggccaaactggtctcaaactcctgaccttgtgatccgcccgccttcgcttcccaaagtgctaggattacaggtgtgagccaccgcacctggctcttccttgaggttcttactcagagttgtagtttcagttatgtttatgtcaggtgtgctcacatatttggaagaatatgaatccttacttgatatctgacatcttatctctaagagataaattttatctctaagagataaaaatttctatacatttttaagacaacattgaaagttgaaaaaaatcatgtcctgaaaattcagtttgagaaatttttactcttttttcctagtgttaaattttccctacacaggtatattccctggaaattgctataggcatttttttttccaaaaggtagacacagcttcagggatgtgtggaaacactacacaataactactggatatgactttatgggcttctggatttagcattcctttctaatagagaaatatgaatattattttttctccttgctcatcaaatatagcacattatatagttcttaaattttactctagtccatgcctgtggggatttcaaacctagataagtgcaaaggagctggaattgcaaaaattgtgtcagtaaagaggtatactgtgtgtagtttgctggtatgttttgccaaagtagaatattgaaaattattatatctatgtactgagtttggtcactacatactattggaaaattttatattgttatacaatcacttaattaagcttataatttccgaaagataaacaagagctcattaactatgttttgggttattagattaggaatgtttacacttgtatccccagggctttgtgccttgaattttctttaaagagaggaaagtcttggctgaggctgactttctgtggagaaagacttgtgaaatgcaaatggttttcatccatccaaaatctcattatctcaaggctcaatttgggaaaaacttgcttccaaactcattcactttgccattgccatggctcagattcttgctggctatttgttggagctaacagtttcttgccatgtggacctctgtgtggggccagcccaggtgagatctggcttccctgaggtggggggcggatagagagagagagatcgagagagagaggggagaacatcacagtctttggtaactaattgtggaagtgatatcctgttacttttgccatattctattcattagaagtaagtcactaggtccagcaattcaaggggaggggaatgcacaagggaatgaacacaaggaggcaggatcatcttagaggctgcctattatggtggtagaaacagacccatagtatttgcatttggaaatcactttttctgattaaatatgcttggctgttagtcattttatagtcttgcttttaaagctattattctaatgaggttaaagcagaaatcagaatgaaaatttttcaatgacaccattggaggacatacgtccctgtgctagtgttatcacttgagttttcgagacttataatagattcttgttacaacctctactttccttaaatgtcatctattttaaaagcttcaggtaaagcctctcacaagttgtctggacatgtctatatagatggtgtttctttgctgggtttattgtgttttccatgtgactttgaggagcagtctatgaaaaacaggagtattttgctctacagaagttagtttttccttcaaaattgtaaatagtaagaataatacaatacacataaatacaaatgcaggatccatctcataaatccaaaatatcctcctctgggtcattggaagtttttctttttaaagtcacaaactggagttttcaggtcttcatgcacaattcatatggtaaggaaaaaaaaaagatgtatatgctataccttactagccagatgagaaaggcccaccatcttccctatagttgatagggtatgggttacattaggttataaaaatatataggttgtatttcacagagcttacaataatactcgggttgtctaaacctgtatgttataataggccattgtggttttggggaaacctctaaccctctttcctcactttaaaagagagacaaaaattcactaactatagtaactatctcctaagttattctgaagattaaataataaaatataatcatgataagggcacagttttgtttagctagcttttgaaaccctagcgccctttcaacagtgctttaggcttcataggtattcagttaattcttaatatcaaataatgtgtccagttcagtacctgatacacaatgaattctcagtaaatgttgacaattgtgattattcaacaataaaatagatttctctaggtgtcagcaaggatcctttaactggcaatagtcaagcagaggttttgaaacacctattaggaactggaagggattaataaattaggaaatttattgatgtacttgactttaagtcatgatgtgttataattgctgtttcagaattgttgggttaatatcttacctgtttttgaggattacagtgaatagctgtaatttgaatatctccccatgagcttctctggtcaattgaggtaaggaaatcagtaataaagactcagagatcttaacatactaaaattttggttttagtgtgttgacttgttcaagagttcacttgttcaagagtttagtatgttcaagagttcacttggctctgtctcctgtagaatcaacagctcaaaatatttgaaaggaaaaaagaagtctgtaagttttccttcaagatatattaaatattgtatattttctaagcaacaatgaagttgtactattctataccaaaataattagttgattcaataagttcttagaagaggattaaatcttttaacgaggttacttctctaaataagcaataaattacatcagataattactcatagaataatttttaactagcatccataatagaaatacctgcattctaactccagattccccattcattactaagagaacttgagtaagttacttaacctttctctaaagtgataccaatattaacatctctcatattagggctattgcgacctttatgaagaaaatggaatttaactgtttaacagaattcccctgcatgccattagaccaatatatattagctacacattttagccttgtattactaaatggactcagcctgagctttcttttcttctttaagccttaagtatttggcttcaagtttgtatctcattttcctaacagaggaccaggaaagaaagcagcaaagtaaagtaagtgagtcctttatgtctgacctttagtccattgtttcaatatatgatttcctaatctcaacccaggggaataactagaactgacatgtattcccagagtgacttcctctgacaactcacagcaggctagaatagaatagaataggctgagttaaaaattttagattatcttcattctctttctgctagatgtgttctgaaaatagtttgtacaagttaagtttcacttctttcctctaggatattattaaaggtgtctttcttttaatttggctctctttgattttttatatagcttaatatatgtattttttatactcaatgttcttaaattcctggcattcagtttcagagcttttaatcacactaaaatctgatattcacgtttgcaactttttgaagctggataacttatgagtactgttttggaaaaaaatgaattgcattcctttctcagttatcattatttaaatggcatctctgccttcactgaattttttttcttttgctgttgctctcattaaatgcatttttgcaatttgagtttgaccatttcttgtctctgccttgaaaaatgcattttaaaattgtagacaagaaaaatgcctgtgaaagatcacaatctcatagtcatataagcacttgctcatcataggtctgcagagattatttttataacaggcctacagaactctttattctgtgtattaatttgataaattttactttttagatgaattttactattcttggatttacagaaaaactgctaagataggtcaagaaagttcccctatactcagcactcaatttcccttagtaagctttattaacatattttattagtagagtacatttgttacaattaatgaatcaatattgatactgcattataacaaaagtctatgttttccgcagatcatagtttttacttactgtccattttctgtttcagaataccacattctctttagttgtcatgtctccttagactccttttgggtatgacagtttctcagactttccttgctttgatgacctcaatagttttgaggagtactggtctggtagtttgtagaatgtctctcatctagcacttgtctaatgttttttctcattagtagactggtgttatggatttgggggattaagaccacagaggtaaagtgccattttcatcatattatataggttgagtatcccttagctgaaatgctttgggattttgaatgtctttttgatttgggaatattttttctaaacacaatgaaatatcttggggatgggacccaagtctaaacatggaaattaatttatgtttcatatacaacttatacacatagcatgaaggtaatttcatacaatatttttaataattttgtgcatgaaacaaagtttgtgtacattgaactatcagaaagcaaaggtgtcactatctcatgtcttctgcgctcaataagttttaggttttgggacattttggattttggattaggaatgctcagcttctatcaacatgacttatccctgctgatattgatgttgagcatctaatttttatgtattttttaaaatttctcatttagtagccattcttatttggataccaaatgtctatgcttgtatattcatgtttgggactatctgccctagaccaacttgtgtactgttcattatgtacatcacccactggctggcactgctaaggtgaagctgggttaggaacatccctgtgatttaattcaaagatgttaatctacccacaacaaggcctctaatctgggctggtggtataagaatgggaatcgattttaatgccttggaagagagtcctgtgagaaatagacagtggtcagaacccagacatatggactttttgtcctggaagtaatccattttcagataggaaatacagagtaccagactataaaccactggcgaatctcaaatatacaaattgggagaaaagggtatattgaagaaaataaatcaacactctcacgtgcacatgtgttctcaggactaacactgactagtgcaatccagacctaaacagcaagattcctttcagatcccactacctaaaatgccatgcccccgctggaaaagataaagttttacttcatcttgactttatcttgattttgagcttgcagagagatgaccttatgaccccagccagctaagcctttggagaaggaatgggtgggtatcagtgtagggtcaattgattgaactttctgctcattcatttatatgagagaaaattaaaggacagtgtgcctgttgtttagattgtagagtcagtaagtagcatgcccagaattagaactcagaactttttttgttttgttttgttctgagacggagtttcgctttgtcgcccaggcgggagtgcagtggtgcgatcttggctcactgcaagctccgtctcccgggttcacgccattctcctgcctcagcctcccaagaagctgggactacaggtgccggccaccatgcccagctaatttattttttgtatttttagtagacggggtttcactgtgttagccaggatagtctcgatctcctgaccttgtgatccgcccacctcggcctcccaaagtgctgggattacaggcgtgagccaccctgcccagcccagaactcagaacctttaatttttttttgttctttattccttcatcttttaagagtttgaaaaactcttcttttcccagcactttgggaggccgaggcaggaggattgcttgagtccaggagttcaagaccagcctgggcaacacagggatactttgtctccacaaaaaaatgtaagaaaaaaattaactggagtatggtggtgtgcacctgtggccccagctactagggaagctgaggagatttgcttgaacctgggaggtcaagactgaagtgagccatgatcacctaggtgacagagcaaaatcccaactcaccaaaaaacaaaccaaaaaaaccaaccaaccaacaaacaaaaaactcttcttaaaagattatctgtatttttctatcatttcttaactttaagtttattttatgcagatattaacttcttttaatattatagaccaaaccatataagagatttgctagattttgttgctgctagtgttaggtaccatattttccaattaaagatagtttattttcactgacaatatgaagtaaaactaagatttggtttatttctattgtttatgcaagaggaaaagttatcttaactgatttttacataatgaggttatacttagatgattatctcttttaaaagcagaggaactttttttttcatctttacaagttagagctcttggaggaataaatgtgaaatatatattgtgtggagtgatcgttgatgaaattccttcctgattattctatttaagaaagaactaaaccttttcttctctttgtcatataggttttgcaaccttgatcatttttcttttttctttttttttctaaatccaaagggattgtaacaaccaaatgtcacgaacttaaactttactaaaattggttttcttcataggactttcattagcttctcatggtttactctttccaacccacagcctggttttacttttaacacactgcactttaggtttaaaatgttctaataaaatagtgcttctctaatatgtgactttaagcaaagtcgactcttgaataagaactcacttacagcaaatatttttaaaagcggacctttctggttagctctaggtataatggcaggagatataatcttagtataactagaaataacctcaatgtgataacacacttaaaacccataggattatgaaacgtataattataagagaaattctgctgaggagaatttgtgccaaagaagagatgacactattttcactgcccatcaactgaggataattggcaataacacacctcaggtacataaatagatttgcagtgcccatggataacatgcatttcagcaagagactgctgtgaatacgaaatgaacttggaaagaggctaggaaacttgaaatgttcacacataacttgccacctttaaaaaaaaaacaaaaaaaaccacaacaaaaatccacaaattctccaaagagtaatggtgagaaatgaaatgtctgaggcactgaataaggaagtctttgtgataacttcagttcactaaataaaatatgtcctatgccaccatcctaggatatgaacatattcaagattaggaagaaaactcaaaataactttcaatcttcaagtgagaaaagaacatttcaaaaagaagatcaaggtccttaactccttattgtattgaatataagttcactctgccatgattactgttgtattttgaatatacctacagcacttgatctataattgtcacttaatatattttgttgaatgacttcagaaggaaaatattgatagagaactgaattatggcataatgttagaaattcataggttgatccaaaatattattatagctcaagctgtcaatttctcctttctttcgaataactagcaagtagggtacttttgtctccttgtcgtttgtcaatgtactaaggactaagtgcctgagtctattactaggtaagaaagagaggtgaataaatatgggatcagaatgattaacaatgaaaatcaattagtaatcatttttcaataagatttattaattataagcaggatgaaagcaatatagttaataagagcatacaaaagattattcttggaacacacagcagtggaattttagggatgtaaaataagagatcattaaaaaggaaaagcaattgagaaagggtagttattttattaataaaaaagttgtgaaaggttatgtcaaacatttccacagcttacctaagaagttcttgttttactgaaagtaaaggaaatggattggacataacatgaaaattattggcctattttgttaaccttttcatccacatctcatgtacacagaatatagcttaaaaattattttgtggtgcactgtaagcttttacaacacagggtctgcaaacagatttatttcattaataagaaggaaagacaagaagcttgattagtagattgttttttcctctagcaaattgtttctctttgaaatacattgtctagagttatttttagtagaattctaaacgacaggtggatgaaactttttcttttttgaatttgtcttgattgcaagaaattatctaatttcatccctcagttccccccaagtcagttacagctgtacatgcagtgctatctgaattggaaatatacttcaaaactcattcatttgcatgtctattaggagaacaggcaaaattctaatgacaacaattacttgccctttcctgatgctctttaaataaagtactttgcaaactgtacataaatttgccttaaaatgttatattacccatacatagtacattctcacaaagacttcttaggttggataaatggagtgctacctccatcactgcagatttgaatacaagttattgttgtattttttttctggagtggaatgagatgcagtaatttacaacatgaaacaagacatacatactggggttaagtcaataaaacattccactcatgttttctttgaatagagacactagccaaagatcaaatatcctagataaactgagtattaatattttctcataaaattagtaacagaaatacctgctttgtcaggtatttgttgaatttgttcaatttgtcaggtattctatgaatttgttcttaattcatagaattagggtatgaatttagttactacagtagaaatgaaactaaagtaacaatctggaggcaggcagttaagggctggtaggacagctctacctcatgaggtcttctaagattcaggctccttcacatttgtcattccatcatcctctctggagttgttctcatctgcagggttcaagatggcttaccatatcatctatcgtctagtcactggaaagagaaaaggagacaagtggagacctccttcctttaaaagaaggacatgaaagttctacatattcatcacttctcttcacatcctgttgacaagaactttgttataacatgccacatttagctccatgagagattgaagagtttattctttcttttggttgtccatgtgcccaactaggaactcttatatgttaaataattctcctattatttaacaataggagaataaattttgggagacaactgtcattttctgttccacttcccagctcttaggattgtggtgagggtcaaataaagtgacggaggtagaggagatatattaactgataacacagtaaagtaaaaatggtagttactagtcctgaaatcagctactaggacctgggtgggaacacagctctgaattttagtttctatctataaaaagacggccagaatagatgatctctatgttccttttccatgccttgtattatgatcttaaagttctttgtgtctttcttaagtaactgtgcgattctcctctagaaccttcgtgtataggctgattgcttggttttatgttgtctaattcaggtacatttctctccttcatcagtttctgctccttagtctgactcctaatgttggtggttccaatatctaccctgacttctatctcttgcatatggcataaatcctcatatttttctaagttctttgtgcagtttctgtaaagataggaacacagctgaaaacaggaagatgtatctcaggaactacagcaataatcaggccacttagtctgtaaatcacacttggagtgggcaattaactaggtctcctccccactgagaaccctgaagcattgtaaaatgtaggacctggaacactgctggatttagccaggaattcaatatttaaatgggtcacctcggacatataatagcacttgccagatgataaaaaaaggtttaacagtatgatcataaatcttgggtccagcctgggcacttggtttttccctaacttgttttaaatcagtttgaaaaagacagagggggagataattatgatcacagaatctttgaatcagaagaaaatataaaggtcatttcacttaatttccctccagaagaagcactctctctccaacttcccaaacatgtttattctatttttgcttgattggaaactcactgccttctgagacaatccattgttctattgtttacaatactgataaattctctaattgtggctgataagttttttctgtttttttttaattaactatctgtggattatctgaatgggcctcatggactgctgtgataatatactaaattttattctccttgaatcagagtttcgttacttaacactaaaatgccggcatgaattcagtaccattaactaaatttttattgagtcctgtggtaagcaaagcacagatttcctatacctctctatcttgtattagtctgataggctatgctatgctgcaataaaaaacaatcttaacattctagaaacttaaatcgataaacatttatttatttttcatgttatatatcatctcaggtgtgtggggctctgcttcatctcatcctcatgcagggatgtagcctgatgaagccttcatgatcaacaagattgctctttaacatagagacaggaaaggaatgtgtcagagtatttcccttaaaaatgtttaccttgaaaagactacatagtttccactcacatttccctggataaactttattttatggaaaggaaatgaaatagtaccatgtgtgctgaaaggtggagaaccagaaatattcattctccagtaaaatgttagtaacaaacatgtaatatctggtcaacaaaaggtcagcttatttttatttccatgcgcacaatacattaacctctttaaaaaggaggtaacccaaaagtaccactgagtgacagcacaaatcttctaaatcatgacatctggatgatatgcagtagccttaataccaggtctgaatataaccctttttgatctgaacacatatgaattaaaaatgtacattaacttcctctcacagtccaatatacgctgaccaaagtagaataggataatttgaataaacattccactttggaaaaagaataataaaagaacatggggctagtctggcctagagcaattgtgctgtgccatacagccaagactgtgaaagctgcctaccttgaggttgagaaatattccttgcacagaccctgatttggctacctgggagtagctcccttgtcctctgctctctgtgaccctctgaaagattccttcctttctgttaccctttgtaggcatctctgaaaaactggtattggaaaatatgccttctttcaggcctgggcagctttccacatccactttctgcttacagatgactgacagcttaaggattaatttaaacccagattagtgacattctctttcagtccagattggtgatttgtggtgatttgggagtaaaattctctgaaaactttgtgggtgtcctacctatttgattccaatcagcgtttgatgctagcaatcccacccacagttcttaaaatacatttcttaggacagctatattctgtaattttcttatccacatatctctaactattgtccattgcagatactttgagccacttaggcttagagagagtaataccattaagctcattttctgggacacatacctttagttagatctcacgatgagataccttatccacttagtgctatagacatacttttttttctttttttttaaattttgagacagagtcttgccctgtcacccaggctgaagtgcagtggtgtgatcctggctcactacaacctacacttcctaggttcaagtgattctgctgcatcagcctcccgagtagctggaattacagctggtttttttttttttttgtatttattttcatttttatttatttattattattattatgttttttagtagtgacggggtttcaccatgttggccaagctggtctcgaactcctgacctcaagtgattcacccaccttggcctcccaaagtgttgggataccaggcgtgagccaccacacctggcctatagatatactcttaatatgacaattgcctctaagactgattttactttgcctttgttgttcaaagactatgaattttacatttttgctgtttgggctggaaatcagttgtctctgtattcctgaattcaaggacacagatttctttttcattcttgattccaaaccattttgttttctgaccaaatttcttataatcccttgccaaatgcagccaatagctacctacacaacacagatactgtttcttagcctcttttctaagagtcctgagtttactgggtacatgatctgtttaccaacttactaaaggttaacagttttactagatgttttcctactgcttaactgataacagtttcttccctacgtactgcttaattgcaaagccacagatcatagttttttttgttgttgctacagctgtctccttttcttgtacaaatgtctacatcaatcaaaatgtactaaattagtttctggtaacaaacacccacaacattttagtgatttaaacccacaaaggtttatttgctgttcgcactatgtgtccattgggctataggggttatattgtacattgtcctaactcaactgtctaagaagggagttttcctatttggagtgcaactgggaattatggcagatggaagggaactttaaaggtctctacctagaaataacaaatgtcagttatatttaccttttattggtcaaagaaagtcacatggccacatgtgatttaaagggaagaagaaatgcaatattactatgtatttaaaagaaggagacctagaaatatcggttatcagcattaaagactaccctgcttcttttaattttgataaaagattggttgattgtgtttaaagtctagaaggtctaaagctctgaaatgctagtgtttgcacaggtaacaaccaaatgtgatttcattattcaaatgtctgtagggctagaatatattaatcaactattataaaatatttatataaccatataatatctgctaaatttcagaagaaaagatgaatccattataaaataaatgaagactgcatcaagaatatttacttgctaatacagacagaaggtgttttgttttccaaatgaggacatttataactcataccatatcacgaagtttttgatcaactagaatttgcttctcattttctgctaatccccttacttgtatgagaggtatgcattaaggcacatttataaagatgtcatttaagtgtcttagaacttttagaatttgtccatggcaaaagatcatattcttttgaatgatctatggtacccatcaatgcaccaagtagaggggaggcaaagacatatttcacggacaacaacaaaaatggatgttctcttattactgggttaatttaattgaaatataatttatatttgctaacaaacaagaagaaaaatatctacaacaactaggcacaaaacatatatatatatatataaaattagctattttgcttttttataaaacaacacaaaaaacaaaagagtaaaacgatacaaaagatgccaaatgaatagatgaggttttggaaataattttctataatcggtaagaacaaccaggcaaatgcagcatctcatgaggtctagtagaatagttgtttatttattattatttatgttctatttactgttaaaaactgaatatccagttggtaaaatagcaagcctttgtcctgtgcagagagcactttctttttaaaactaaggttcattatgtttatctctgcacataattatcacagtcatttaaagtgtttcaaaaaaggattaatttttctcttacagctaccatacattatagaattaatgggaatctcaaaaacccctgtggtcactgtaccactgagatgtctgaaatagccttttctctgattttctttcttccaggcatcttttctttcaaatccatcctttatcctaccgttaaatcattctgtctacacatctttttttctaaaaatccttttttgttaatatgagttcaagacaaaaacaattttaatgccctattttttgtagcatacagtctagacctcttgtagtagcactcaggatccttcacagatgttacaatcattgcttttctcttccaagagaatggcaattctctattgctacctcagttgccacaggcatccccatttctggactgaaatattgtaccttcccttgcaatttgtactaaaacttaaaatccaagaagactcccatgaatattatcctacttttaaatgttaatgtcagaatgtttaattctccccataccccaataacttaaacatgcccaattattaagtaatgagatgatttcataagccaaagaatacatttttaaatttcttcacaggaccaagcttacagtgaatgctgacgaaacgtttgctagttttttgaccatgtagcattggcttattttccatctcccagcaaattcataaattagccacaaaattagactacccattttagttcctcattctctagaaccagaaactcttttaaatctagaacttgctgcctcacttccaaacaacagtagtagttacacatttctcttttccctggctttctgccctcacgttttttatcagttttcttatttgttgattcacaatccaattgttgaaaacatagtctatgctaagctactgtgctaaaagctgggaatggagaaactatctcctccttaaagagtccataacgtggttgagagagagaagctaaaccaatatgcacaataatgttatgagtgtttagactaaaatacagttgagtataatgggaaacatttgaaagcaaaagaattccaaagctcctacttcttaattgttgattttttccctaagtatcattttcttgttgtttcacatcattaaagaaactttttcattcctcttaagccttaagatccttgatctggttcctatgcaatggactatttttcctgttttcctcagtgacctggcctgctttttgctttctgtggcattcccaccagctttttgagcctcgctcaactctgggttaagccactatgacatcctgctgctttttccatctgtctataaattctgtagcaattcctattctgattctaaatatgagcctaatgcaatgagtgagttgacttcttcgactctcttgcctctgaactcttttttcatgtaatgctttctataagcattctggtctgtcgacctgaaatattgacactcccactttcatatcattatcattatgcttcacatgttagaggtctttatatatcccaaagtcatttacattctcctcattaataaaaaccttcagtacaagtgaagataggcacttgattgcagtgttgtaattagtaggagagttaggatttaaatccaggtgttctgattttaagctccatgaatctaccacattctctgcagaagcagcgtcatggctctctccactacgattctatctgctgtgaaaaccttctctagacattgaccttccaccgaggtagcataaatctttcttctgctaataacacatataattcatggatatattttaactaatcaaaatcttcactgttaaataaaggaagggaaatcccatggtgccaaagtcaaagggaaatttaaaaccagaattctatgttacagtgttttgctttggcaactcaaagatgggagggcaggaatgttagattaagttcgggtatagggccttggagttgttgagtggagttcagtatccactggggaacagaatctgtgaccttggattcaattgaagaaatgggaatgaataaccatgctaaagctggacctttacaagaaatggagtaagagaggaagtggggaaaattttcacatctgcctgagaagcaccaaagaacttgactctaccaaaatcctaggtgggaaataaaattttccagtgaaaagctgaaatcctaggccagagccacaaataagcatggagtctgaagttagtttataaatgttttgttagactcctcaagccaagctactaattttaaaacattttgaactagtaaacatcctgggagtgttaagaaagcaaagatgaaacaattatgtaataaccaaactggggtccatgagattcttaagggaaaaaagtttcactaaaaatgagctcatgagaaaaagtagaaagtacacgaggcgatatcacaccttgagggagttggccaacacgaattcaggaggagcagctctctcaaaacgagattacggaacagccacaaagaggctgggtaatatttactgcacagttgaagtaacttaaaaagtaaaaagaggaatagaatcacaaataataagaaaagacaatttttggtcaccatgttttgttgtttttacctcttcaatggttttttggctctgtctcctcatctccatccgtattgccactacttcagttcaggccttcatcatttctcatttggattactgccacaacctcctaattgactttcttggctgagcattgcaattttctctctccccaatcttgtttgtattcccacttgttcttcacattgctatatcaaaacacatcacccctctgatttacgtattataggctgattttagtctttgggatgtagttcaagctccttggaattgtattcatagctccttaagattggaccctagaccacctcttcaatatcatcacacagctgcctcatcctccatgcacttgccattctctctctctcacctctgtgcctctgcatgctctatctctgctgtttggaaaggtctccaagtctcctttgcctaggtcagttcccctttcaggaagcttcattgattcatcttctccacagcctcttccttagtctggattaggcttcttgccatcgtgcccccattcctttcagtgtcttctctgtcatggcattaccatgggtgtcttgatggtctgtggaccggggtgatccctactggattgtgggttccttgagggcaaggaccaggtcttgcttgtatttgcttcctgcacatttggcatagtgtctggcacaggtgatgaagcctgtgctattagtgagtgaggtggtttactggatggtttcctcttcggtgattcctctctgtttaaccctcttactgatttgatttccaacttaagctgaagcctttctcagctatctttcttaagtattaaaagtggatttgatttgcttctaagaatcctccatccctagtttcagggtcacatcactgtccctttatgatcatctacaaggggtcacacttgacagttttacctaaataattacataaagggagaaaatattgaatcctttctgttttctatcttgtttctttaattaatctttttgttttgtgtgatctcttttgcttttcccaatttctcttctttttttcagatattttcttcattcccgtatccatctttggttggatcttttctgtttcctttctttcatgctgacactaaaagcaatctatcaccttttgttctttcctgtcagtcaatctctggtccgtgacagattaactttgacaagtttttgtgctgaatataaatggtttctctctgtgtttaaaagggaacacacagcacacaaacaagctggggaaaggactatttatcacataagtagttggaaaaattgggataaacatattgatctattgcaatcttttgtttgtgctaagaccaagtaagtaattattcagactacttactaacctcctcacaatttaagattgcttaactttcagtgtaaacaaattttattgtggtctaagacaatttccaaatgctagcgttcacttattgaaaaggggaaagtctgtggaataataatgttctgccatcctccttttaatgagaatggttatggtaacattttgaaataaatatgtcataacaactatatgacagtatgttgaaataggataaatgggattattatctgggtttacaattagcataaccaaactgtagaataataatgggacatacatggaggaaaatgttaccctggttaaagaagctgggcactaaaatctacacagctgggtcagaattctggttctataatttattaggcacttggccttatacaaaacctcaggttcctcatatgtcaattaggctaaggattaaaaggaacaatgtattatttagcatgaattcctggcatataaaatacccgatatatgtaagtatgaaattaaaataatgattgtcgttagcttatctctctcatcctcctgttcccttcattattgccatccaacttaaatgcctactttcaaaattctcactattcttactctttctaaaccagtaaccagcacatttaaactgtgttgtgaccaattagtgggttatgaagtcaatttactgatctttatttttaaatgtaatacaatagaaaatattagagtgaattgtatgtactagcaaaaagtatttttgtgaaactttttagttatacatatggtctgactgacattttaaacaggcttttctgcctgctatatggactgtgggctctaggtgggcacagctggaagaaggagcttttactatcatccaagtgagtgattgtgaggaagatgaccggcatagaagaaatagttgtgggtgaaaagtggccagattaaggatagagttcatggtagaggcaacaggttttgttaactactggatgtaaggtaaaaattttttgttgtaccaagcgactggaaaaatggatttgccattttctgagatgaggatgcccctaagtggggtaggtttgtggactagaacagagaaagataaattttgagtatattaaatttaagatgcctattattatggatgtgaagatgttaaatagacagttagatatacaagtctaaattcaaaggtgagctctgggctgaagatgcacatttgggagtcattaggatatatatactatttgaaatcatgtgtctggatgagatcatcaaggttgtgagtggaatttagagaagggatgttgtccaaggactgaaccctggggtactgtgacatctagaccatgagaaaataactacaagcaagtaaagagactgagacactgcagccaatgagagggagattaacacctaggagagtgtggtgtcctaaagccgagtgaaaaaaagtacaactggagtgagtggtcacctgtgtcaagggctgtcagtggatcacaaggtggagatgatgtatttagccactgatgcttattgatgatgcacacaagcaccattttggtagggtggaagcaaaagtgtgagatacatattttgtgtgtctcaggttttacaacatgtaattgttataatgcaatacattttttgttcttacctttttttttaacatcatgtttttaaaatgcattctaggtcatacgtctaggttgttgctttttacttgcgcattctactgtatttttaactccatttctctgatgatggagacctatgtagtttctaagtcactgccctagtgaactttcctgtccccttttagtcttgtgctagtatttctctggggtacatacctaggaatgtaactactaggtcttaggacatggacattcttcatttttatgaaatactgccagatttttttttttagtattagtagctgaacttgtttaccttctcttcaacagcatatggaagttcaatatcttcataacttttttttacacttggatctaacccctttttcttgatatttttgttattctaatgggaattctgtggcttctcaatgttttaatttgcatatctctcattactaatagtttaacaacattttcatattgatattggcaatttgggcttcttcttttatgcacttgcctactcatatcttctttgtccagtttcctgctatctccattgaaccagctttctcctttttagagtcttcattatccactaatgacatcttctttgttgtttttttgccagttcccatgacacaagctacctctctttatgattccagagtctgtgttacagttctcttcagttaccttaagccttcaaatcaatgacttaatatccagctaacactgtaatgttatatttccttaactttctcgacttcattggccaagtctctaaatgagccaacatcaggggcaacttttgcaacgttccatttttaatctttcaaaataagagtttctttttttacaacaaacattttgcagtaatgtctggaagcagcactcccactatttgactccctgctgagcttcccaacacatgcactaacattccttaatccccatttgacacccagttgcagacacaattctttccagaaagaatgtaaggaaccaagccaaatgttttcctctccaagaagccgcacatacctacactgaactcacatggcactaagtagatattgtcccacaggtcactctttgcttcggttcaactgtcctataaggttatcaattgttggagggtgggcatgttagcataaaccaatataacatgggtgtaaagaactcggatcttaggcctggtagtcttggttcaaattctgactctgccacttaacaacttagtttcgagatgttacctaacctctctgtgacttggtttattacatcattgttgtaaagaattaaatgagttactacatgtaaaacacttaaaagaatgtccagaagattgtaatcactccataaatgttacccattactctaaatgttgatatccactctatttccattccagtgacatgttgtacatattaatagtacatgtttttaaaatgatttgaatatgaaagcaatatattacagatagtaggtgaaatgataactagaagtaaaaacaggaacaggaagctaagaaagcttaagaaatataagattaaagtggtaatttaattttaaattattgatttgaaggcccaagaaaaaaagcacgaagacgtaattgcaaccatcttctattattcattttctattttagccttggcccataaaaatgagaacttcacagataataggagaaaacttttcacctatctcttcacctcctcagacccgccgttcaggaggaaggctctactgatgggtgagattgagaggattactaagtatgactgcttgagccctgtttttgctctttcttttcacccagccttcctgcaggcaaagcctcttctcttctcctccaacagtaagtgcacaggggcaggacttgaccctgtgtggggagatacccataccaggggaagtaggaaagcctatgtttgccccagatgcaaactaaattctctaatacaaatttactagcagtgaggctgatgttttgattcttttctgacttctgtgttttatcacttagtttaccccttgagaagtcccagtaaaagggaagatgcacagcaagataaagaaaggcgatagagagggaataaacatggagagacaaatagaaaggagctggatagtggtaaatgaaaggatggagacatcttcatttgtttcatacagtaggaacactcatagaattgcagtgctggtgactgatgaagaatagattcaacagcaggaggtactgagagagagatagctatgaaaagggaccacaagtcctaatttggctgggacagtccaggtgtatgtctacagtcttagcattttgttcagtttagtattttcctgaacaaaggtatcccagtttggataattaattatatagtcaccacaggtgtggtggaaagaacaaggctgttgttggtgcatgataatggagaaaaccatagatgagcagtttcatgaggaacgtgatttttaagtgatgggtaattatatgcctttagttttaaatgccatctgaaaattggatgtcataacccttctttgaggaaatgttgtcattaacacaaagatagtcaaagagactatttccatttatctagtgcagtggattttttttttttttttgacggagtcgctctctgtcgcccaggctggactgcagtggcactatctcggctcactgcaagccccacctcccaggttcacatcattttcctgcctcagcctcccaagtagctgggactacaggcacccgccaccatgcccggctaattttttgtatttttttttttttttttttttttagtagagacggggtttcaccatgttagccaggatggtctcgatctcctgacctcatgatccgcccaccttggcctcccaaagtgctgggattacaggcatgagccaccatgcccggccgttcagttgtttttaaagtgtgatccctttaaggggacccatattagtgccacctgggaacttgttagaaatgaggattctcaggacccatccaaacctactgaatcagaatctttgagattggggctcagccatctatgttttaataaactctccaggtgaatcagatgcacaggaatgtttaagagccagtggtttcatttatatataataattgtgaaggcagaaatatgatagtgctataatctgtcaatcaatcatttgttaagaatcgatacaaagccctgtgttgggtactttattctgtgaaagatacaagagaacaaaaagatagtaaaataagcattctctacccttgagaagattgcagttgggttggggaaattggacctacacccataagaagttgtctaataatagaaaatgataaataagtaggcaagctaaaatgtctattggagttcaggagagaattcccaatgggagagcacagacaggagatactttgtggaggacatagaactcagaaacgagaacaggtgggaaatagcaggaaccaggagagtctaactggggagataagatcaattttcagcaaacaatgagtagcaactgaagagaacagtgttaatgccaatagggctctgtattggtcttattgaaaaaaggatccaaggtgaaatgttttcaaaacttgagattagacaaaattaaacaagtttcttttactgcatatacttctcagagtctttaaaatgctaaagagcaatgtggtgctccaagaaggattgtggcatttaccagttgacttatggtccttggagcagcagatgccaaaatgggataagatccctgaaaacacctctgaagtggaaagctcctgaatcatctcagctctcatggggtttaccaatgcatccagcatgctggccacctcttgcttatcctgttcaacccaattatgtcattgatcaaatggatcaaaatgatgttctgtgggatgtccagacaacccagatctttttagactttattataagaaattataggagaaaagtctagccttgaggcacaactgtaaataaatagtattgttcatcctctgtgaatgacaactgtttgtgattttcttttctatttgtaatgaaaaacagcatatttaccaaaagaatgtcaacatatgacttttaaggaggtatctgtaatagtcaagctcatagaagcagagaatacagtaatggggcattgtcacttaatgaatataaatttcttgttagaataaatgagtaagttctagagatctgctgtaaaatatagtgcctatagttagcaatacagtattgtacacttcaaaattgttaagatggtagatctcatgttaagtgttcttaccacaataaaaacaaaaaataaaacaaagggatacaaggacacttggggaggtgttgcatatttctattaccttgattgtagtgatggtatcatggatgtttgcacatattcaaactcatcaaattgtacacattaaatacatgcagctctttgtatatcaattatacctcaataaagccatttaaaaatcagcaaagcctttctaatctgctttagcaatgccacatccagcatagcagctgagatgaggcatctggcggagtctatggtagtctatagtcattgtccaggttccatctggtttctgcaagagctagttcagagaatgaagtggagacatgatacagcatcgaccctgcctcctttaggaatttagtgatggcaatcaagtttaacagtctcccactcccaggataaaaaatatttttaatttactaaatttcggctagaggtgggggaaagtctcagtggttgctacttggtcttttccaagaccagagatctaatacagtggtgacttcagctgccaagtatgttagtaacaattgtacactcagggactgaaaaaatcaccattgggtaggtccatacacctagtgggcccaccttaaaatggacctgagatgagacttatttattacttggtcatcacaagcacctacttaaacagagaggctataataatgctttgggtttctgagtatcaacttcaattcagaccttatattcaattatccttgagatgtatgggcattccttgtccccagtgtaccattatatgaatatatggcagaaggaccagggaaacactaagtccttcctcccaggaacccagccaattcctcagtaagatgtttccagatctgaaaattggcttaagtctgtgaactgagcaaaggatagtgactttctattgaggtaattcccttcagccatccaatcctccattcttactttctgcatttgttactgtaatttcagcttcctggcttaagaggaaaagcactcttccatggcctctattattcggggccctattatcctcatggatattaacaagcccatctctgtgactcctctcctagaccaggtcagcagagcagagttaccattggacaatttttgtgatactagtgtccctctcactagtgtattcctgatagtggctggtgtgtccaccaggcttcccattgagtgcaattctctgaggggttgtctaactgcacataatatatccagcatagcatgcccactttgctcagctctttattcctttctctgtcatttgccaaggcaactcaagcaactcaagcacattcagcattggtcattgctttctctaggcttctaagagctaccctaaagtcaatatcccctgtcccccagtgttcttgctgggatagtaaattctgtggacccaagtcaatgaattcttacttattcagccttaaattattaccctctcaattaagttacctcaaaattcaattacccagaggtaattcccagggtcctgccagtataggctagctaattctttcagctttttagtatatcatctctttccttgcttatcagactcactgtattcctagcagagttatactgggatgtagcctattatctgtctgatgactgccagtagaggaggtatggggcagtccctgaagtgggtatgactgcattgttggtggggaggtctctgctgcaattttaagcataagagaagtgctaactctcaccgggtatggtggctcatgcctgtaaccccagcagtttgggaggccaaggaaggcaaatcacctgaggtcaggagtttgagaccatcctgaccaacatggagaaaccccatctctactaaaaatacaaaattagctgggcatggtggcacacgtctgtaatcccagctactcaggaggctgaggcaggagaatcgcttgaacctgggaggtgaagattcggcgagccaaaatctttaactgtttctagggaagagtgtactacatcagcaaactttgaggtttcagagggtctgcagagctcacgtcctcagaggcatccatccaaatgtctttatctatgtttcagggttccagattttcctggaactaaactaaaattttcctgggacttgaactaaacatagatttgccttggctgagcattaaaacatttctggagctctgcaactctaacagttaagtcttcagcctgctgctcatctgtttgtgccgttcactgcaggaggtactagtctcttggcaagctaccagtaaagctcccttgctctcatcttttagtcttaaactgcttgtcatggttttcagtttctcattatccttctgcagggcatcaatccaacttagcaataaccagacaatgccttattctctagagattgttcccatgatctctatcaaatgcctttgtgctcacaccaggcgtattcccccatacatttttcctagatcaccattaatagtctttagtcattgggtcactgcctccttccaggaactctgcattggccatatatcatgcaggagcatgcatatattctttgtcttcttggcagtaagtgagccagcatccaaactctatttttccatctgtgttcttgtattacttctgggaccccctgtgatagttcagctgctctaagaagtacatgccaagatgggattaagtatgcaaaataattttttggtgggggggatggtgaaagcatatgaaggataaggggaagggagcataaggtggagagagacttcaggccacaatgcaaatctgaaatctgtaaaagagagggaaagaggagaactgggtagaaaaagaatcaaattgctacgcagttcaaataaagttttggtcaggttcatttggaaccatgagtcaaaattgtccattagaagcatcctgtgtcttgtattagttcttttgctctgctcatttcttggctgttagaaactcatagggaaacatgagattccccatgtctcagggcagacatggtggtggttctgtgttcccaccagagatctgagtggtgcatttcatggctgcgaaaggtcttgcattttcaaacttctttgatcatggactttacctgtaaaacatctttaagggatgttcagtgaaatatactttttaaaactctgggctttatatttgtgttaaaatttgagttgctgatataaattaacttaggagtgcacatgatacctcttttaatgtctgtggttttcactgcttttctttggtcaagagaatgctctgtatttttaccgtattttaaaacaaaggtctatataatagattactatttaccagaaaatgttcaaggattctgtttcagtcagctcaggctgctataacaacatgataaatttggtgggttaaacaacaggtattttattgctcacaatggagtctgagaagtccaggattaaagtgcctgccaatttggtgtctgctgaggaccctcttctgggattgcagagggccatcttgctatatcctcacatagcagagacagagatcatctctctcatatctcttttagggacactaattccattcagaagagttccacatttatgacctaattacttaccaaaggccacacctccaaattccatcacattggggattatggctttagcataagaattttggagagacgcaaacattcagtccatatcaattgttctatatgttaacttgtaacagtacatttgagacaggcactcttattatcaccactttacaagtgaagaggctaaggcttcaagaagttacatgacttgcctaaaaatcacatagctagtaagtgattgtgccacttgtaagttgtgcaacttgtaagttgaacccacaatgtctggctccagagtcagtgctctcaaccgctgtgcaatgctgccatgtgggcattcctgtgttgtctatggctctgcagaagagttttggaagctaatgctgaacatgacttagcaggttattgttaatgaaggaccctgagtggctggtgcaacgtaacttggatgactcagataagtgggactctgatagccagagagtgcatcccccaatgaacacatgtagaaatatgcactccataaatatatattatttccaccatggataaatacatatataaacctgtatgcacatgcttcatacacatcaatatatcatgtagctatcccatgccttataatatgttcattttaagtatacacagtcagaacatttttagtattcccataaatgtattagtaactggttagtatgggatctgtcgggtttgaagccatacagacttttactctaattagcagtgggatcttcagcaggtatttttacatctttgagcttcagttgtctcatcaataaaagcagctatcatcatacctatctcacagggttgctctgaagatcacatgagagaagagaagtaaaactgcctaacacagctccagtactcaggagagcagtgaacattgtgttaacttgaattaaatatcatttacaattcttaacacgatggaggtttctaatgattattaataaaatgaacgtggattatgttaacctgagctggtttcaaaatatgtaccctgcagtttaagtccagccttctcgtttttctctaggctaaaatcttcaggggtcctgaattatcttcttagcactctcactggtcagctgtgtgattctagacaagcaactttccactattgtttctgagttgagattctcggattcagtaccatggagaagtgctgggttggctgcaagaacttcagcagaaaactttttaaaaattagtcgaaggctctacctcagtgattctgtctgatagcattttattccttaggataatgctagctactgtaagaaataaatccctgaattggccgggcgcggtggctcacgtttgtaatcccagcactttgggaggccaaggcgggcggatcacgaggtcaggagagagagacaatcctggctaacacggtgaaaccccgtctcactaaaaatacaaaaaattagccgggcgtggtgccgggcgcctgtagtcccagctactggggaggctgaggcaggagaatggcgtgaacccgggaggcggagcttgcagtgagccaagatagcgccacatcactccagcctgggggacagagagactccgtctcaaaataaataaataaataaataaataaataaataaataaataaataaataaatccctgaatgttagtggtttaatgcagaggagtttatttcctggtcatgtaacagtctgatgaaggggttactgccatttgtgccgctattccctctgtcgggggttcatcttctttcatgttgttgctctgtcctccaccagggcattagagtcctctgtttccagctagcagacatagaaaagtgaatgtaggagtgcatgcaaagtgaggcacatctctttctcttagattcatcaactagaacttagcctaattgtgcacctaggctcaaggggctgtgggagatgtagactctgactagatagtcctatttcagggacagttttatgctcaaaggaggagaactcatttcttttgtgaacctccagctttctctaccatggccagacttgtgactcagtgaacttgatggcacccaagataatcagactatatgcctaaagcacagtatgtatagaggaatcttacttaaccattgtttaacaagggttgtaaaacttttggaaactctgaaacttgaactcgtatcctacatttgaattccacggcaaagagaaaaccagaaaatattatgaaaaactttatctctcatgtaaattcccacaatgttggatgttggagcattaattgctgtcaccctttgctaattcccttatcctttgggtatgtggatagcaaaaatcttttcaaataaaaagaagtattttatttcaatcactataccaacgttttataagaataaattcacttgttcttcagcacatgtagattgtgttatttttgaatataatgttcttattgagtgttaattatatgcacctacactttcaaagaagtgataactagatactgtcaaactgataacagccagtcttctctctagctttatgcatgtgttaatttataaggtggattagcaggaacttcacaagccctttatttttggtctgcttggagatgagagcgatgaaagaaaaaaatgcagatatattgcttctgtttaaaaattcgtaataagacaatgggcagaagtgctctagcacagaagtttctattgatgaaagcatttgccaatttaccctaatttcctgaacgtttacggttagcaaagaaagtacacataagcacagaaaaatctatttttatttttctatgattttcttaatttacaccctttaatttggaaaagacccatttaactgtgcttaaaattatttgcagggcacggtctattgttaacattttcatgtaacttcatagggtccaatgaaatgggtgcagaaggtgtagcccaggtatcacatttatagatgggcctggtattagaatatgccatgtccatgttcagaacttcatttttaaataaatttcttgaaatttatgatgattcagaagtaattcagatttaatttaaatgtttcttataaggtttgctaaataaaatactgccaaaaaggttggaagagtatattgaactttaaagcaatttagaagccttagttgtgtgcttttgggatgctcaggttcatgggcaaacacagcaggggcacttttgtgcacgcagagttctgaaacagcgctaagggaacagacccaatgtgtaaggcaggggccttattttcagccactctatggctgcccttgaaattcatgtaatgctttaagatatatcctcacattctatgaggacatgggctttgtttcatagggtccttgaatttcagtagagttggcccctttacagtgttatgtaatattttgttattgaatgaatatatgaaaatgcatgcatcaaaaatgtccaatgacttcatttatattctgcatttaatctatttctaattagtgaacttttaagtaatgtgaaaagtggcttcaggatagtttggggttcaattgaggacatgttttagagtaaaaaatatctataatactcaaagattttgttagaaaatgacaaaggaggtcattgagttatggtccctttttccacaaagctaatttctttctttattgtgaactactgtttaatattctttcatagcatacaaaatttattttaaaagataatgttcattttatggaaaactttatggtgttctggctttttctatttattttcctcattcctttttgaggactgatttaactcagcatgtatgtttcagatgagtgaatatttaggaagcaaattcttaatagctagatgatctgacagtggatattcgaaagggtaaagcaacggaaataacatggtgaacatttcaggatcctggtgaattattatgcggaaagtttttgaaaatttatttttcgttaagttagtctgaacctgaattgttatcataacaatgcagcatattcttctgtctaaggaggtaagtgaaatcagatttaaaaactcaataactatacttagaaatggcacattaaaacttaattttattttctcccttttaagcaagactcagccctttgtctactttcaatcctgttctggggcacacactttttctgaaggcaagctgagagcactttgcattgtaagcaaactgaggttcagccttaccctgcccctgtcctgattaatatttggacatttacctggttctccttttcccacatgctccaagcaaaaacttgcaggcatgtgcagagtcacaggcaggctctcccagggaggcgggagcagaggtccactagcaggcagcatcatcatgttctcttgatctctataggttctgggacctttaaacctaggtggaaggtgattaaagaaaggaagagattgatgtatgtcgtagcagagaaagagaagtggggacatctgccaagcatggtcagcatggtttcctatatcctaggaaagctaatcaggaccgtttctgtaggacctgtatcatttgaaatcttttctgcttttgagtttaaggcagaaagatgtagtcaggagaaacagatagagaagcaggaggtaagcccaatggcttgtgggggaagagaatgtttacagtgtacacttgatagggaaggcaattttattcctgtcttcccagatcatccccacttctagttccttactttgttgctagatgctcccatgagaggaagaaggagttgctatcccaggcctgggatcttgatactgtcagttgccagggttatcattccttaatattacaaagttatgcctatttattattatcttcctggttttatgcagcagagtgggcaagtggtcttagggtctcagggagcttgattaagaggcagcctcattcttgtattctctgtctctctgtctctttctccccctaaaatctacttgatcttagatacagacttggatgtttgttagtttcttcaaatagtgtttttttttttctttttaagttttattttaggtttgatggtacatatgaaggtttgttacataaacacatgtcatgggggtttgttgtacagattatctcatcacccaggtattaaccccagtacccaatcttttgggtacttttgggtacccagttatcttttctgctcctctctcttctctcaccctctccactagagtagaccccagagtctgttgtttctttctttgtgttcattagttcttatcatttagctcccacttataaataagaacatgtggtatttggttttctgttcctgcattaatttgctaaggaaaatagcctccagccccatccatgttcccacaaaagacatgatctcattctttctaatgactgcatagtattccatggagtataggtaccacattttctttatctaatctgtcattgatgggcatttaggttgattccatgtctttgctattgtgaatagtgctgcaataaacattcatgtgcatgtgtctttatggcagaatgatttactatttatattcctgtgggtatatacccagtaatggggttgctgggtcaaatggtagtatactttaagctctttgaggaattcaccatactgctttctacaatggttgaattaatttacactcccaccaacagtgtataagtgtttgtaataacaactcattgtggttttgatttgcacttctttaatggtcagtaatatagagcttttattttcttgcttgttggccacatgtatgtcttcttttgagaagtgtctgttcatgtcctttgcccattttttaacggggttgtttgttttttctcttgtaaatttgtttaagtttcttatagatgctggatattggaccattgtcagatgaatagtttggaaatattttctccatcagagctctgtattagctacttgcatagttactagttaagtagtacttcaattcctatttttctgcagagaggagtaatgggcaggaaaagctagagacacccccagatatttggccataatactatcacacaccacccaaaccccatcttttaaaataggcaactaaaagtatagaaagacaatttgttttgatgagagggggaagaagatatttggggtcaaacagacatgtgtttgaatccttgcctaaacttagtgactagttatttattacattttaagttgttggtctgagcctattttattatccctaaaatggggtttgtaatattttccctgaagagttgttgtaaaagtcgcacctagtacattccattctttgatatataatagacatgaatttataggcatttttatctaatcagcttctgagatttttccctcctttcccctcttgcaaaagacctctttctctctttcatacacaacaaccctcaggctgcctgtcatctttctctgacttctctttttttcttaaaggttgccctgattcactgtcatcagacttcatttgtatatacctacaggcagttgagggctgagtaaaatagaaggacataagtcttgtgggcttacagcgacttagataatacaggcatatgacataggtcacctctctgtcaggcgacttcatgatccttgttggtaacccaagaaggctaatggcataacatgctttcaaactgataattcttacatatcttttcaacttttatttagagtgaacaggtgatgtttctattgaaaaaaatgtatatttttttctgtgtataatgtagtttgttgtatgtaatgaagcagtaaaaattgttttagaattatctttcatttcacaattttaagtcattcttaaacaagtaacattggttattcatacagacaaagtgttaaatatgttcccctttccacctctttatctggctattaaaaatatcatctaaatagatacttaaccttatttctggactctgccaatctttcttcattctactcatgtcggggtcttgatcatttattgtcattatgcattttgaagttgttaggaattttacctttgaatttcacatatatacgtatttatacatatatgtatgaaatgcacacacacataaacagacacacacaaatagttctccctagaagaaagataaattactggcagtattttgtcaataataataattcattttgtgttgcaattttgaataatctccagctctcagtttaatttttcctcttaaatttttataaatgccagtgattataaacagcatagtttatttctttaaaaacccaagatgacctgactaaataaatgaaattttgaaaatctgtaaaaatgatataaaaatgtcatctatgagtaaaaatattaatgatacatactaaccttaacatattactttataatttctttatagttacaaaacgatatcatatttattactctattcctgacagcaaacctataaattagttattattaatattttagacaagaaatagagacctaagtcatttcatttatctaagagtatgaagctaaaggttggcatgaccaggactgaaatctaaatcctttagatccaaatcctatgctctttcctgtgaccatgttgcaggtaacagatatttttatttttagaaaattgagcaaatgctccaaatcttaggttaagagtcagagaggcaagaatagaaaatcatccacctgggatgatttgtcctagagagtgcaattaactcgctcccaaagtgttttaaagatctgggacatttttgattaagtaggtgaaggttggtaaaatttgccaactttttccattctgacttcattcactttttgtactttaaatgtgatttcatagaaccaagaagtaatgaaccatcacataaaaggctgacagtccatggtggcttcaggcacatgagataccttttattctactatatagggtttcagaaaaaaaaattatgtatagatttgaaagattcatggaaaatggtttggaggcaagttacacaaaacagaatgatggttagggatggaagggtatatttcattcatggaagggagatgtttgagacgttatcattgagatgtgatatcaattaattaggattttgtacatttacattacaaatcaaattggtatcattattttggattcagtgattcaatgaaccttagtgttactgatgagtagtagatactttactttcaaaacactttcagattgttaggcagcagtggggaagattgcaaggaaagcagaggttgaaataagccttccaggtttaagggtcttggtgctcttaaaaaatgtagtggtactacaataaaatattttaacagaaaggaatctcaaagagtaaggcatttctactttgcacatgggattttatacaaagaacaaccatgctatatttcctgaaggtaatgttatttttgaatgcaggatggggtcgaattattagcaattacattttcacatgcaatatcataggagtctcttggcttttatactcttagaatttttcagtgactcagcagattgagttgcaatgtcaaaaggaaggagttgagaagcatggccttgagggacaaaagaaagaaaaccaagtcacggaagctttgcaatttgtccaaaattttcagctcctaaatctatgttcttgaactgtatatcctcagagttctgtgaaatcgggataataataacccaaatccacaatgttactgtagtattaaactagaaaataagtgataagtgcttaacacagtatgaagcagacacactgcaagatgccgtaaggttacaatgaaactaattatgcttattaaacattctatgccttctttaccataccacacagtagtaacacagacaatttagtacggggaacagagttggtagaaaagctgctgcttctttgttcttgcaatgtcagggagtgctggattttgggtaggtgttgcaggaacagggataggagtttgaggtaggtggaagagggaggaaatagaacaagacccaggagcctgcccatgacactgttgtgaaagttaacatccttttaccaaacaccctgagtccgcctactaccccaatgttagcaaaagtatttgaaaaagggctcattcatttacaaattctttattctgaattgatagttctccaaaataagggagactaatttcacggcagtcccccaaatgcaggggttgcttgcatggcattgagaaccatgcttcttgctccagtggcacatgggcaggcttgtgtatgctaaagaatggagattcacagcaggaatggggagagacctttaaagctcacagtaagttaagcatatgggtaaaatagactgcctgttatgcacaccaccctcttatgtgaccctttcggaaaaaaacttctcaatataaggaaattatgacctactcaaaggaattatctccctgctttcagctccactgagttattcaacttctgtcagtgtaactttctatttgagttatatagggaagaaaaaaaaaaaaacatttggcttaacttggtatagtatttttcaaaattcaagcatccctagagttcttagaaagtaatgagcattgagtttgtctttggcccagagagtttttatccactgtcttggaagaagttgacagttctgacacttgatcattcatacctggtgacttgtgtgtctccagtgaaactcgaagacagaacccagtctctaatgatagaaaaaaaaaaaaaggaaagcaaagaaaatgtgttttcttaaccaccattataggagatggacagttcatattttaaggtaaaaaatgaaatttttcttgggtctcttaaatgggggaagtttgatatttaatcaggttaaaactattatcaaataagatcattttgattatccggtgactttttgttatatgacatccattaggggttcagtttaattgctaagtaatgtgttggtggctagaacatattttattgagatcttatttgaaaaagcatctgtaaattttcatcaaacatctcaaattacatctttcaaaaatccatgactatacttaaatttctatgagctaattgctcagacaataaacaacaataagtaatgaacaatggtatttgttcctaatcttttttctaaatgttaattatacagttctttttttgttttcagtttcatttttagattccactgactggcttgtgtttcaggaactgggctaacccagagaacaacacatgtatcagtcagggctcaaccagagaaagagaatcattaggagaggtacatattaagagatttattgcagtgaattgattgacacagttgtcagggctggctaggcaaatccgaaatcgacaggacagggcatcaggaagggcaggctggaactcttgggaactagcagaagttgctgtccacaggtgaaatttattcttcatcagggaagcctcaactctactttaacatgtattaactgagggaatcaggtccactcaattgtctaggagaattcccttactagaagtcaattgattatggattttgaaaatatcaacaaaatgccttcacagcaacatgtggactggtgtttgattaaataactggggactgtagcctagctaagttgacacatctgaagaccatcacaacatgtcagcatataactgatccatgtgaatagcaaataattaatactaattgactattttattcaaacagggcttatctttgcattcccaaaaagatttcattttgaagatgcttcagcattgccttctaattctcagtataacctcaaataaataagtcagtaggtgacgcgggttgggttttcatctggagaaaatctctgagttatctaaaccagatattaatgctccaggcctataaatatcagcacatagctgctatttggaggacatgggattatcttcttttctttctccaacttctttttagtcttaataggggaaaccattctttcatggaattgattatttgctgctatggtaaagaagtaataggatttttaaaaatgtataaaataatgttgaatacatgatggctaagttcccaggcttgcccctacaaactcagttcaaagatcaaaaactggaccctttagctgtatacccccatttggagagttcttccttaaggcaactataccacaaacttacagctagtttatgaagtatatatacacccaactgatatcacttccctgtgtactcatttgttaaattgttctatttttagtataataattatttctaattgtttctcataaggtaacgtttatcgagtttctactacatgctagacttgatgccagaagctgtggtataaaaccacaaaggcaaaggaaacagccttacagagcttaattgtgcattcaatttggggtaattggtataataagggaagtagaaaattctgtaagagaatatatgggggcaccagcgaatttctaatgattttttttctagaggaattaatagctaaactgagattcacttggtttagggcaggagggaatggaaagggcaggaggagaggaagcacatgcatgaaagataagaagtgagatagcatgatggattatgagagaggttgtatcaggttgaagcatagaattcaaaatgagagggttggagtgtccagagatgagattgggtggggggcggtaagtaaaggccagatattagaagaaattaattttaatcttcacctgcagaaaatcaaaaggcatcagagagctggaagtgaaaaagcaagaagggggcagatttgcattttagaaaaatctctctgcttgtagtatagatgacagattgaagaaagggatcctgtaaatcagaaggtaatggatgtttcaattttacacattattgtacatatattcccactgactagttcagtgcttgaaatacagtaggcattgatttattaatgtattctttcatttcattccatatgcattagtcacttaactgctgtgttagtcagtttctccaaagaaagaaccaataggagatagatagatagatggaaagattagatagatagatagatagatagatagatagatagatagatagatagatagatggatgaaaggagatttattgggggaattgggtcacatgaccagggaggctgcaaagtctcatgagaagctgtctgcaagctagagaccctgggatgctggtagcatgtctcagtacaagtatgcaggcctcagaaccagggaagctgatggtgtaactcttagtgtgaggcagaaagcctaagaacctagggggccattggtgtaagtcctggagtccaaaagctggagggcctggagtcccaatgtctgaggcggtaaaagaagaatgtctcctagctcccagagaaaaagagagagtccaattcacccttttttctaatttttttgctctatcctgggtctcagctaattgaatggtgcctggccactttgagggtggatcttcccccaggcagtcctctcagactcataagctgagctcttctggaaatactctcattctagatattccttaatccagtcaaattgacacctaagattaaccatcacaactgctctctataatactccatgctatatgcaaagaagatagtaagtactaaattagactggcatggtctaagccataatgggtctcatgggagagggagataaacaataaattaatgaataagataattatatattgtgctaaactccatgaaagaaaacaaagattgctccgatagagaacagcatgtgctacttcaggtaaggttgtcagagaaaacctgcttaaggaggtggtagccttaagatagaaattggaaaatgagtattttagaataaaccgcaaaaagtaaaatcaggtgggagctattacaaagacccaaaaaggatatgataagtatcaatacaataggtcataattgtattgtaggtcagagaactcataattaagtagggggtggaggcagactaggggaatatatttgtagtacaatgtgaagaataatagagttatgtccaaaatgctacaagagaatataggaataaatacttcttttggatatatatagaggaagtcttcacagagagggtagaattagatctgcttttgaaaaataggtaggacttcaccagagagggaaatgcatgaagttcagtgaggaatggccagtctgagggctgagcttgagtaaaggcatgagagatgcaacaaaaaagcatggtattcctgggaacagtgacaggactagatgggctttaacgtagagtctgtagcagacagagggcttgtgatctaccttgctctgaaaggatattcttactctgctaacccagaaatacaccttataatggagctggactaaaatagacccgttttatgatggtgcctcatttgacttttccatggtctgactgcaatgctcaaagtttgtcactccatatttgttattgttttgtataaagtccactcaaaccaccatttttgcctttaaatagttgtctggctttccagagtaaccaacataatacattactaaacatgtccattaataatttcaatttagttttaagagtgtaaagggatctcaaagtcttctaatttggtctcttccttaatgatagttagtcttaggataatcaagcatgtatttatttttccatctatgtcagtatttctctttttttgtcttttctctctggcctttgtctcttttttctcaaccactctctgttttctttctgaattgcttttctccatcatacttcctaatattacaaatctatagctgcctccccaaaaaacttgcccttgcaagaagcaacaaatagatgtgaataacgttctagagacatcctgatttttgtgcccttactcttaggtcttattagaatagtgttcctataagcagtggccttttaaacatattttaataatatttctgatattttaaaaatgtgttttatcattaaaaaaattaacatcaccaccaaaaatcttctcctttatgatgtgcttatttcacagcacatgcctgtatcaaaacatctcatatagcccataaatatatatacctattgtgtatccacaaacttttttttttttttttgagacagagtctcgctctgttgcccaggctggagtgcagtggctcgatctcagctcactgtaagctccgcctcctgggttcacgccatcctcctgcctcagcctcctgagtagctgggactacaggtgcctgccaccatgcccggctaatttttttgtatttttagtagggacggggtttcaccgtgttagccaggatggtctcgatcacctgaacttatggtctgcccgcctcaacctcccaaagtgctgggattacaggcgtgagccacagcacctgaccaaacattttaagaaaatactgtatattctagaaaacttgttctaaaattgttctgtaaatctgactctatgtatgtattagattatatatatgtatgtatatgtatgtatcagactctagtatgtattagatttgtccagttgaaaaatgtgctaataccattgtgccttaattttgttttctttttaggtaaatgttatcaactgtagagactgaaaattaggaatataccaaacatcattaagaattttaatgcttttttctttcatttaaacaatatagtttaaataagcttatatccagtttataaatctgaaatagataattagtggtaaaaaaaacatagtagacttctgctttgagaacagcatcaaacattgctgtttcaaaatgccacttaaaatcatctgacctacattgtcatcttcttttgaatggtttttattgccatgttaacagcttgacctgaagtttgtcttctttggcctccagtggaaaaatatcattcggttgactggttcttagaaaagtttattaaagttggctacacaatttaacagtgtaacagaaactggggctaatgcaaactgtggctcgaaggggcagcatttagcatggaagagtcctgttcctctaaactgtaaaacattcacagcagagtcaccgtgtactttcaggagccacctcacacgctgaagtcaagttatcactcaataaattgttgagaacatttcattggcagtgaaatcttttaagaaagcttttccagctaagcaccacctgctggaggccacctgttttctgagcaacaaggtacccaatcaaggagcccaacttggtttgggtttctaaggcatctttccagattctatagcattgaaaagctagagacaatttggtgcaggtgaagtctaaatattatgaacaaagattatttattgagactccattagtaactccattaatagacatatatgtctatcactatgttataaaaaagtggataagactggaggagccttgtgggatctatacttaatttgagaagacaagcatatataattacctagttatattgattcttatatttaaagagtgcaaatgagccataggtcagtgaggtaggagaggagaaagcaaagtaatgaaaatttctcatccattatgacacacagaatacctactagaataagttaacctttgtgtatgttcttgttggaaatctctgtagtgttgctgctaaatggtagtgtgttcattgtcaaatttgttgcccagagagcaataccttgagttggtgcattgacttcacttgcgttcttctcgactgataacattgttttatttaccgataaaaatcatgattcataaacatagcacaggttcaacagagggctgaattaatattttaaggcatttgtctgagcaactaataacaacacagcctgtcttgaaaggtctctaatattattatgctctcataatatttagaataagaggaagattatgccaacaatagagtcattcatttattcaaatcaagagaggaatgtaggtgcctactgtgtgccaggcactggggtaggagctgaaaggcaacatttactaagacatggcctttcttttgtgtgttttcagcaagaatatgcatgcagagcccatagtctatatgaagtgatagataacattcttaattacaatataaaatgaaagcattaataggtacaagtaaaacatgtctggggagcatcaagaatagaggaatatttgcaaggtgaaggcttcccagagaggtgactttagaggcttatcttgaaggaagaatagatgttgtaaggcagataggctgtattacagtagtagcaaaatcattttatcatgtatattttgccgactattttgttacacatatcttttttctttgcaatacattttattaattatcctaataactctgtgattcaggtaccattgtcatctccattttagagaatgaaaaaagtaccaagtatagagaggttagtaatttgtcaaggtctcccagcctgtgtgtggagagcgatcactgctgagcctgatctcttatccacctaaatgaaaccatgtgtcactgtgctggtgagaggaatagacacaagggttgtgaaaaacttagcatgattttctggccctggttattagaattcagttttggtgagactgtgagatcgagaataaggtccagatcgtatgattcttttacatccctttcaatgccctatataaatttcctagataattacagacatgaactctttttatgtgtatgtgtgaaaatatttttgaagcagaaagtcatttacagatacaaagtacaacttttaaaatatttgggataaagatgttctctgaagcaagttccttgccattgattcatgagtattgagtctttactaaggaaactttgcaaaatcataaatgatacataaataagtgatgtgcttgcaagattctgacaaagtcagttagtatcaaaaaagagacataaataaattagttccttgttgaataaaatgtatgaaaaaaatcagaagaatgaaccttaaaggattcagatcctcacttaattatatgggtagtgaaatctaactgccataaaacgtcagcttctgtgaatacatccacaattccagatataacagcctgccttttgctgtgacattgtttatcaatttctggaggctcactaggtgcatttaatatttaaatacaagggaaaccgagaagagaagacattcttcctgccacacgtatagattataacacatcgttgtggaaataatatgataaagacaacatcatggctgcaccaccattaaatctgttctcttagttctttagtggaaagatgtggagtcacctacccacggtttgcttgatttcttcatctttgaagagctaaattatgttatgttttagaaatgattttttgatttctcttttctccaaatcccttgattgctcaagcctgggttatttttaaaagctttagattttctttgcactcatttctcatttagagtttgaaatgatatgatcaagtacatctgccttaagaaatagcatttaaatcaagatctggatgaatttgaagtagttttttaaaagtagagagcattttattaactaagtttctgcccatgggaatattttaaatgtgtgaggataaagagaatatgttatcttcccagcagctggtgtgagaaagcttgttgagaagaggctttgataaagccaccagggggtgagaacaatactttggagtcttgggtagaacttatgcctaggtttcatgtaaggaagagagtagcgctgaaaaatgaagaatgaatgaaataagagttagaatggtcagtgtgtgggacagcccagaacggcggttttgaaagtgtaggacatatcccattagtaagtcatggaatcagttaatggatgtcaaccagccacttaaaaaaaaagggggaggaagagaataggaaatattggtatgtaagacatagtgaagattaataatttttaaggaaatatttgcatgtcacatatagtgaagattaagtattgttttgtaaaatgtttcaattttatgtgtgtgcatatgtattgggtaaatatatttcttatagaatcttggtaaaaataaattacaaaaaatgatctacagagaaagggaatgtgaattaatggtaggacaggggctttctttggggaagaataaagctaagagtttataaaccctttccatctctctggcaaaaacttcagtgaattctaccttgttacaaatacctccaataaaatgaatcttgttgttttgtgtgtgtgtgtgtgtgtgtgtgtatgcacttgtgcacacatatgggagtgtataagcttagtattaggaacagggaaggtatcaaggaggtagaaaagaacagatgaccgtgagtacgtagaattacatatctgtgtatatggatatgtagaattacatgtgtgcgtgtgtccatatttgagtgtctttaatgtatccacatatcatggatactgcatttaaatttttggatacatttaaataatatcatctgtaggtgagaaactaataaatttcaaatagctttattgaaaatggaaagcagtgtaaatataggtagttacttaattattcaatttaattttgaattctgtcacttgaaatgagatgtacgattaactaaatgtgtattatcaggtccaatgccaaaagtcactttatttttaagaaatttttttcacattgctgattttcaaggtactatcagaaagattgtcagagtatgctattttaatattttttcacaaaaacattagtctgaaaagtccacctatgtgcaagagtgtgagttcctctgcatatatatcccaatattttgtgttagaatttaatgtcatgttttactctgttttctacaattcattatcttcatctgtagattaaataattttaggagtatttcagaaactgctgaatattttttagcatcttcattaagacaaatatttttcctttttccttcctcttacccattcttcctttatattctttccttcttttcatatataaactgagtttctcccatgtgccataagctgggaagacagacactgtccctgtcctcatagagttacagtaaaggggaaggacaaggagtgagagcgcacatcgttgggcatctagcatagaagtaggggtttggaggaagtccctgggtcaaatgacatctcagatgctacctcaagtatcagaaatgcatgaccaggcaagtcagagctgggatgaggtgaaagtgttataggaagaagaaatagcatgtgcatagggtgggtgacaagatgaacatgggagagagaggtgagagacgaccacagagaggtgagaaggggctacatctcgctatgaaatctactgaaaccaggtaagagtctggttgtgtcgtaaaagcaatggggacttgctgatggcatttacgccagctccacttgagtaggaatatatttctgaaaacaacccaaagccactcaacatccagtgtagacttagaccagaggtcaagaaattttttttgtaaagaatcagagatttttttaaaaattatactttaagttctgggatacatgtgcagaacgtgcaggtttgtaacataggtatgcacgttccatggtggtttgctgcactcaccaaccaatccgtcacctacattagatatttctcctaatgctctccctcccttagcctcccacccgctgacaggccccagtgtgtgatgttcccctccctgtgtccatgtgttctcattgttcaaatcccacttatgagtgagaacatgcagtctttggttttctgttcctgtgttagtttgctgagaatgatggtttccagcttcatctgtgtccctgcaaagggcatgaattcatccttttttatggctgcatagtattctatggtgtatatgtaccacattttctttattcagtctatcattgatgggcatttgggttggttctaagtctttgttagtgtgagtagcgctgcaataaacatatgtgtgcatgtgcttttatggtagaatgatttataatcctttgggtatatacccagtaatgggattggtgggtcaaatggtattaaataatttaggctttgtgggccatgtagtctctgtcacaactactaaactcttgttgtgctatgtacacagccataaaccatttgtatacaaatgagtgagatgatgttctaataagatattacttacagacattgaaatttgtatttcatataatttttatgttccacaaaatactcatctttttattttttctcaaccatttaagaatggttcttaggtcacagaccacacaaaagtaggctctgagtcagatttggcccacagactctagtgtgctgaaccctactctatagagaaactcaggtgtgtaacctaggtagcaacatttgggtggtgcctgaggacacctacagagtaaagcacctggttaatccttgcttctaactctaattctaatggctgaatgcaaaggtactttaagtattatgtacaattgtaaagactcttaagatgatgccttggagggacaatacatattttttatctgttctgatatgtttaaggagaattaatgttttctaaaacaaatcaagtcttcaagtgttttcacatgctaatgatggaaacaggcattataagaaagacatacatggtaaatgtattagtttgggttctctagagaaagtgaaccaatagaacatgtatatttctgtgtgtttgtgtgtctgtgtgtgtatgtgtgcatgtgtgcaaaatcccaagatctgctgctggagacccaggagagccagtgttataaattccagtctgagtctgagtctcaaggcagaagactgatgtcccaactaaagacaggcagaaagagagaggaaaggagagacagagagagagagaattttttcctacttaccttttttaatccattcaagctgctgatggattggttgaggcccactcacgttggaaagagcaatctgtttttctcagtatactgattcaaatgttagtttaattgagaaacgcccccatagatgcaccctaaaataatgtttaaccaaatatccgggtaccctgtggcccagtgaagttgacacataaaattaatcatcacaaaaacaaatgagtttctaagtcagaatgagataattggaaggtctggttactctgaagagtaacattaaattgggaccttcagatgagtgagttaggtagcggagtcattgggggtgttgaaggcaggtaagagaagtttagatgggggagttatatatctttgaatctagtacaatattagagcgtaggaaagatcagaagaagtaccttatttctatctagtaatgtagaaagcccaggaactcttggtgtctctctattatctggccagagtaaagccagctgtaagcaacatatagctgtaagcaacttacagctggctctactatggccaaacagtagagagatgccaatactcaggtattgtaaagagtagatcaccggcgctattcagtttttcaaaaacaagaactctttttaagtaatgagcttcctgcacctttgtacacacttatgccccagtcttatctaaataacatctaagagaaaagaataatccacaagaaaaactttccatctaagccatatttatgtcctgattttatccttcagagcccttgcttcttgaaaaacactccaggaagaagtcatgatgtttttttcacatcattctttccattagattgaggtagggtagacctgtgaccgaccacaggcaagtagtttaaagacttttcatctgcaagctctaacttggtttcactgacctcaagacatgtgtttgagagaccatgaacaaaggatttcatgccaaaaggaggaaacaataaaaagttatctctataacagccttgaaaaatgccaattttttttcaggaatatcactaaaatatacttgcataagaacagttattattgtggaaaaagcaaagcaatttcattgccttggcaccacctctttagcatcaacggaataccctttctccgccacatatttcatgtgctatagtaaaagaaatctactgagattctgggtttacatttgcagtcttcatacaccacatgcacattctgatattctttcatagatgttgtacccattataactcgtgtcccatcacaagaaagtgagttttaattttaaatattttaaatatgaatatcataatttactgttttcatgtagtattaacattgttccttagagcccaggcatataatgtagtttcctgacattatagcagatccatttttaagggtggaaaaaaacccagtatcttcattacttatgaataatttgggccctccagaaatccagctgtgttcccatagaaacctcattggcctagatgtggtgtcatcggccaagaaaagctaaaattcaaccactgtattacaaattgttaattcaagtaaatattgaatcatctaattactgattacagataaaactttccccaattctttaagaagttcagaaaatatccattaaatatgattggtcaataatgaaataccagagtgaggtgggaagtgttggctgaaatggtgaaatttactatttttttaaatgcagcaaacaatttctgaaaatatatcttagtgacaaaactattttaatgatggttataaaagctaagtacaacttgctaaattagttctaatcttatcctaacaacagaaggggcttgtagctattatgttttctagagaaaactcagaggatgccatcataaggcaactttatttttcacaatggctgttatctttaaacttgcattaaagagtaattaataattttcttctaaccttaagtgacagaataagcttgacagcttagataatgaaaagtcctacattcacttcttatcacaagagtctgtgtttcgtaacatgtccagtccggtgtaatagtaagcaactttgtattttgagtaagatgaaagtttctgccttcccttggagagagcctggtaaaatcgagagtcctcagtctgacttggggaggcctttaggcagtttttttccttagacagtaacatctcttcaaccaacaactaacaactactgtttgaaatggaaggaagcagggagaaaagtcaagaaaacataaaaggtcttctttgacagacactggtcagttagtatcaatcctctgtaaagctactaggactcaaagctgacttttctcttggggcactttcatggattctgtggagaccttctccccaccccaaatacaggagatgcatccccttcaaatggttgtttatgtcctccatcatccctgagcatctggatactcttccaatttttctctgctaaattctccttagccctctaggtagcacttgtgggaagacttaagaaaatttctcagccttgtttttcgttttgtatgaccgatatctggtccacgggaatcacagtggctttgagtcatcatgtgtgggagtgcgatcctcttgtttcagctccttcacagacagctccagctttttacctatgagatgtctcagatatggtagctaaaaagattaaggaacgtatcttgagtaatcctgctgttctcttgaagatctctcactagtttaggagaaagaccaggaagataggggaggtaccacagtataataatctccagggaagtcctccctttgatattcagcattctgtggccaattcaactgcaaccgtatcaaactcctgatatgaaggaaagaaaaggatagcaaaactggtttttaaacaacacttttagaagtcttgcacaggctatacttcattttcattttgaagtatgtatttagaatctatttccttgggacttcaatcagaaatataaaatagtttcccattttaacactcaggtatagtagccattaatattcttatttggaaaataaattacattctaataataaattaacaccaaatttaataatgaaaataaatttaagttctgcctaattatgaaactattttatgtgagcactgagtacacttaaataatgggattattagagtatttgtatgttcatcaaaataatagaaattttatgtaattaagttaaattcacttaccaaaacaaatgaatataggatatttttaaaccatgcaatatattagtataaatgagtatggcaaatctgaacaactagataaatttcctttctttgcctacaatgactcaaccagatgtttggcttctgctttgttataacctggaatgcacctttgtttgcttccaaatccctttgtgataactgtgttgtaaatatcctttagagatgagtgtgaaagaatgactctatcctgaaactcaagggcaagttctgcttcatttaagccgatcagtaaagccatttcctagcttcatgattggctaagggatagggataggagacaaaatttggacgaacagggcaaaaggagaaggtcattggtgatttctgggaaaagcacttcctccttctttccagagagcaattcagggagttgctgtctcttcctaatggacatgaactgaggaaaactgtagccctagtgttattttggtaggcatgttgcaatttcaggaaaaatcaacttcaagtgataacaatactgtgagaaacaaaaaagagatgaaaagaaaccagaattttcatgccttttggagtgactgtaataaaactagcccaaagtatgctcttcctttgaactctttagctatctgagcaagtaaactccctttgttcttcaggaaagatgtaatagattttctgttgcttgcatatgaaaccatctggagtaacacaatgcctgctcagaacattatctatgtatcactagcaagctcactattaggagtataattgggtgtgcattatttctaccaaaggcatgtgagtggtcttaattaaaaccgcttctgtatttgtgttctgatcatttatttgctctacaattgatcggtaggtggatggtttgaccaattactgctcatgctgtttcttctacagtcattgttaaaaatgctctaatggacagacttgcaatatgggcacctgtgattctatgctaactttgctgttgatctctgaacacaagtcctagatgattctttttcactcactccccatgctctgccacagtatctgttactgcatttgctcttttcttcaagattgtaccatcgagagacaaagtttaccctcagtaaataggagaactgttcagaactgttcatttgaagaaatacaccctgaggttatatacaaataatcctccagacattttaatagaataagattatctcagtgttttattaattttattatatcatttcactaaatatctatcatttatctatctttagtgcaattatatcaattttatataaaactattgtatataacatataaatatctaaaatatctaaatactcagaaatatctaaaacatacagaaatatatgtagtatataacgtgtgtgtgtatctacacacatacacacacagacatacacgtatttattacacagaaaggcttctgctttctggccccactttcacagtggggtttggggatgaacctacattgacacatcatcaccttaagtctgtaatttacattagggttcactcatggtatacataatttacactagggtttactcttggtatacaatctatgtgttttgacaaatgtataatgacatgtgtccagcattgtagtatcacacagaatagttgcatagcaatattttaaaaatagcatttattggactaattaatctgtctccaatttttgatttgacaaataggaactaagaaatcttagaagagaccttagagatcccatcaatggactatggttctgattcatgaatgcttaatatgctactaatctatcaatgcttcatatggaccaatctcagtaataacagagataccaattaaataaattgcaactatggcttcctatgaaaggaagcagaaacataggcagcctcctttacagaatggggaaatctttttattttgaagggaaagcatataatgcagaaagaagcacaattaaatatccattgcatccaaactgaagtcattgtgtaaatgagttgtgcaccactatttatttatgaaggtattgaacattcattctggcaaaacaatttattcagttttagagggcattattatgagttcattagatttctataatctgcacttcttagagatttttttcttttgttgttgtcaagcgagaccacgattgaaacacttactctcaaagttttctctgacatttatctcttctatggtaaattgtacaaaatgttaaggcctcatatatactacaaagcatttatcaactgttgagtagaaccccaaactagtgctttgtccttctggcatcaccttcagagcccacagttgctgaagaggattgattttgatcagtgttttagtctgttttctttcgctgtaacaaaataccatagactaagtaatttctaaagaaaagaaatttgtttattacagttctggaggacagaatgtcccagagcaggtgctggtgtctggtgagggcctttgtactgcgttatcccatggcagaagagcagaaggacaagcatttgcctgcaaaagaaaggagcaccaggggttaggctcacttttatattataacaacctgttaatgtgataatgaacccattcccaaaataacaaattaatccattcctgaaggctccaccctcatgacctaatcactcctaatgctgttacagtggcaatgaaatttcaacatgattttttgaggggacattcaaaccatagcaaccgggaacctaggtttgtttcttaagcttaattagtgcaatgacagttgtaactctgaaggatataactctccttcaactgacaatgtagataaattgcattatagtaatagtatatgtaagataactcaatcataagtttattgcagtccacaccctgtcaaagactctcttgagatgcttgatatttgacagtctacctcgcatatgaactattgattcctgtagcttctccaattttatctttttatcaattacatcatctataaatgcggcatctaaactttattatctttatgctaattccatactccttgctttattgtgatctgcttactctcctcttcaactccaataaatatctttgtttatagtttctgtctgccaacctaggaaacataatcattatgaaatggtaaaagagatttttagtatgagggtgagggtgtagagagtacataaacatcctttcttttaagcttatccatgttagcctttaaaggaggaaatatgctttagtagcagaaaaaagtcaattctaaaattgtatttatttttaatttttggaaaattgtgttcctatgacactaatgtatagagttagggatggggtttctccatgttggtcaggctggtattgaactcccgacctcaggtgatccgcctgcctcagcctccaaaagtgctgggattacaggcgtgacccaacatgcccggccaaacttgtgacattctgaatagtgttgcacaggttaacttctctgggtaccaatgtcttggtctgtaaaattaaaagggtagctagtggtgattttcatactagatcagtgatttttgtgcctcttggagccatagggaccggaaggagcctcctattagccattaagagagagcagaatagagagggcatgagctggagctgttgtgctgcttaacttcctcaccaccctttcacaaaagtaaccaaagtcacgttaaactttacccactgagtaaactttcttcaggattgtttttgaataagggattcttcaatgtttacaaaaatggaataaaagtctaagaattcttctagagtcccataattctatgaatttatgttttgtcctaaaaatctcttctacattatattcttcaaaaattatgggagtaagcaaaatgttatagggataacacccaaacaaaatagtgtatatttgtaataaaaataactatcatgtactgagtgtttatgctaagacttatatacacacttaatgaataaacccatttagtgctcacaacagacctataagattggcactacaggcattatttctaagatcacataaatatagaaggtaggatttgaacccaggctgacttgctctagagctctaacatttaactacaactatgtatactttctgtctaatataagacattagaagcacaaggcaacatgtcagttgctctcaggagtaaataaaaggacttaattatttgggaaagttatgaaaaaatgcttaaagtgaagctctgtagatcaaatattattggcattgcaagactgaaagtggttgatacattgtttacaacactttgcatacattgttttctactaagctgctgaaaagcaatacataaataaccaaataataaaatttcaagagaatgagaaaacaagttataggctgggagaaaatattaacaaaagacaaatctgataaaggactgttgtccatatacaaagaactctgaaaactcactaataagaaaacaaataacccaattaaaatatgggccaaaggccttcatagtcacctcaccgaagaaggtatacagatggcaaataatcatatgaaaagatgcttctcatcacatttcatcaaagaaatacaaattaaaacaaaaaagagatatcaccacaaacctattagaatggccaaaatccagaacactgacaacacacaatgttggcaaggatgtggaacaacaggaactcccatgttttattggtgggaatgcaaaatggcacagccacttttaaagacaatttggcagttttttacaaaactaaacacactcttaccgtgcaatctagcagtcacactctttggtatttacccaaaagagttgaaaatttatatccacagaaaaacctgcatatggaagtttatagcagctttatttataattaccaaatcttggaagcaatcaagatgtcttttgtagtgaatgaataaactggcacatccagacaatgaaatattattcagtactaaaaagaaataagctatcaagccatcaagacacatgaaggaaacgtaagtgcatatttctaagtgagagatgtcaatctgaaaaaactacatactatataattccaattatttgacattctggaaaaagtaaaactatagagacaataaaaagatgagtgggtaccaagggttgaaggcagggagggatgaacaggaagaacatggaggattcttagggcagtgaaactattctgtatgctactgtaatgttggatacatgtcattaaacatttatccatgcccatacaatgtgcaacactgagagtgaattctaatgtaaactataaacttttggtgattatgatgtgtcaacatatcctcatcagctgtgacacatgtaccactctggtgcgtgatgttaataatggaggaagctaagcacacgtggaggcaaggctatacaggaaatcaccataccttccactcaattttactgaggatgtaacattgctcttaaaatagtctttaaaaaggagtggatttaagggcaacactttaaatgtctttccacagcaatgccaagtcaaattccactgaccggaatttgcagtactatgttgaatatggtgagagtgggcaacttcaccttattcctgatcttaggggaacagataatttcaacaaagagatgaaaactataaaaaatcaaatggaaatgcaagaaatcaaaggcaagatgacagatttagtttttaatgattaaatataatgttagttgtgtcatgtcatatactatatcaggttcaggaagttatcttctgttcctagtttcttgaaagttctttccacggaaatcatcatatctttgtttgttttcttttgtgtgttgatatggtgaattatattgacaaatatctgaatgttaaattagcctttttaattatttcattataccttactttaaccatgatatattattatttgtatatattattggatttttatttgcttataatttattgaggttttacatctatattcatgagggaaataggtctgaaattttgttttcttgtaatacctttgtctattttttctgtaagcgtacatcttagcctcataaagtgaatcagggagtgctgtctcctccactacattctgggaaagttagtgtagaattggtattatttcttaattaaatgtttggtaaaagtcactggtaaagccacctggtcctaaagttttctttctggaagtacatcgcttacacattcaattttttaaatagagattagacaatttaggttatttattggataagctttggcagtttgtgtctttattagtttgttagggctggcataacaaagtaccacacactcgtggattaagcagtgaaaatttattttctcacagttctagaggccagaagtcagagttcaaggtgttgacaaggttgtttcttctgaggcctctcttcttggcttgtagatctatcttctttgtctatccacacatcatcatcccttagtccaggtagtttatgtcataatctccccttgtttttaatttttttaaatttttaacttttgtgggtacatagtagatgcatatatttatatggtacatgagatgttttgatacagacatgcaatgtgaaataatcacctcatggagaatgagatatccattccctcaagcatttatcctttttgttacaaacaatccaattatgctcttttagttatttttaatgtacaattaagttattgttgactgtagtcaccctgttgtgttatcaaataatatgtcttattaattcttctagttttttgtacacgttaaccatccccacctgccctccagccccccaatacccttcccttactagcacactagttatattgcattaaggctcacctatatgagtttattttaccttaattatctctgttaaggccctatctctaaatgtagtcacattctgatgtactgggggttgggactccaacatatgaattttgatgtgacacaattcattccataacagtgtcattcaaggaatttgtctacttcatctaagttgccagaattatgagtatagagctgttcatagcattccttattaaactttcattctgtagagtttagagttgtgcctcttcttttattcttggtggtggtattctgtgtctttcctttcttcttgatcaatggggtcacatatttaccaataatactgtcttttccaagaaacagctcatagtttattttgtctattgtttttctgctctcaatgtcattgacttctgattttatctaaattatcttcttctgtctaattgccctgggttcagttttctcttgttatattttcttaagcctgaaacttagatcactgatttgtaatctttttaaatatggatacttaatgccacaaatagccctctaagcattgctttagctgcatccagtagtatgctaggttcaacttatactggctcatgagagctaattgtggagtctctgcccaactccattttctgtgatgtcaatcatgatggaaacatttacaacatgaaaactggcaaatgctacaaatctgtatcttttttttcccagagagctgactgttgaacatttactatgacggtgttctcatatgtcctattaattttggtagatcatgttttcatttttacttaagccaaaatattttctcatttctcttttgatttcctctttggctcatgagttatttaaaagggtgttgtttaatttggacatatttgaacatttccccagatatccttctgttactaatttctagtttattttactcataatccaaatacatactttgtgtaatttcaatttttaaaaatgtgttaggatttgtttgtaattaaaatatagtttacttatagtctagagtgttccatgtgcatttgaaataataatatatcaaactatagttagacggaataaaaatatctgttagaccaagctaggtcagagtgtggtttagctttctatatcttttaagttttctttttatttgttctatcaattactaagaaaagagggttgaagaattcaactatgggcataaatttgttaatttctcctttcaattttaaaaagtttttgctttatacattataaggttctattattagatccatacacatatagcattgttatatcttccttatggattaatccctttatcattatgtaatattttatatttcatttgtttagtaattgttttcaaggttcatttatgttatagttgtacttgatttctttttatggctgaatattatttcacattttgtttattcagtaatccattgattggcattttggttgatttaactttttattttttttacttttaacctgtttctttcatactttaagtgagtatctttcaggtagcatataacagcatacaagtgtatcttccttttacatattctggcactctctttccttttaattagtttattttcatcatattaattatggtataattgtattaacatttgttgtcttcttagatgctttcctatttgttatatatgtttctatttctcttatttctttgggattgggttttcaatgattcatttgtctttatgattgccttattatttatatctgtctgaatttttttttagtggttgccattgggtttataatgctcatctttaatgaaaatatgccttccaataattttatactacttcatattcagtgtaaggacataataacaggaaacttccacttctttcctctcatattttgtgtcatatttctcataaatttcttctgacatattttataaattcattgcaactatgtttgcttgtgacaattatcttttagaaaaactaaaataagaaaaaaatgaattttatgtttatcttgattactaggtgttttttgagacagggtctcactctgtcacccaggctggagtgcagtggtaccatctcaactcaccacaacttctgcctcccaggctcaagcaattctcatgcctcagcctcccaagcagctgagactacaagcatgggccaccacgccggactaattttttgcattttaaggagagacatggttttgccatattggtcaggctagtcttgagctcaggcaatcttcctacctcagtctccaaaagtactaggattacaggagtgagccactgcccctggccatttatccaaatttctttttgtcatcatattcctctgcctaaagaacttcctctaacattgtagtgcaggtctgctggcaatgaattctctctctctccctctctttctctcattctttaattttccattgtatttttgaaaaatattttcacagggcataaaattctcacttgaccatttttttgtctttcgacagtttaaagatgtcactctattgtattctggattgtaaaatttatgataaaaatgtttttgttattcctatctttgttcctctagatgtaatatattttattttctggttgtgtttgatttttcagaagttcaaatatgatatgtccaaggatttgtgtgtgtattatgtgctcattcctgttgttagtctctgagcttattgtatttgtgacttcatggataaaaaattctctgccataataccctcaaatttcatttgttactttattttctccctccaagatttcaattatgcatgttaggttgtttggtgtttttttcacagattttgaatattctgtttttttcttccttgtgttcagtttgattgacttttatcctttatctccaattttacaattttaccttcaatttcacttcagttttcagtctaatgatgagccatcaaagacattttcatctctgttaccgtgtgtgtgtgtgtgtgtgtgtgtgtgtgtgtgtgtgtgtgtgtttcggtggtggtgttagcattttcacttgatttcttccttatagtttcatctctttgatgaaatgatctatctgatcatgtctgttgtccacctttttcactagagccctttacatatgtatcatcattaaattaatcttcctgttggatagtgacaacatctgggtcatgtctgtgtctggttgttattttttcttgcttccttgtgtgccttatactttttgttgaaagatatgccatttttggtaagaaatgcagagaagtagcatttttgcttggaaatgggtttgccttgtttttaggcaggcctttattaatatgagttatgtcattcctgtttggagttggacagaatataggcttctaattcttccaaagcagtcctctgtaatagaaatataatacatggtagatacatgattttaagtttttagtagtgttgttttcaaaagtaaaataaaaatgcaacatatccaaaatactgtcattatgacatgcagctctactcacatttcaagtactgaatagccacatgtggtttgtgactataatattggaccacaaaatttgagtattttctgttttagaatggaggttcgtttgctagagagttgttctcaatggtttttccaccatcacctttaggttttcttttaatacctgtccttggagaagtgttcgttctacatttttgacattcccctaggagtacactgctgttacttgtttctctgtgactggtggtaggcactaggggaacattctctggtattctggtctagcttcattcttaggcaatcactttgtctgcatctcagggatagagccttctcaagggttcttcttctcccttcaataggctgggcccagtatatatttcttttcctccacaagggtgagggaatttttgttgttgttgttgttcccttccctcaacatcactgggtcattatctgcaccttaaggatgatgatattttcttcattttccagagtcttaaggtatttgtcatggagagataggagagaaggatccaggtaggccttcatgcctttcttgcagggctgctgttctgttcctacaggcccaatagagacattctcaagattttcaccctgcccccagtcaagtgtggtggcatccagtgaggtttgtgaagagtctggaagtgggtcaaactccccaagtgtttttggttcccaagggctgtatgatgtcacaagagttcacacttcacctttagcaagctgctcaattttagtaaaatttgtctcactggcttgaaccgcactgggtgtctagcatctgccttggctcatcagaggctagtgtgctctttagaaacacttgtttttccttagatttgaggttagttggttgctttgtgactcagctatctagtagattcaagaaccattgtgatttttgcagattttcctatatatttttttaaacttaaaggggaaagttacactactttcagctttctgtatagcaggaggaaatgggaattccttgatgcttatttttgataagtataactctcctattcccaaggaatctctcatgcattttgctgaaaatcatggatatgcagaaagtaaagcctagctttcaaaggattccttaagtcatagtttattatgctttgctgtattaagaaacaatgtgcttttgtttgtttttcaaatataaattatttgtaaaatatttttacaaatagttatttgtaaaatatttttacaaatagttatttgtaaaatatttttatgaataattgtttatttataaaataattgtttaacaaataagaatatttgttaaatattcttttttatctcatactttctccttcagagaagctgatatccagataaaaggaggactgtcccttaccccacttccagatatattagaaatcaatgatacagacatttctttgtgactggagaaatgagagtttgatcagtgtcattggtgaacaagcacagtaagaccaagcagtgtcaatctttgtatcctcttagacatctgaagtcatgccatctgatagggtgacttatgattgggtattcagggttgatccaatttcattgttttacaagggcgtaagtacagactacgtactcaagatttatgtagccagctatgctgggtgctgaacataaatgtttgaaaagtatttggacaaattgtttctaatctgacacatttcacctccaggtattggttgttgcaatgacccctggttacaaatcacagctgctaactaatgggcactatgagcctgtggcttcactgacaccatcattttttgtatgtattttatgttgtttttgctggagtgtgcgtgacaagttagatccaatctgtctgctcagcaacaagcaaaacgaaaaacacaacgtaggaaatattgttcacatttccaagattgttttctatcatttggttttactaatatgctaacattcagaactgataaataaatgaaaaatggataggaccttgaaaatggatgatttttatgataactataagctgacagcattatttttaagtggacagttgtttgcattcacattggttattcattttatatttaattcactcacctctctccaaaaggttccaatgctgtgaaataaattagctgtcacattttacaccagtaggtagtagaggagctgcctccctttctggagctgggttttatagaaagaggtggacatgtgatatgactggtattttgtttcattatctaaaaaatttttttagaaatgaagaaaaagggtacgtacccttcagtagacagtgttcttcccactacagttgctgacattttgtggaagactttctctgtaagttagaggtgaatttctgtgaattgtatatccttaattattcctgttgggaggtgtaactttttctttttccctatgactgccaaatcccttttccacagtggtacagctgtgcttgggagatgctctgtttgtttctttaagttgaagtgaagtggacagatttatgattttaatgaaatatcttaagcacaggaaatatgcatttaacacattttatgctctttccctaatatgcacccttgcctctcccacttttcacaaaactccttgtaaatagaaggttaagcctaaaaaatatgcccaataagtgcacattgcattaatagttcagttcacgtgagtataggaaactctgctaatgataacatttgactatgagattcttccttaaccttcatacctttccaaaaaccttctaagtttgactccagagaatgcaagaactaaaatatcatgccattcttctacaaaagacttataaatactcaccattgtggctgttattaatattctttcgttttaaagagaaaggtatcagctcctctcatttcagaacaaataacacaactgtaaaagctgttgccaagcaacctgaattcacagctcagatgggctgaattgtttatatccgtatgtggataaaactgacccactccttctctaaaaaatgtatctacgaagtctttgagatatttccactaatattttaggctgtaggtcatggcattactattctgtaggaagttctgaaattaacacacacactatctacactgtggcattgcaattgccatattacattataactatctggtttggggtctgtttccccattgaactgtgagttccttgcgggcaagtattgtgttctactcatcatacaggcaggttctttatacatagccaggacttcatcagtgtttgacggatgcatgaaaaaaaatgattttatgccagtgtctgtgctgtacactttctacaaaaatattttcttactagaacctgaaagaaagaaggaaactgttcaatttaaaaatctaccaatatgaaattataataagcacaaactgaagcattcaggtaaaaatattagaattataaacacattttagaattaaaagaaactttgtgggacatttaatctaatggttctcatcagaatcacacctggaacttataacttttgagtgacagtttgaaatgaggtatcctttttttaaagttccccccggagattcaggaaccgaattatcactgatgtagtccaacagtctccatttgtggtggagaaaatggccgcagaggagtgagaaccacgaggtcatgagaagagcacaagctcttgggtcacctgcctatcaagtgctgtctgactgtagccatctgttcctcactgtccataaaatggaaataatacttacttgtgagatgtctggggaaacttaatgatatgacctgagtagtgccttagaaccatgctggtgggaacctggcaaggaccatctcttcccttcacaatatcctctgagttgcaaacacgttgtgaagagaacctttgttggctgacttccaaacacttcagggccatgtagaaccgtacaggatacctctggctccgacgttttgactggaaaggagcaagcattaatcatatctgtcaggatccctgcagaatactcatgaggcatcacccaaaagggtaaattaagagtgttaataaaagactcttttcaaaggtgtggagaggttaagggaaccaccgagaaactgtgaggcaaggcagggttaccagaccaaggggtcagagtggttactggaaactggtactatctgtggctgcaagaaatggattcctggcaggagctgaatccaaatgagaggaacagagctactggccagactgcagcctggcaggaagggagccaggaaaagaatctccctctcctcctactctctgattttctactggcagtcacattggctaagttagagaaggaggatgcccatccaaagcaattctaagggtcaatctttggtgacacagagcaggatgaagaaggatggagaaggctctggaagggaaaatagaagatatctaggcaatttccagtcttctactttatgctgggtactttttaagcaggatgtctttacaacacgttttcctttgaggcttattcagttgaatataaattacctaaaaatgactgacattgtggtacagtcttccttgccaggaatttacatgtatacctactaactctaccatgaataaatgttcctaggcaatgaaaccaaaacttgactactgaatgtgggtcccctggagaagagacacagttttcaactgaacacaaggcccctttgttggagtagattcaggagggaaaccagcctgcagggtctacttgccagggatgcagaataaccaaaatctatgcctgcctcagcagctgccggattttcctgagccttctgttcaccactttattttcaaatttatccatctaagaaatgagaagaacacctgtgcctcattacacgattgagatttttgagggaaatgaggatcattcttatggaggaaagatactgtctacttaaatgcaaagttgaagagggaggcattctgctggtgctaattttcttcaacaaatgagacatgtataagataccggatgctttgttacctttactaaacctttcttgggaacctggagactgagagatgaataaggttgcctctacctttgaggagttcatggtcttgtggaaggaatcagaaatgaaacatttcttaaaagggaataatattgaattgaagatcttggtattcttttgtaatattttcctgcatttattttatttaatgatacatgtatttatttttgtaaatgatggtctccatacactcagcacttcacatgcattggggttgccaagcagtccctcttggctccactcttccctggcaattccctcccttaggttcccaaggttcactaactgtttaatatccatgccttggttcatttctgacactacttgattctccaccagctttcagccttgttctgaataatttatcctaactcagttttttattcttttatgttatatttctgtaagagccctactcagtatcttcatccccatttccacttggcagaagagagattttatatagagattttatatagtggttttataaacctataaaatacctactgggcacctgcagatagtaaatattctgttactcttttctttttgtccagtggtgaaggtttctgactgttcagtaaccaggatgttaggaccaataaccagggaagccttaggcttctaaaagtttagttatgaagtatcttacagcaatatcaaaaggacacaaggacctgtttattgacttgaatgtgagctggggctgaaaaggaatagtattccaaggagcagcatgtgtaaaggctcagagtcaggaatgggcaagctgtgttcaggagcacagtgacagtatcaccctatatggggttaagagctccaggtgagatgtgattacaccacctacaatgtatagtgtgactaccatgtgtctagagctttgccagattgtttacatatatgagctctaatcctcacagcacagaaacctgtgtcacacagctagcaagcagtagagccctcttcaatactcagctctgtctgctttcaaagcccaaaattacaccatggcagtttgctgccttatttcctaagtaatataggattgatgaaggaggaccagatgttgaggattttcgagaaccagaaacagagtatggaaaagacctggtagactttagacaccaatcttcctgtgaataatttatggaagaatattttctaaaatgatcacatgccacccacccagattctcaaatggttaaacattttccagttttttgactttgaaaatacttttcaatcagcttctataaagccagttgcatgaaattcctgtgctctgtcgacacccttctgaatctggtcattacttttctctattcattacctgagaggtagtagggaaaatacagaaaatgaacagtgggtagcttccaccgtacctccatctatattgcaagctctttgttgtaatgccgctctatctgaaggcctagaatattttcccttttccatttcccctcctctttaaaaaagaattttacagcacaccagacatgagagactttgtaatgattccatctgagatatagaaattgcttaacatagggaagtgaatgcttgtggattcatgttagcattctttatctatggagaatacgtatgctactgtgtgtgtgttatttaggttaagctataacccatgtacttcaagcattctaatcagttatgcttagtcccagagaggtcacctgacctttaattaagtaagccagaggcagcagcaacaaacctttcagcaatccagatcttaacacaggaaccttggctaaaagacatattgaatgcaagccatgaatttatattagtgaaactgttgtcttaattagcatgaagagtgtcataagtggcctttcatcagtgaaataaaatgtattcacaatatacacatcagctaaaatatgttaaagatgctctaaatagggtttaagtatctagtaatgtctgtagtcaggacctcaagaaagttcctgtactcagttcctaagtggtactctgtccagccattactttaggagtgtttctgttttcttaatggaaaccagaggagtaacagaatcctatctctggaatgttcttgtgtctgccttgagtaattctttcatgccagaattatagaatagtcagagcacctaaaaatgacgagaatgggggcttcttttacagaatacaatgtaagaacagttctgccttcttcgttattgggggtgattttcaaaggggagggagtgtacgaatagggtgtgggtcacagagatcacatgcttcataaggtaataaaatatcacaaggcaaatggaggcagggcgagatcacaggactggggtgaaattaaaaatgctaatgaagttgcatgttccactgggcacgcatcgtcattgataacatcttatcaggagacagggtttgagagcagacaactggtctgaccaaaatttattaggtgggaatgtcctcatcctaataagcctgggagcactacgggagactggggcttatttcatcccttatctacatccgtataagacagacattcccagagcagccatttcagagacctcctgctaggaacacactctctttctccaggctgttctttgctgagaaaaagaattcagcgatatttctcctatttgcttttgaaagaagagaaatatggttctgttctgcctggctctcaggcagccagacctaatggttatctcccttgttccctgaacatagctgttatcctgttcttttttcaaggtgcccagatttcatattgtttaaacacacatgagttatgaacaatttgtgcagttaacacaatcatcacagggtcctatggtgacatacatcctcagcttatgaagatgacaggattaagagattaaagtaaagacaggcataggaaatcacaagagtattgattagggaagtgataaatgtccatgaaatcttcacaatttatgttcagagattgcagtaaagatagatgtaaaaaattataaaagtattaatttggggaactaataaatgtccatgaaatcttcacaatttatgttcttctgccatggcttcagccagtccctccatttggggtccctgacttccattaacacttcgtagtaaaagtctgttcagtaaatgtctaggtgtttggcagagggaggtaaccctcaaacacctcagattttgggggtacactgttacaaataaaaagaaccaaaaagttgttcaatcagttggcaacagttacctttccttctattccagctacttcattggctaggcagggttttggggtagcctacgaatcagaccagtactgataaattcttatagatatatttgttttaagtgctagttaaccgtgtgtaatagaagttttgtgtcaaactccttgctaggttggagacagcccatagtagcaaattttttatttcctagcaacccctaatagtcctgattagcaagctctcatttatttactcagtttgggaaatagagcaaaccagacatgcagccgtgaattcactaatcgttctgtactgtggccatcagcaaacctttgggtagttctcagctactgctgataattcagaatagagcagttagctattgcaaatttgatgactgtgcctgttttgccacttctgttctcaacttaattgatagttgctgcctttattatgaattattaacaataagagtgaattttgttgtttggtaaagtgataaattgttcttttgttctcaaggttaattgcagtccctatgccctgtttacactttaacgactcccaatgggagcaagcaaacaaacaattgaaaatataaatttaattgtatagaaatgtagcataaaataaagataaaaaattcatttgtgttcaggggcaagaatggtgatataaatgttcaagacataggtttaagctcatacaaaaaagtaggaagtgtggcagcaacaaaaatcatttctacttcttttcttcctgaactgttcaagtacaaacagtctctgggctcaacaattataccaggcaaaacattaggcatgaaattgatgttttctaaaatttcaaggtttctacgaataaacaccttgataaagaaatgaatattctatgtgcttaaaaatacttatcataattactatttattgatactgttaccaaaagtgatgcaaagattgaaataggtggttttaaaagtcaaggacagatgatcagattttatacaggttgagataattatagcaagattataaagagtagttaagtattcaaaacctccattttcccaccacaaacatatagtgaatacattcattttctcagagtgcctacacttcataatttcaagattaatgctcatatgacaattattcattatagttaaaagtaaaatattattgagaaccctctaaggaacaaaattcttttctaatagctataaaccaactgtttaaatcttacaagaaagaactttcattttcaactgtctattatttgtggtcttagtgtctttcaaaggatgtgacttgtgaatatttctcttagcaatacaataagatagaatggctattttattaaattgtgttctacaagccctgtttcaatagcataacttgtctcaatcttccacagttcctgctgttaaaaatatgtagcttctgatgtacactcttattctaaatatagataaattaaatgatgcttataaattttaaattctacaaatattagagtcaacaacaacaaatgaacagggctgtctctttgtgctgtctctttgtgcttgaagtcttggcctgtaacattccaggaggaaattctcgatcactagcagttatactccagagagcaggcatttggacaaatttgccttcaacaacttagcaacagatgagtctgtacctactgctcagatgacactgccagggcttgaccagagtactttgctgtagatgagagctttggtgacagattcttttgattggaaagttggtaagattcctagatcaggctgctatggaggggcagggctcaatggggaccttgccagccaggtgaggtggctgatggctctttgtaatagctttggaaggtacagctaatgatctgtaggagtcagtctatggatgtacactctcagcaagagaagatcaaaggctagattatgctgagagccaagggttaagtactatttattaatagctataccttgaacagaatccacagaaaggtcagagactctcactgagagtgggaagttcaccatgttctatcacagtctgtttcatatctgctatttctagagaaatgtgtcatctaaaatgcaatgcaataaaacaatgcagactttgcattatttttttaaatccaatacatgaaataggtatctggataatagcaggttcttgatacatattgtactttgatgaaaccagatatattaacagagactcttttggttccaagttataaaagtttttgagctaacaggtgaaaatggtgaatttacaaggtatctggataataataggttcttgatatacattgtagtttgatgaaaccagttatattaagggagtctcttttggatccaagttatacaaacctatttgagctaactgaggtgaaaatggtgaatttataatatgggggaaggccacattcaggaatcaggaaaataactggtatgagggacatcagtatcaataggatgttctcacattcctgctcccatgcaatatacttccctctctctgtaggccagtttctcttcttcttcagtccacaaggtgtaacacacggccctcagtaggcagccgtgtttacatgagacaggtagggtcaatctgctgctgagaaaagattactttctcagtcctcattctaaattctctggggagggaggctgtgtgttacatcttgggatcaaatacccatctgtggggccacttatctggcaagggtcatatatcattagtgacctggctgccactaacctagtgatacagctgcatggtacaaggagcggggaggcagcttttagaaaaaggcaagtgaaacaacttgaaaataagtagcctgctactttagaggaatcaatgttaaagcagtttaagagatgtacatatggccgggtgcagcagctcatgcctgtaatcccagcactttgggaggctgaggcgagtggatcacttgaggtaaggagttcaagaccagcctggccaacatggtgaaaccctgactctagtaaagatacaaaaatattagtcgagcatgatggggcacgcctgtaatcccagctacttgggaggctaaggcaggagaatcattaggacccgggaggtggagattgcagtgagccaagattgtgccactgctccctagcctgggtgacaaagcaagactccatctcaaaaaaaaaaaaaaaaggaaatgtgtgtggtgtgtgtgtgtgtgtgtgtgtgtgtatatatatatatataaaattacatattatatgtaatataaccatgtaacaatatatactaatatatattataatatgttacagtatgctatatcactaatatagtatatataatatatacatatatgataaaatcagcctacattttagagcctcatcaagttgtactaagaatgaaagaacctctattagatgtttccctaggaatcttttgttggatgctgggtcttaagaattgggaaggatgctctgttctgggggaaatactagatctttagacaaaagctttctgcttagtaagccttcctcctttgcttcctcccttcctttctccctcccttccttttcttctttcgttcctacagaagcaacccataccagtgtagctgctttcattataaaaagccctattgtgataagcccttaggcatggtgaatgagaagagttacaaagatacaagaaaagctgtataaattactgtcaagataggtggattggattgtgatatggtttggctctgtgtcccacccaaaccttatctcaaattgtaatgtccatttatcgagggagggacctagtaggaggtgattgcatcatggaggtggtttctcccatgctgttctcgtgatagtgagggagttctcatgagatctggttatttgataagtgtctggcactccttgccccactgctgccatgtaaagaaggtccttgcttcccctttgccttctgccatgattgtaaatttcctgaggcctccccagccatgcagcactgtgagtcaattaaacctcttctgtttataacttacccagtctcaggtagtagccttatagcagtgtgaaaatggactaatacaaagaattggtacaaggagtgaggtaaaatgtggaagcaactttggaactgggtaacaggcagagattgaaacagtttggaggactcagaacacaagaagatgtgagaaagtttgaaacttcctagagacttgttgaatggttttgaccaaaatgctgatagtgagatggacaacaaagtccaggtggagatggtctcagatggagatgaggaacttattgggaactagagcaaaagtcactcttgctatgctttagcaaagaaattttcagcatttttcccctgccctagagatctgtggaactttgaacttgagagagatgatttagggtatctggcagaagaaatttctaagcaacaaagcattcaagatgtgacctggcttattctgaaagcattcagttacatgcattcacaagaaaatgggttgaaattagaacttatgtttgagaaggaagcagagcataaagatttataaaatttgcagcctgaccatgtggtagaaaataaaaccccattttctggggaggaatttaagcctgctgcagaaatattcctaagtaatgaggagctgcatgttaatagccaagacaatggggaaaatgtctccagggcatgtcacagaccttcacatcagcctctcccattacaagtctagaggtctaggagggaaaaatggcttcatgggatgggcccatgaccctgctactctgtgcagctttggaacttggtgtcccgcatccccgcggttccagctcaaacagtggctaaaaggggccaaggtacagctcagctgtagcttcagagcatgcaggccacaagccttggttgtgtccatgtggttttgggcctatgggtgcacagaaaacatgaattgtggtttgggaacttgcctagatttcagaggatatatggaaatacctggatgcccaggaagaagtctaccgcaggggtggggcagagacctcatggagaacctctactaggacaatatagagggaaaatgtggggttggagcccccatacagagttcccactggggtactgcctagtggagctgtgagaagagggccaccatcctccagaccccaaaatggtagctccactgacagcttgcaccatgcacctggaaaagccggaagcactcaatgccagcccatgaaagcagccagggggtgggttgagagggctataccctgcagagccacaggggtggaacatcccaagggcttgggagcccaccccttgcattagtgtgtcctgctgacatggagtcaaaggagattattttggagctttaagatttaatgactgctccaccaggtttcagacttgcttggagcctgtgccacctttgttttggccaatttctctcatttggaatgggaacatttacccaatgcctgtactcccattgtatcttggaagtaactaacttgtttttgattttataggcgcataggtggaaggggccttgtcataggtgagactttggacttgaatttttgagttcatgctggaatgagttaagactttaggggactgttgggaaggcatgattggctttgaaatgtgaaaaggacatgggatttgggaagggccaggggtagaatagtattgtttggctctgtgctgccacccacatctcatctcaaattgcaatcaccataatccttacatgtcaagggaggaacctagtgggaggtgaccagatcatggggacagtttctcccatgctgttttcatgatagtgagtgagttctcataagatctggttgtttgataaatgtctggtgcttccccactaaccatccttccatgatgtgaagaaggtccttgcttcctctttgccttccaccatgattgtaggtttcctgaggccaccccagccatgcagaactgtgactcaattaaacctcttttgtttataaattggtcctaattgtattagtgtgttttcacactgctataaagatactacctactcaggatacttctttttacagaggagaaaactgagtcacagataagtaaaacagcttgaccagcatcatatggtgaagccaggattggacccagtgagtctggtcccagagcccattctattatgaaccccataccttttcagtgtaggtacagtggcatgataataatgtagctgacagatttaagggtatattactggaaatgtttaaataaatcagaactataaaattacataaaggtgagaaaaattacaccataatttcctgtacttcctttggttctaaggtgacagatgggactattttagcaagacaaatgtcttaaagaacttcgaggtttctgacattttagttttcagtccagatgcaatcctttgattaatgaagttctggttttagtttccctaattttcaggcttacacataaggtccttggaagaatatacaataagcctaagtgaaaacgttagtggccatctatctctttctaaatgggaccatttaaatgattgcagacagataattgcctacattaaaaccataaaatatgttatgaaactcccttctttggtcctcttacaatcaggcatcttaaatactgactccatgtctattatcccttctttctcccactctaatttaattggtgtaagttcctaaagcttcatcagaaaaataccttccaaattttcccagtcctctttcatagtgcttttctaaccccaaggtccttttatgtttgtccttgcattcattccattttcagacatcagtgccacattcacaaatcagcagacctagagaaagtagatcatatattattccattttgaattatttgtgacctaaaatttaaatattagaagtgaggggcagccttgctatatatatctggcaggtcctacttgaaactaccttaggccaaaagcagcagatgctgtgtttcacagttgttcagaagcatggcatttaagtaaagacaccttgtccatctaatctcttctcagcatttgacttgggcgcacggataagggcagatttgtgagtatgatcctcataaatcaactccaaccatatcccttatttacttctgtcccttcaatggcttcctatctcattcaaagctcatgcccagatcctctgtgacctcgtctccactgatggcatctttcaaccttgaatcaattactctttcttgattttgcccagcacattcttaccaggatgcctttgacattgtacttctctctgcctgaattgctcttcctcatatatttccagggctcatgccttcacctccttcatggatttttctcaaatacatctcagtgaagctttccctgaccaccttcatagaattgtaaccctctgtcctgacacttccttacatccctctttttccttctaagaagttatcactatctaacattttatatattttacttatttttccttattagtttgctgtcaagaattagatatttttgttcattttattcactggtaaagtgaaaaaaggctagaaaagtgccttgaaaagagtaagcagcaaaatatttgttgactaaataaacaagcaaagattatacatgcaaaaaacagaggtaataaataagggtttgattcactttttaataatgtttgaaaaatatttggggagacttcctgagggaggtgacatcaaaactagggttttaaggataaattaggctgggtgtggtggctcacgcctgtaatcccagcactttgggaggtcaaggcgggtggatcaattaaggtcaggagttcaagaccagcctggccaacatggtgaaactctatctctactaaaaatagaaaattagccaggcatggtggtgggtgctgaggcaggagaattgtttgaacccgggaggcagaggttgcagtgagagctgagatcccgacactgcactacagcctgggcgacagagcaaacctccaactcaaaaaactaacaattttaaaaaaggataaattagagttttagagttttccagcaggacaagttagaagtggaaattttacgtagttgaaaaaacatgtgcaaaagcactgatacaaaactatatggtgcatttagaataccttaagtttaaaaatattgataaattggttgggcgcagtggctcacatctgtaatcccagcactttggggggccgaggcaggcagatcatgaggttaagagatcgagaccatcctggccaacatgatgaaactctgtctctactaaaaatacaaaaattagctgggcgtggtggcgtgtgcttgtagtcccagctactcaggaggctgaggcaacagaatcacttgaacccgggaggcagaggttgcagtgagctgagattgtgacactgtgctccagcctggtgacagagcgaatctccatctcaaaaaaaaaattgataaattgtatgatattaaaataaaaatattagaatttattatttaaatcgtggaaagtgcattgggagttttaagcatgagtgatagagaattatgctctgttctgcttttataaagatccttcggcagcaatatgaagcataaatttgcagaaattgaggatttgtttagagatttaagttaaaagcattagcaacagtccaggcttcagtagatgaggactgtactataggatggagggacagggatggtaacaaaagaattaacattataaatgattgattgaatgattttctgtgaatatgtgcgtgttttggggggagatttagaggagtgaaggagctgaattttattgttgatgaaaaatggggttgttcagctgaattactcagtttatttcttattcgttaacattgatgtatgtcttggggtaactcctaagccgttcacattcattttatatatcttaagagttccagaactctggtttattggttagggaatgcaattagtaggatagacctttgtttcttaaaatcaatgaaaagatcagcagaacaccctaagctgtatttttttctcaaggtgcataatctgaagaccttgtgtaaaatctcgactcctgaactttttcctgaagtgaacagaaaattgttgattttagttcactcaaacaaaataagaactattcactgacaaatcttctgcataacattattctgtatgtgaaatacatggctgtctgctattggcagctcagtgtgcattgttcagtagaaaagacataaactttgagtcacagggatacaggctaaatcccatacctgtgagataatctttggcaaaattaccaggccaccatgaatcttacttttctcttcataagacaatattttactttttttttttgaaaaccctacatcccaggatagttatgaggtttaaactagatagtgtgtatgtataagtttgagggtcctttgattctgagtataaacaactttggctaattaggaaaataggatttattggaaggaaatcaggacttaaattattgacatgaagccagagaatgggcagaaacgacggcagcaagaatcacagaaacagtctcatagctgaaacaaactggtctggatgccactgcaagaaagagtgtgtgctagctgttcctgtttttcctctttatgtgacctgcttgagactcagtcccaggagagagtatcaaattggcagatttgaccccttccagcttccacactggaaggaaggccctggggtttccatcccagcaagactctagacgttcagacagaaataattctgcaaaaggaaattgggatgctgagaaggaagaatggattcttgctagacaaaaacatgaaagtgatgcctttaaagtgatttattaaattgatgacttttgacgtgttttgatcacaatccacagcaagaaatgcattttacatcatgacctaggagtcacatatgtatatgcatgtttgtatttctttataaccaagaaagatgtttcttttcttaccaagcttattcttaccatatatgttgctctgttttgttctattttattctatttcactttttaacagcccagtcatgccccactaaattgatttcataacttatgaatggtttacaatctacaggctgaacacattttgttataatgtatataatattagtacattgtaccaaatattagcaaactgtaaatatcagttcttatatcatcttccccctttattttgcctcccactctcccatgaaataaaatcacagtcagtgactgaatgaccaagatatctgcagcctctctcattttattggctgatggcatagttttagtcatagtttcctgaagaatagagttgtatcaatttcataacttttaagagatgtggcatataaataaaaacggtatgaataaagaaatagtaaaatgaagaatgtgagataacttaagcctcagcaaaactacaaccgccttcttgaaatatcatagttttctgctctgcacacaaacatctgctgttgctccctgaaatgagattcctgaggctaagcacaccttttcttaatcttgactgtattgaaaaacctatttggatatttttggtacaaacatatattttggcctaagatgttgagttaattggtttagaggtttgaggcttgaattaatgaaataattgactcaattctttattttttattttagttagtctttcaccaaagcattattagactcataatacatttgaccaaagatcttcaatctaatataattggataatttactgtaattatttcatttttaatgatcccctatcccatttcctaggagaactgtggcaatctctctcttcaaacctttagtgcttgatctatccttatcaaaccaggggatgatttccctaacttgcatttgaagccttcctccctgagatttctctttagaatccctcaaattttaaggtgtatcatttctcctgtgtctggatctcattccttttggcatctcctggtagccaagttcttgaatttgtcctctttcattttcttcttcaaaccagccttctctactggcgaaatcatctctttttacaaatgttctctgatgccctaacaaactatctgaacacgattgctcaactttcctgttcccacaagctaccattccataactccatctttcttcacacgctacatttttttaaagtactgtatgtacattttgcttccatttcatactatccactcattcctgtgtctctaatcaagcattcactcttcaatctactaaaactcttccctgagtctctcatgacaatatccaagatgtgtatttgtttcagttggtttccttgttgtgacactattctggtgctttgactcaagctgtatcctaaccagtaggcatttcccaaagccctctgctgaccaaccttctttttggtagaggggcgagatacacttacatctactggctcggatacagcttgagtcgaagagaataggcaaataatttaactttggttcaatctgggatctgccactgtgagctatgccatcttgcctaattgtcctacccttctcagcactgtataatggaaataatagagcccatatcctagggtcttctgaatgttaaatgagaaaatattggtaaagtgcttagagagtccttggctggttttcagtgtcagttatcattttcccaccagggaaacagaggcccttctgttgcagatggaagaacacatttttcaaattcatgaagagtgagttcctccactataccaccctaggcctctatctggcccttcactcctcccccagtgtgtctggggaaagagtcctcctatgtagcttaactccttccatcttcctttttctccactctcctcctttatgcccgaaattttgtagaggacactgtgtatgataagtttatctaaggctagggctctatattaggaagttgattgtgttgcactcctaagccatcatcttcagcacttttggattcatctgccatctcctttatctatttcagttgatgaagaatttgagcagagaaaaaagggtggtgaccctgtggaccttctcaaaccccaacacttactgatatttttcccctactccattggattctcaactccaggctttctctactgtggtccgtcctatacaatgctgcttgtcatcttcctaaagtcctcacgaaattgtttcctttacaaccagaaaagctgctccctgttatttacacaattgcgtgtggatttcccaggggtgttcatggccctctactgcaacgtctaatttccccactgctgcttttgtgttactccatgctccagatgagctagatgttttcctgaacagcacataagttttctgcctctgtgttttgttttatgccattttttccacctaaagaatagtctctcatccttctttattttttgaaattctggaacttaagtccatctcttctgctatcatcttttcagtaaaggccttctctatccccattctgatataattaattcgttcattagcatgtatttttcaattctcttacggcatgtagacacatataagtgtatatataggcatccttattttaaaatttataatgggactggttttcaccttatacaatcagatcataacctgtttaaggacaggaaatacagcctcttgtttttaagccccatagtggctgtgtagcattgagtatttagcagggagtcctgtagttaatgagtgctcattaagtcactaagtattttatgatttaaattgaaatgagtagtcagtgtattattcagtattctccagcaaaacaaaactagtagaacacatacctacctatatgtgtgtgcgtatgtgtgtgtctgtctgtgtaatatgtgtgtatatatatatatatgtataatttatatgtgtgtacatatatatattacatataatttcttataaagaattgacttacgtaattataaaagttaagaagttccatgttccgctatctacgagctggatacccaagaaagctggcagtatagttctgagaaccagatgagggcaggagaagactcgtgaaccagctcaagcattcaggtgaagacagcaaatttcccctttcatctttttttttgattcaggctctcaatggattgcaggatgcctacccacattggggagcaatctgcctactgattcccctgattcaaatgcaaattttattgggaaacactcttcagagagacatgcagaaataatgtttaatccgagcacctcatgtcccagtcaagttgacacataaaattaaccaacacatccaggatacacacggaacacactttccatccgtttgttcttccgtaaaaaaaaaaaaatagtttttttctaagaaaatacttgtggttttagtagcagaattaactaaactgcccagcagttactgttgtatgagcaattttcttcaggttttcaggttgaagaagctggtttaagattttacaacttctaatagaattgaagacattgaaatgctggtttgaggacttgcctgatttctatcagcagcaatgatattcatgcaaaattttctttgaaaatgagctcctaagcactttaaaaatgctttggggtgcacgttttcctgaattcatcctataaaatatgtatcatgtgcctatatgcacatgactgagctaaacttgattttaaaaatcctaaatgcaaaggtaggcagcctgctctacccaagagggttttttcctggcactttgcctttatcaaccacaaatatgctcattctttcctctttctgccttattgcagttcactttctgcctctttttgtttctaagtctccttgatatcttgccctcttttgttcctatgtattttattttattcaccttttttttgagataggcccttgctctgttgcccaggctgtagtacagaggcatgatcatagctcactgcagccttgaaatcctgggctcaagagatcctcctgccatggcctctgaaagtgctgagattatagatgtgagtcatggtgccgggcctttattttatccctgacttacctgccagagggtttgctcaggggccccatgtgttaaaatgtttcaccaaatttacctcagttgtgaagcctctgagaataccagagagatcactggaaccaaatagcctagaagttgaccttaatacatgcaagacactaaatccacgacagcaggggtcatacctaccctacttactatcctagctgcagcatcttgttcaatgcattgaaataatagatatacatttgctgaacaatgacttgtcaagaatgctaatacatgaaaaagccctttgtatcccatctagaatactgaagagttcttgcctggctgtactcctggggctggcaaagacttttctgtctaagcttccatgagctgtctgcccagtaaatttggactggtcccatcacctgggcatattcatggttaaaggttaatactcctagagaacgctttcccttccacctctttccttgacttacttttattaatccatcaagtcctagtttagacaatcaattttgatgaaatttaaatctaggatggtggcctgatctcaggtactactgtgtttttcctctctcagtgcttatcacactgactttggtttttaattgtgtaagaatacttaaaataagatctgcccattttacaaaaaatttaagtgcattatatagtattgttaacgttaggcccaatgttgtacattggatgtttagaacttattcattttgcataactgaaactttatacccatttagcaacaactcctgtgccccgctggcagtggcagccaccattgtactctctgcttttatgagtttgactactccagatagcccatattagcagaatcatgcaatagttgtccttctgtgatggcttatctcacttagtataatgccctctatgttcattcatgttgtttcagatggtagagtttcttctttttaaaagccaagtaataatccattgtatgtatatatcccattttctttcctcgttcattcgttgatgaacatttgggttgtttctatatcttggctattgtgaataatgcttcaaggaacatggcatacactatctctttgtgttcctgattccagtttttctggatatataaccaaaggtggaattgccagatcatatggtagatctattttctttaagaactttcatgctgttcttcacaggagctgtatcattttatattcccatcaacaatgtaaaagcattccaatttctacacatcctcaccaatacttatttatatatatatatatttatatatatatatatgttagtgacactattttatttttattattttttattatactttaagttctaggatacatgtgcagaacgtgcaggtttgttacataggtatacatgtgccctgatggtttgctgcacccatcaacccatcatctgcattagatattactcctaatgctatccctcccctaggcccccacccctcaacaggttccagtgtgtgatgttcacctccctgtgtcctcattgttcaattcccacttatgagtgagaatatgtggtgtttggtttcttgttcctgtgttagtttgctgagaatgatggtttccagcttcatccatgtccctgcaaaggacatgaactcatccttttttatggctccataatattccatggtgtatatgtgccacattttctttatccagtctatcattgatgggcatttgggttggttccaagtctttgctattgtgaatagtggtgcaataaacatacatgtgcatgtgttttatagtagaatgatttataatcctttgggtatatacccagtaatgggattgctgggttaaatggtatttctgtttctagatccttgaggaattgccacactgtcttccacagtggtcgaactaatttacactcctaccaacagtgtaaaagagatatttttaatagtagccatcctaaaacgtgtgaagttgtatctcatctccgttttgatttgcatttccctgatgattaatgagcagcttttcataaatctgttggccatttgtatgtcttctttggaaaaatgtcttcagtcctttgcccattttttaattaggttatttgggtttttttttttttttttttttttttttttttttgcaattgaggtgtaggagtttcaattgatttttctatttctcctttgactgttagctctatttgggaagaaagcttctctttcttgctcacctctatatttttagcatctagatactgcttggcaaaagccggggtagagacattgagtgaaagccattaattgaaatttttaaatggggactttggcttaacctggctagtcattcatgctgttatataaacttacttgaaaaaacaagtggaatcccagggcgtttgaccaagctggctgtactgtgagtgaggagtcagcaaggattaacgagcaagctacagaccgtggaattatggaaaatctgaaggacagtgttcagggatgaagcaaaaataaaatgccaaggagaaaatccaactgaaggatctgtctggagttgatgagcagaagtgggtgttatgcaatggggactgaaatgaaagacacagtgacattgtaaatgagtaggaaaggagggtaggctgaagtacccaaatgccttggaacctggtcgaggagttgttttgtggatcttctaatctggagcatagagtgaagggaaggaactgtttaaatgtgccagttcaaacaggatagatgttgtggttctcaatttcccaaaaaatgctctttaacatggagaaaaaaaatcaagattttctaaactaattctgactgtaaaccattgtcaatcttggataaatcttcattaatttaacattaatttaattgagaactagttggcatctgacaggtactttctcacctggaatagaccaaaacctagagatctgtaggaaagtagccctaagcctaactgccttattattattattattaagtttcatatgtgatttgaattaaaaaccagtattgagaactgctggcatggatgatctaatttaatctaattttagcatatgggcttgagatggtctcctaaaatgcagagaaaaaaatcaaataaataaagtaaagcaaaagcagactatagatatgaaaaaaatagaaaagaaatgtaagctacaaattatagtcattttctcaagagaggacagggcattagaacagaagcaatgatttgaagcatagttttagaaagttacaaaggaaagcccccttgaaagggcacgccatgtttcaagtgaaatgaatttaaagagaggcacctgggcacattcttgaaatatctaggaatttcaaaacataaaaaattctagtagaaaacaaaacaaaaaaaaaaaaaagaaggaaaagacacaaaggtataaacccgagctagcttcaggtttttatgatagaagaaaatgtaaaaatggccaagaattttgtgaaaaacagtttgttgttatctgcacccagtcaagatgttgtcctcatgtggaagaaaggttaaaaaaaatatttaaaatcttatgtagaaaaaattatcttgacaacctgctgaaaaattgtataaacatattcgccatctgactagattttaggagtcattagattttcatctcacagcatataccaaaagtatcttaagtaaattaaactatatgtgtgtgtctctatttataatttacttcatgtatatatatgctaacagaacaatgaaaatatacataaatatttcaaggtaatgcatgaatcaaaaaggaaagtattcataacactgactctttaaacatctgtttacaacagaaatcatcataaacaaaatgttttaaaaaccaacaaaataagaatgtatatattatacactcaacatgtatatattatattttctctgtgtatgtgtatgtatatgcatacctatatacacatatataaacacaatacacacacatatatacatccaaactataatgatgtaacaaatatgaaacatatggaaccttgatgtgggcaaatgacatgaagaggaattacaaatctaaaagtaagtatattgataaatatttgttgagtaaatgtttaaaccccaaatttaaatgtatacatatatatatatttactcataatgaacaatttaataataaacaaaggcaaattaaataaacgacctaatgcaatttgtcacctattaaattatcaaagattcaaacagccatccatatggtatttctcatgttggtaactgtgagtagatgaacatcttcacagtaccacacttactgctgctgaatgtaaataacactatcaaactggcaatatgtattaagaacctttaaaatatttatttcttttgactcagtatttccccttcttgactctgttcttagaaacgtatcaggatactgatcaaaatgcatgaaaaatggtgtctacttcagtgtcatttgtagtacaaaaaaatttagaaatggataaaatatctagctattggttaggagaaaatatttttgttacagccataaaaacatttaaaaacaatttttcatgatgtgaggaatagtttattatataattataactaaatcactgaatgtgaaattattagtatgattgcagttttgtaaaggaaaatagattatgtttttaggagattggaaagaattaaccaaacatagtgctattattctctaaatggtgagatattaggtaatttatatgttattctttatgccctttacatataaaattctaagtgtatgttcaaaaaattataaaatagcagggaagtattattcagtaaacaatgcgctgataaatagcaatttaaaagcaattcagattagatccttatctcgtacacaagcatacatttgcttattgctttagtacaatattttctatgtctgtctgaatgccagcactgcaacattttgtagcttgattattttgcatttcaattactacaatctctacaatgttttaggagaaaaataacagaatggctagtttaatctattatacaaatctaagtacacatttatagaaaaatcaactatttcatttatagttggatctttaattttctcatgaaaaaaggaactaggctaaggcataggttcttcactttttgctgtaatgacattaaaagtcaatttgagagaatgcgtgctagtcttttactgttggcaatatacagcaattgcattaccttagaacactgttctttgcagaatgcatgctcattggagagttaatgaatgttaaattaacatcttaatgaaaattgtatattaatactgctcttgttcctaaatagtcatttaattctgataaatcaaggaattcaatttttgctaaataaaaatcaccgtcttggaaagcatgatgctgcaactgaacatttgctgtatttctgaaattcagagctactattaaagagaaaatacattcagtttgaggactgtatggtttggaaattttgcttactgtcctatagaagaaatcaaacggtgttttcagtgttctaaaatgagtcattagatactccaatttagttatagatatgaaaatggtatactgtattgctcacatgatagaactttaacaatatttctatcataaatttaataaaaggtttagcccaacaataaaaacatgacagtaagattcttaatgcacagtataatagtaagaagataatttttaattaaaattttaatcaaaatgaatttaaatatttcagtgcaattgaaaattaagtatgagttttttgttgtttttgtttttgttttttttttagattcgggggttacatgtgtaggtttgttacatgtgtaggtttgttacatgaacatattgcataatggtgagatttggacttccacagtacccatcatccaaatagtgaacattgtaacaaaaggcaatttttcagccctcatccctctgctaccctaccctcttttggagtctccagtgtatattatttccatctttatgtccatgtgtgcccattgcttagctcctacatgtaagtgaaaacatggagtatatgatttactgtttcttcgttatttcacttaagataacagcctccagctccatccatgttgcacaaaagacatgattttattcttttttatggctgcataatattccatggtatatacatccctcattttctttattcaggtatcacttgatgaacacttaggttgactccatgactttgctcttgtgaacagtgctctgataaacatacaattgcaggtatcctttttatatgatttattttcctttgggtaaatacccaggagtgagattgctgggtcaaatggtagttctagttttagttcttcgagcaatcgctacactgtttttcatagaggttatactaatttacattcccaccaacagtgtataagcattccattttgcatgcatcctcaccaacatctgtagattttttaccttaataatagccattctgactagtgtaaaatggtatgttattgtggttttaatttgcatttctgtgatgattagtaatgttgagcatttttgtatatttgttggccacttgtacatcttcttttgaggaatgtctgttcatgtcccttgttcactctttagtagagttatttgatttttcttgatgagttgtttgagttccttgtagattctgaatattatttctttgtcagatgtataatatgcaaatattttctcccattctgtaggttgtcttcttattctgttgtttatttctttggctgtccagaaactttttagtttagtagtctcatttgtctatttttgttttttgttgcatttgcttttgagagcctagtcaaaaattatttgcctaggccaatgtctagaagactttttcctgggttttcttgtagcattttcatagcttcaggtcctacatttaagtatttaatccatcttgagttagtttttgtatattgtgagagataaggacccaaattcattctccttatggctagccaattttcccagcaccatttattgaatagggcatcctttgcccattgtttatttttgtcaaccatcattgtatgtggctttacttatgggttgtctattgtgttccattaacctctgtgtctatttttgttaactatttaaaaaaaatacatattagaggctgggagtggtggctcacgcctgtaatcccagcactttgggaggccgaggtgggcggatcacaaggtcaggagagcgagaccatcttggccaacatggtgaaaccctgtctctactaaaatacaaaaaattagccaggtatggtggtgcgtgcctgtaatcccagctacttgggaggctgaggcaagggaattgcttgaacccgggagatggaagttgcagtgagctgggattgcaccactgcactccaacctggtgacagaacaagactctgtcttaaaaaaaaaatacatattagagagttaacttttaaaactacaatatatgttagtaaacataaaataatccagcatgaaatgagcaaataatatttacaataaaatttaaatatttgcatgcaatatttgattttgaattataacttaaatataatttaacagggtgttgataaagttttagttttcttaataccttcaattctcattcttctattcatttttttccttccctcaatctcccaggaacccttttgtcttaattagttccatcatattttgaccactagaattaatcatccaacaagaatgaattgtctgtcgttcttcagtcttttctttaatatcagcatttaattaatcaccaggttctacaggaaactcctctttccctgatctcccagcttcacttatctccaaccacactcccgctgtcctagtgaagaaccctataaattcttatccaattattttctctttgtaacttgttcaaacttggtaactttgtaactagccttacagcaagccctgctcccatccattcaccgcgtgctaacgaagggctctggctagaaaacaactctgctagtatcaccaccttgtgtccatcttttgatggcttcccattcaaggtccctgttgaatagccttccaagtggtagagataaagagcaaattccataacaggatttgtttttaatttccaacttttatgttaagcttaggggtacatgtgcaggatgtgcaggtttgttacataggtaaacacgtgccacagtagtttgctgcacagatcatcccatcacctaggtattaagcccaacatccattagctattcttcctgatgctctccctccccctaccctccaacaggccccaatgtgtgttattccccccatgtgtccatgtgtttttatcactcagctcctacttataagtgagaacatatggaatttggttttctgttcctgcattagttttctggggataatggcttccggctccagccatgtccctgcaaaggccatgatctcattccttcttgtggctgcataatattccatggtgtatatgtacggcatttttttatccagtctgtcattgatgggcatttaggtttattccatgtctttgctattgtgaatagtgctggaatgaacatatgtgtccatgtatctttataatagaaagagttatattcctttgagtaatatactcatgtattagtcagggttctcttagagggtcagaaccaatagaatatatataggggagtttattaagtattaacatacacgatcacaaggtcgcaaaataggctgtctgcaagctgcagagcaaggagaaccagtctgagtcccaaaactgaagaacttggagtctgatggattgagggcaagaagtatccagcatgggagaaagatgtaggctgggaggctgggctgggctgggctgcgctgggctgggctgggctgggctgggctgggctgggctgggctcggctcggctcggctcggctcgtctcgtctcgtctcgtctcgtctcgtctcgtctcgtctcgtctcgtctcgtctcttcatgtttttctgcctgctttatattcactggtggctgattagattgtgcccaccagattaagggtggatgtgccttccccagcccactgactcaaatgttaatctcttttggcaacagacacactcaggattaataccttgtatccctcaatccaatcaagttgacactgagtattaaccatcacaagtcagtaattggattgctgggttgaatgatatttctgcctctaggtctttcaggaattggcacactgtcttcctcaatggtcataacaagacttttgaagccctgtgaattctgattcattcttgaaattcaccccttttttgaccacttctgctaaccactttgctttccacctctactaaacacattcctcaagacttgacatgttttcacttatctcaagatttttgtttttacttagtaaggtgtaagtaattgacacacattttttaaaatgactgaacatataaaaatgttaagcccccgacctacagtaactttccattgccacttctcagcactttacctcactgagtcctattatgtccacttatgtttatgcttaagaagttcactccttcatgacttcttttccaaaggctttcttaattcctggtgctgtttcttctgggtaggagcaatattgctctatctatactgactacatttgtatcattatccatttacttatttgtctttcctgcattccttcattacaagtatttattaatacttgtatcttcaatgccagtcacatgcttgatagtattaggcacccagtaagtgtctgttgaataatgagataaatgaaaattctggtgtagagatttataaaatactctattaaaatcatccttgaccaccatgagtcagctcacatactacctcctacaatagaacttttctgattctttaccattgtcaactggatatgacctttctgaccttgcagcccctgcagtacttcagttatcctctcttaaaactcataatgctctaaaatttttatagaaccacaaatgacttcaaatagccaaagcaattttgagcaaagagaacagagctggaggcatcacacttccttgacttcaaaatatactacaaagttattgtagccaaagcataaaaacagacatagaccaatggaacacaagacagcccagaaataaacccacacacttacagccaactgatttttgacaaaggcaccaagaacattgaatagaaaaagaacagcctcttcatcagagttctaattttttttccctagacttacaaaaggtactcaagatcagtaagtacagaaaaaccaacaacatatgtattccttaaggaaagaggcttgtttttatccgccctgactgcttcttctgaagcaaaccaggtgacatgagtacatgtgatgttaagtaaatgatagcattataattttatcaattgacctataaaataagtatccccaatttgcattcttacagggagcatcaagccagatttcatgttatacttgaatgaaaattcaataatcagtgtctaactttgcatgtctctaatgtatatttacacttccttttatagttaataagaggattcatgcttcatatgtcatttaaacctcctaaaaattctatgaattagcacagctttaaaacactgatagaaagaatggagttcacatacacacttcacagagaagagaatctggattttggctggttgtttcagaagacaattaccaagatgttttatagcaggggtccccaacctccagtctcaggttggtaccaatctgtgggctgttaggaactgggctgcacagcaggaggtgagtggcagtggtgagcaagcattaccacctgagctggcctccagcagatcagcagggtcattaaattatcataggaatgcaaaccctgttgtaaacttcatatgcaagggatctagggtgcatgctccttatgagaatctgatgcctggtgatctgaggtggaacagtttcatctgaaaacctccatggaaaaattgtcttccatgaaactggtccctggtgccaaaagtttgaggaccattgttttagaggacaaagtgtgagagaaaaatgaccaggatggtgagcaaactcattaggaatggttgaagcttgtgtgcaataaatacttgctaaacaggattaaatggaataatgtaatgtttaaataaaaaaaaaaaacaagaaatggggggatcaatttgcataaaattcagacacaaaatgatgctgaggatgcctaagtttacatattttttgcatatggtatattaaggttttatgtttttgtccatcacaagggcctgctagctggaaaaattagatttaggtaggttgaactttttccttaacagtgcatatttccaagaactccaaagagaaaagagagagagtgtataagcaaacaaggcacttgtgataattatttccttaaaaaaagattcagggatcaacacttttttcttttatttttcaaaaagagatgatcagcattcagaatattttgaaaataaaacaatgcaaaactcagcaagtgtgttttatccagttcaatgtctgtaaatcttttattaaaacttcttctgcctcagacagaagaatcttctacattatgtcaggatttcaagagcaacattggaaagatatgttgctttcaagtgatttttttctccctagttaatgtttatagggaaggctttcagaacaaatataggaaaaaaatcaatcaccaaaggatgagttgtgctctggccccaaggcaggagttgctgataactccccatgacccccaacccaaggtttgaattcctccaactttccttctctactttctcttttgtgacacctgagatagttggtcacaatgttggtgaccaagaaaaaattaactgccctaaaccacttggaaattgaaactacaaactaattttcatgaacaccatttcagggaggaacatacttatgtagtctcctaattgcagagtttttaatattgtacccactaaagattttcttttctgtctgcctgcctgcctgcctgcctttctttctttttctttctttctttctttctttctttctttctttctttctttctttctttctttctttctttcttccttccttccttccttccttccttccttccttccttcctttctttctttcttttttttttctctctctctctttctttccttctttctttctttctttctttctttcaagatgaagtctcactctgtcacccagcctggagttcagtggcatgatctcagctcactgcaaccttcacctcccaggttcaagcaattctcctgcctcaacctgctgagtagctgtgattactggcacatgccaccatgcccagctaattgtttgtatttttagtagagatgaggtttcactatgttggccaggatggtcttgatctcctgacctcatgatctgcctgcctcagcctcccaaagtgctgggattacaagtgtgagccactgtgcccggccagagtttcatttttttaagtaagctctagtgatatccagttgagaggttgccagggctccctggcccagagcctagaaccagactgtaatgaggtaggagggttttactatggctcaggaaagagacttgttaggaagctggtggaggtggacagaggaggaggctgtggaaaaggagacaaaggggcctctgagggaatcctggagagggaaagaggcctaggagttcagaaaggcttctgagaggtaggtggtcttttgaacatttaccttattccaactcgagttctaagtcttttgagctttgcctgtcattaagttttgtaagcatagaattgcattttcttaaatgtaggcagtctgtcaccttaaaaatttctagccttgtttgtagaaaagggtgaagaacagctgcccaagtgagccacctaattttctctgtgaggacagtccactaaatggccatgttcaaaggaatctcacaattcacagctattgctgcataatgatttatgagccaaatcactcacccattagaagaatgagtcttcaatggtcagatcaaacataatttattatctctaacgtctggtagtcttatgtttttctaacactttgcagcttttatcagggtatgtattcctgcctgtggccacagcactgaagaaaatggcagttccttttcagttttgtccaataatcctccacgttcctgcatttcatcagtgttttcagtgttccaagactgtgtccagatacacagtagagttagctttgccttcccttatggatacacataaatacctcccttatggatatagatacataaagtaagcatttggctattttctgtaattagaaaagatttaagaaagcccattttgccaaaaatatatcatgcaagggtgcttggggattcttttgagctcatcatttaaagaaatacaaattatgcttaatgaatgaacataataatctcctaatactttagctgagatttattttatcatataggtttcaaatcagcaaacattatcggttgcattttatatttgagatacaaagttatttatgttgtgggacctgaaactaagtaaacagttatccttgaaactggggaccttttagactacgagaatgagtttctcaaagtctgtcttttatagtgcctagaatagtagaactgataaatagtgtttactgaataaatacactactaaattattccagtggatttcccatgcacacaaatatctatgatcaatacagtacattaggaacaccatgagaatactacaaatattttggcaatgaggagagacaaagaggatttgtaaaggcttcataaaggatgtttcatttagcttgattgttggatagaattgaggaggcttgtgtgaaaaggttgtgggaatttctactggggtcaagagtaccaaaaaagaatagataatttttttaagggtaatcctgtttgggaaatcagctagtgcctgtagtaaagcaggacagggagtgaaaaacaaggattgcaaccatgaatggaatcctgggagtgccttgtaaaggaacatagacattattcctaaaataagcaatcaggagctcctgaaggcttttcagcaagagtatgactatcacagtaaccaaatgagatcattgggtaccagagaagaaaacacaaaatgatttgggggcaaaagacaggtctttcttccagcatggtggacaaaattggcctagagctctgtgaatccaagaagaatgttgtgtgacttgttctttgaatactaagtgtctacataagaagatattcttgtgccaaatatactttttcaccaaaatataatgccctctcctttttggtcctctggtatttgaattaactaatacctttggtaaatgtgttctgatatatagtatcctggtgaatagtatggggcttccttggtgtaggggcttccttggtttaaggtgaacacccttcagctgatggtttgaaggaatgtggaagatgtgaggcctgctctgggaaagacatgccccagcggagaaggagaaaaaacccacagcttttattatgtgagaaaagaagtcagtcaaaggaggtattcttcaaacacaaagccaaagcactgcaaaagaatctatgattatttcttaaataactttttgttaatgctactccctaggtgtcctaaaatctcagctaaatgttttgaaatctggccatgttttcaaagagcagaaacacccacagagttgattctcactcttacaagttctaagtgatgcctagggcttaagatgcaccattcttacagagttacaatagtagtcacatgatctctcttaatttcccatgatgaagacttagaaagtgtttcttttataaaccagagggtaaatacaaaatgtcccctttaaaggaggctgctaagaggtacaaatgattggactcagtgttttggaacttgctctatttttttccagatggataattgttaaagggttattacaagtagttacatgaaaaggcaattatgaggaggctatgaacaaatctgccttcattttgatttgaatattggagcagtcgtagtatttgttgtgtgttcctggtaatggaattcaaccttttatcttttgttaaaatgttctgcaataatatgtgattatgcagatgcataggaataaaacatgtattacagagtccatcactctgcaatcgtttttgtattatagcaaatttcaagtctttcttactttatgtagctacaataagaatgtatctttggatttgcataagatatgtatatgagtgctttttatttattaaagccattcaaagaggaaccaaacacaggaatatcaagatttcttttgaataagtaaaaacttggggaaaaatggcaaataatctggcacttttttatattctacataattttatctaaatgttgtcaattcaattaacataatttttaaaaacttgcataattgcaatacatattttccagatttgtgaactattttcaataaaatcaatttatataggctactttctaagaatactgcaaagaatatcacctccataccgtgaagaaatcagtaaaataatttgtggaagtgatgcttaatttcattgtatacataacatctaatttagttccaaaatattctctgagtaggacaaactcttgtcaattttgttaattatttttgttctcacagtatttaaaatatgctttaaaatttttgcaaaagagagatgttttcaactattttaagattaaatgcagaaagcagagattgcaattatgaagcttatttgcatgcttcagaatgttgaatatatattagttattaatatttatctcatttcaatgatataggcttgaaatagtaaaagaatgcctgctttatgaatgaagaaaacagaggataacttagcttagctcctgataagaccctttgctttaatagtcacatgacacaaaaatgcatcaggaccaagatgtcaatgtctatgctaagaagttaatgtccagacagaagacacttagctaactaaaaattagccgggcttgatggtgggcacctataatcccagccactcaggaggctgaggcacaagaatggtttgaatccaggaggtggagtttgcagggagccaagatcgtgccactgcactccagcctgggtgacagagtgagactctgtatccaaaaaaagaaaaaagaaaaaaattaaaaagaaaaagatggcacttggccaaaaaatgtctgttgaaggactgcagtgagcattgtggaactgcaatgagctaaactaagtggatgcttatttcaaaaagcgaaactgacagagagagaaaaacaaaacaaaacaaaacaaaacatgtaaataccacagagcttcagaggtgggagatgtcaccacaaattgcagtaggcagggcacaattaagctagaccttttaaggtgggtgaaatttggattacaggaggaaagaggtaagggcatctaagtgagtgaatgatagctgggggttgctaggcgtgtacatgggacagtttgtacatgcaggaactccagaagagggggagagctgggtgagaaggcgtgggaatcaagttcatttcatggactcctcaatctcttttgctctagtttccccccacccggtgcccctgttgtttatttctctctctcgctctctgtctctctctccccctatctctttctctcttcccttcctctctcctttttcctatctctatccctatccataagtttatctttagctctagctcttacttagaatccaatcagcctccaaagccaagacaattcctttgtttaaagtttcactctttcataaacaaaattcattttttctgctctaaacattttttctcattattttctcttctagcacactgttctcgccatctaatattgtcagtgttttactttaaagagtcagcaccgatgatactgaaattcttacttatttaattttatcattccatataatttattaaaaattattctgcattgtggttttgcacacattgctggaattttcttctgatcaaccaatgagtcttgggtctgttgaaaatattatttgtacatctttttattttccaatagatgaggaagagaagaaagaggaggaggaaggcagagagagagagagagagagcacaaagggtaaaatcattaatgttatatcaagcaatttaaaagtattttagactctctgccagaagattgtgaaaacatagtgcaaggtttattattattatttaagtaacacagtcatgttattggcctagagctatcttaaaatttattttaagcccattatttgtggttattaccgggtaccaccagtacagtgaaaagaatattagaataggcataaaaatggattctaattcttcattcatcactatgtgattttagtaatataaatttatctctcagagtcttgagtaataccatcattaaaagagaaaagaaattatggcattcttacattagataatctaaaaatttcattccagcctccaaattatgtaacagaatttttgttccccttcctctaaagcaaatgcaatttgcaaataatttatattaggaattctatccttccagttgttattatagaacataattattcctcatacattttatgttaatgattttagtgcatgaatggttttattcaagactcattatgccaataattttaaattataatatgtagagacaaagaaaaaaaattaacaggcaaaagatgaaagctatcagtctgtcaagtctagacaccagaacaattgtaaacactttgatttttttttcttccagagaaaatgaattgttagttaaaaatcttgactaaagaataaaatagtctaataattacttactaattacttacttacttactaataattgatttgtacattttatcttaatgttcttgagtgtaaagttctccagaggcagggcacggtggtttacgtatgtaatcccagcactttgggaagctgaagtgaaagggttccttgagcccatgagctcgagaccagcctggtcaatatagtgatacccccatctctacaaataataaattaataaaaattagttgggcatgttggggcaaacctgtagtcccagctactcaggaggctgaggtgggagaacagccaaggagattgaggctgcagttagccatgattgcacccctgcactccagcctaggcaacagagtgagactcttgtcttcaaaaagataaatacaatacaatacaatacaataaaatacaataaagtttcccagcaagtttggtgtgtgattgtttgcatagtgaattctgtaatatgagtgtgtgctcaggaaagggttaatttgttcatcttgggttaactctgggttgctcaaaccctgcagactcctaagaaaggcctgtctgcctttggaatgccccttggtagctcctgggagatgagctaaacccttggaatattctgcctgacaagagtgtttctattggcctaaggccttgggccacccagcaccggttagatcaaatagtttaggctaacagtatgatctatggtgaaaactgattttgcttttgaggggttagagactgagtagctgaggtcacctgactgactcccaattaaaaaccctggacatcaagatttgagcgagttcccctggcttacagactttggcaaatgtttttacacatttcaagaattaagactatccatgcaactgccttgggggaagacacctggaaccttgctcctggtttcccctggacttgacttcttacactttttccctttgatgttttaatctgtatccatttgttacaatatattgtaactgtgaatgttaacagttgttcaagtctcatgagtgattctagtgaatagttgagactgagggtgaattgtgcctgcctcaccccaaagtatggttcaagacagtcttttaattaataatatcacttaagaaagctttcctaaataattaaattaataatatcacttcagaaagctttcctaaaatgcttctaaagtcaagcaagattttttaattaaaagcttaatagttaactttaaattacattaagagaaaaaaatttactgaaaacatactatctttaggctatctgagatttttaagtatctattaccaagttttcaactttcagtgattccagatcatttggattcaagattaaagtgattatattttttctctttgattcattattataatatccatttgataaagaaccccaaaagaaatatcattatgtaccttcaaatcatatttatttggaagactcattaaaaaccagaagctatgttgtactttaaatatattatctttagtttttaattttcagcataatcaggtgatataatattaatgttgctttatatgtgagaaaaattgggcttagaaagttaaagagattactccaggcatactactggatgtggcatagagagtatttggattagggtctattaggaattaagttcatgcttgttctattgtgttactccatatattcacccttaatgacatgttacttattctgcctctggtagtagagagagtaagctgcttgtacatcaattttgcttcttccagctgggcgtgatagctcactcctgtaaacccagcattttgggaagccaaggcgggcggatcacctgaggtcaggatttcaaggccagcctggccaacatggtgaaaccctgtctctactaaaaatacaaaaatacaaaaattagccgggtgtggtggttgatgcctgtagtcccagctacttgtgaagctgaggcaggagaatcacttgaacctgggaggctgaggttgcagtaagccgagatcacgctactgcactccagcctgggtgacagagtgagactctgtctcaaaacaaaacaaaaactttgcttcttccttaaatatttaatggaaatcaacagagaagttatatagagctagaggttacgcccggctaattttttgtatttttagtagagtcggggtttcaccgtgttagtcaggatggtctcaatctcttgacctcctaatccgcccgcctcggcctcctaaagtgttggaattacaggcgtgagcgaccgcgtccagctgagaatgttttttattgcaaattcatttttattaacagatattgtaattgtaaccattaaattcttcctgagtccatttttctattgtgtctaccaaggaattttaaaatttcttttaaactgtcaacattattggcataacatttttataataatttctgttccttttaatgtgtatggaatcaatagtgatttttaattcattgctattattgatcatttatatctgctctctgtctctctctttcagtatatctagaggtttataaatgctgctaataatttcaaataatgacttttggtttctttgatttgctttaacttctattacatactctctttttttacatacttttgatttagtttgatattaatttgctaggttactaaagttgaaacacattaattttaaatatttttatttatctttcatatgcatttagagatataaaaattttttaaccactgttttaactgtatcccataaatttgaatagactgtgttttagttattattcagttaaaaaattttctatttacctttgacatttgttctctaactgtgaattatttataagtgtgttgcttaattcaaaatatttggtgatttttccagattgtgttattattgatttttatgtttaattctgttgtggtgagagaacattatttgtatcacttaatcctttgagttttagtgagcttgtggcccaagcttttacttatataaaaacaccatttttttgccatcatttaaaaataatattatactgactatagaaatgtaggttgatgggttttatttattgatttttttttcatcacttgccttcttgcttgcatcatttttctatgacaagggcgtgataattcttatttattattgttcaccagtgtgtaatttatctggctgcctttgagattttctcttttactttggttttcagaaatgtggtgggactaggtgtggttttctttgtatttatcctgctaggattttattgaacttcttggatgtgtgggttgatttcttttggtcaaaattgacaagtttcatcattattcattcaaatacttttttcattctaattgctctcatcttcttggacttcaattatgtgcacatttctgccaccctgaactatgaattttatttcttccacccaccaagaccccagctctctggtgtgtctagtgctgtgatttggataatgatccctggtggaaagctgaggttaatgcagagatcattttgtgcagctcccctatcccagtgatcatagccctgagttatccattgttccatccttgaaaatagctactgtagatatttgtcaagttttagtgttatttaagggagaacttaacacatgatgactatgattctttcataactattgctctgattagtatcattctgtttggaatctcagtgtttctagtttgctaatataacctagttgtaaggggcacaactggattaatagttgaatcccttaatatacacagaacgctatgggcccagaattgtataatttttcttacctgaacacatgcacattttctacataatggattgtatcccctttctcttatttttactcattacttcgtttacatttagtttgtttgaaagcaagttctcattctctcactcaggcaggagtgcagtggcatgatcgtggctcactgcagcctcaaactcgtgagctcaagcaatcctcccacctcagcctccctagtagctgggactaatgacactaacaccacctagcccaggtaatttttttttctttcattttttgtagagatagggtcggactatgctgctgaggcgggtcttgaactcctggcctcaagggaagtctccagccttggcctcccagagtgctgggatcatagacatgagccaccacacccaagtagcattttttatgtcttcattttttaataccaacctcacccatcctttcttttcttgcctttggaagacaactttatactaagaaagctacttttttgtttataggtaacttactgtctagttaagaactgactcaaatttcaaaataatgctcaaaaatttaaaacatacaagaacaaaaacatttggaagaattattttctcattagcactgcttttctaccttcttcttgatggtaatttgttttgagcctaacttttgtgattgctaatttcattataaaccaaattctccagctcttttatgactggtgtaacaggaagtaaactaaccagagactcagggaccaggattccaaccacagctctgctcctgactagttgtaagattttggtacattacttagcacatttgatcacagcattctaacccttagtaagcaagatgctttctgatgtcctttcaactctaagttctatctttaaggatacaatttgaaatgtttctcttttcccactgagcgaactcagactcctaaagaaattgtaattaaaaatggccttttgctatgtttgacaaaggacaaaatgtgataataagtattaaagcaatttgaaatagttttagcaatgtaatttagattataattatcatttctggaggctatattcattttttatgttccttgtggtacattatatgtaatagatattgaatactttcttaattttatgattaatatacttctggaaaaggagaatgacagttgaaatcacttaatgtgatgaaataaatatggctttattcttttcaaattgtggtgttttctgtgattcactacttctttcatctattaatctgtgctctaagtggcttgatcccatcttggcacacatcaccatggattcttaaactataagaagctgcattcatgcatgtgtacatttggcaaccttgtgttgaacagagctctgcatttgatgctgtggataaataaactgttatgatactgtatctgcactaaaggagctcaaattccagtggaggaggttgacagggcagtcaataattctaaatccagatgagcagtgcacaggctgcttgggaatcataaacaagaaatcaaatttaggaaatttgaatgggtctttcaagagtggagtggataatactgtcagcactggtgcctttgtgtacctttaacaggccacactctttcctgtctgtctttgcacacacagcaccttctgactagaatgttctttccctgtattttcacttcccattatctaatatttagctgaaatatcattctattaaggccttcattgtccaccttctccacaattgtatcacccttacaatttaatttccctaatattttactttgtagccccacttactattatccacaactaacttatttatttgtgtcattgtttattgtatgtctgaccagatggtaggaacctgtttgggtcactgcttcatatccgtataatctggaatgcccctggctcatagcagccactcaaaaaatatttgttgaatgaaagaaaagatgaaggaaggaaggcattagaaaattacagaatgaatgtctctccttccagccctccacaccccaccaaaaaaaaaaagggtggaaaattagtacaaaaaattactctcaattattaattcagaaaatatttattgagtcaaatgctattctaggccagagtgcctgatgtgtaaaaaataacattctcccttattaagaaaaatattatttatttctttctacagatggtcagaaaactagaactagaaaaaatgtaataaaaaaaggatgtaaaatgttaggtctcattatgaatcatttcaaacttaagtatgtgtacatatagtagtgacttagagcattaccagcagcatattctgttctaatagactggataactgagaagaaataacatttaacaccctcattccagaaatattgcataatccctgtctcttgatttggggctcagccatatcacttgccaaggccagtgaaataatagcaaaccccctgcaagaagagaggtacagtattttgtacagttggtcttgtctcttgcgcttctgccatcaccacaaatagagcttccctgaaatagatgctgctctctcagccccaggccatgtccacaaggaatttataaggaccagacttgagcccaatgcatagcaagtccagcttgaagcagagcatcccagcagaacccagcctaaatcagccgaacccctgccatctgcagatgtgtgaatgagcataaatgattgtagttttaaactgccaatttttgtggtggtttgttataattaaagaatgaaaaatcagccagatacaagcccccaacccctgttgaagtcctgagttaagaatgtcaaatacatatgtgctttgtttttatgctgttgggtatgtggaagttatttaggaaaacatcgggtagtcctgtgagctagcaaggcacaagaagcagggttttatgggcatacttctgcaagaaacaaagcaagttttgctctcattagtcatattcaccttgcaaattaaaaccaatgtcccatgttataaaagaactttggattggcctgtggtgtttatctcctgtgttaactcatgtatccttagaaaaagagtggaagaaaatgataatacctcatatttattaaacacttgctacgacaggtatagttccaggagctcatcattgacgtcagactctgtaaaatatgtgataaatatattattctcattttacagatcaggaaagtaaggagtagaccacttaagtaatttgcccaaggtcacagaactggacagtgacatagctgaaatttcacctttacaggcttccaggatccacatgcttcaccacaatgcagaagtaaagtatctctggcctactactcatgtataactcacgtatgatagataatacagaaacagttggcttctcaatactatttcctttaaaaattataagtacttccaaactgatttcaaatactgcagttttggcaattcatggttttgtaattgcagatgttctgtgtctgtctatttgcctgagtcttatggaaatgggcttgggcctctatctgtggaatacagcagacagcagaacatcaaagatcagcacacaggtgatgaaaacccaggggtgctggctctgaaaagcatgtgggaaatatatgagaagactcatagtcacacatctgatccaggaatgctggcttaacaatgttattactattagtaataatatgaagacaccagtttactaacaaagataggcaatggcaaccttgaagttatcttttaaaaaagaaaggaaaatatcatccaaagccattatcttcctttatagcataggtatggttgttttgtaatctacatacatatatattaaagagagcagctgtgcataattgaatgttctttgtgctggattctaaaattataatgaatgcttcattacatgagtaatgcaaaaagaggcttttaagattcacttctgtgaattttaatctatgtatatgatatggcttggctctgtgtccccacccaaatctcgcctggtattgtaatccccatgtgttgagggagggacctggtgggaggtgattgaatcatggagacgatttcccccatgctgttcttgtgatagtgacagagttcccatgacatatgatggttttaaaagtggcagtttcccccatgtgctctctgtctctctcttgctgccatgtaagacatgcattgcttcttcttcaccttccaccatgatggtaagttttctgaggcctctccagccatgtggaactgtgagtcaattaaacctcttttgtttataaattacccagcctcaggtagtgtctttataggagtgtaagaatgaactaaaacagaatatattggaaattttagcttcatccagtctgctttttagctagtgatggataagtccttgaaatcaaatgaaatataaaatgcacaaattctagttccaagcacctcacccaatgagagcaaatttaatagttcatgacattcccttcagatcactcttctttcctcctttcatacaatcttagaattttaaaaatggaggagactttaatgtcatctagacaaatttctattggattcttgaatttcctttgatggaggcatgtaccatttctggagtataccctacctcacagctgatacacttactggctatatcaaactgaacacatttcaggccaaactcttgacttctcctttcttgattttctccatctctgttaacatcactgctatccacctgttgcttgagtcagaaataatcactctcaccctttcccgttaatttttcacatctactccatcaccaagttatgctgagtgtaactccaaacaaagctgcacttctccttgtgtctactgtctcagagtgacaaacaccgtaacctgtagtctagactgatttgctagcttccaactaatttatctggttttgcttccacacacttttcttctgttttcctcacagagtattttttatttattaacatgaattagatctcttcctttcttctcaacctttcattagattcatattgtgctcaggaagaactataatctttgaccctgaaagctatgctattcttatctctttgcatagtatttctgcatggtgacctccgttgattgcactatattctattttcattcatacttcaggttgttgtaagagttgtgatacagtacatgtaaatcacttagaatagtgcctagcacataggtatatagttagacatttttattaggtttctcctgctgtttatttatttcatgttcgctcctctgctagaatttgagaacaggagctgtgtctattttgctcaatagttcatagcttaatagctcttagtacgcctggaaaattggatatgcatatttcatatttttaatacgttgaatgaaatctatatttaatgagttctagcctataggaagttatttttttgcatggagttgaaacttagcttctatccaaatgttgagcttcccacacctttagaacattcaaactaagttatactgtcattgtaattaaaaacagtgatatctatatctgtcctgctatcacaactgaatcaacattaaattcatcaacatctcttttaaaaatattcaatttaaagtactttaaacactaaaaatttataaatcctagttatttataaaagtcattactgacacctaaatatgtaactattttaaatttcctccaaatttccaaagctgtctattctaagaaaactcgatacatataaaaatacaaaatggaaaggagctaaatgaggaggtacttttaaatttatgaaatgatattttatttttaaagaatttcacatttaaatagcatgtgactttaaaaaacctatctacttgcttattttatcagaaagttaattgattagattagattggatttagatagattgctaaaatgtcaggattatctctataaactaaatcaagtacttgtgttttattaatacagtaactgcaagttcttaaatgaatcacaggaatctttgcaagaatgagttatttagattttgccatgtgtcagtggaaaaatacactttcagttaaattacaaatgtggcaactgaaagggcttcatgtttagatataaggaaataagtgaacaattggaaagcgtagttgttaacaagtttttgctgcaaggaacttgaagatccacttttaaaaacctggttcaactgacattgatgacctccacaagttacaaaagaaccacggtgataaaaagttctggaagaatgtgctgcttctgaaaaatgtcttaaaactgacagcctcttgtatagatttttatgaaatagtaaacaacctcaagtgaaaataatgttaaatggcaggcatattatccctctaggggaaaatataatgaaaataaaatgttttagaagtgtataaacattaagcaagatggcaagatgaacaatgattctttatttttgattagtgtggacaggcaattcaatcatttgactcagggagaaaaaagaatacagcttcaaagtttttgtggcagattattgctcgaataatctgtagagtgctgcttcagttttgattatgaagctattggccattggccaagaggagtttctttgtaacggaaagaggagttttctgtaataagtagggtttagagactcttcccataattttggcttggagttgtgatgaaatcagtctggggcaaccttcctgtcttattctactgataacttttcaccttatataagaggtcagggtcctagataagtccttctctgggaccttttactttcctttttcgtattgcatttaatcatttaagcatgaaattatttcaccacatttaggagggtcttaaggtacagatataaagtttcatttcttaaactaattcagcttgtgtactatttatggctgtttgtattggcttcagttttctcactccttcgtttatctcctatacttccaccaaagctatctctaaaagagattttatgttggcctttttcatcaaaatattcaatctccaatgaatttagcattccccaacaggatgtgccagtcccttgaaaatattgacccaactcatgtttacaacataaatttagcctctcagctttacaatgggttgttataagggaaagaaagagggaagggagtcagagaggaaagtgtggtaatagaagaagaggtcagagttttacagcttctggttttgaaaagggaaaagggccacaagccaaggaatgcagacagccagtggaatttggaaatgatgagggggagattgccttctaatgttctcaaaaggaagacagtctgttgatatctttgtctcaacccagtgaaatgcattttggatttctgacctccagaactgtaagataatcaatctgtgttgttttaagacatcaagattgcagtaatttgttatagcagtagtaggaaactaatatagatttggctgcctggaagtgggttgctgatgcaacacatacatagaaatgtgaaatgatctgggtacttggtcaatgagcagaggctagaagaattttaaggaacatgatagaaatggcttagattgtcttgagcagaccgttagtgaaaacatggctgttaatgaccctgttaaggagtactctggagggtgtgaggagcctggtggagaatacccaagtcatcatgagcagatagtaggtagaaacaaggatgttataggcaatgctggagagggtacaaatggaaatgtggaccatgctactggaaagtagaggagagaggatccttattttacagtggcagagagcttagctaaactgtggaaagcaaaactaagaacttggatatttagctaaggtgacttccaagcaaagtgttcaaaatgcaacttagtttcttttggttacttatgcagtcatgaaccatagaacaatggcttttgatttttgtttttttggttttgttttggttttgagatgaagttttgctcttgttgcccagactggagcgcaaaggtgcgatctcggctcactgcaacctccgcctcctgggttcaagcgattctcctgcctcagcctcctgagtagctgggattacaggtgtcagccaccatgcccggctaatttttgtatttttagtagagatggggttttgccatatcggccagggtggtctccaactcctgacctcaagtgatctgcctgcctcggccacccaaagtgctgggattacaggtgtgagccatcgcgcggggccagaacattttagtcaataatggactatgtatactacagtggtcctgtaagattataatagaggtgaagaattcccatcacctagtgatgtcatagtggccataatgtcttagtacaatgcactgctcacatatttgtggtgatcccagtataaacaaacctactgcactgtcaattgtataaaagtgtaacacttataattgtgtacagtgcctaatacttgatattgataataaatgactgtttcttgtttatatatttactatgctatatgaatggttattttggagtatcctccttctacatactaaaaaaaaaggttaagtgtaaaatcgcctcaggcaggtccttcaggagttattccagaagaaggctttgttatcataggaaatgacagctccatgtgtgttaatgcctctgaagaccttccagagggacaaaattggaggtgtaagatggtgatatggaagatcttggtgctgtgtaaacctaggctcatgggtttgttcgttttcatttttaacaaaaaagattaaaaagtttaaaaagtgacgtaattagaaaaacgtctatggaataaagatataaaaaatttttatatagctatacaatgtatttgtgtttcaagctaagtgttattatgaaagagtcagacaatttttaaaattaaaaagtaaataaagtcaaaagttacagtaaactaaggttaatttattatggaagaaaaaagtacgtttatgtagcctaaatgcccagtgtttataaagtctatggtagagtaatgtactaggccttcacattcactcaccactcactcattgtctcacccagagcaacctctaatcccacaagctccattcatagtaagtgtcctgtacaggggtaccatttcttagcttttatacattatttgtacttatattttctatgtttagatgtcctagcgttgtgttacaattgcctacagtattcaatatagtcacaggctgcacagatttatatgctggtaacaataggccatgtatatacagtgtaggaatgtagtaaactgtaccatctaggtgagtgtaaataatgcattctatgatgttcacacaatgacaaaatcacataaggatgtgtttttcaggatgcatccccactgccaagtgaaaaatgattgtacctgtagcgaagtgtgaaaggaaggaaatgaaagagatgttaggcaaaaataatggatttgggaaatgctcagcctgtccagattacaaatatgctaaaattaggagaataactgtcaggaaaacatgatctgtagggaaagccaagggtgtggctggacaaccttttgttactgcattaaaaagatcaaaagataagtgtattcggtcatacaaggggctctttgaacagattagtgcactttatgggtctccttagccatctccagagaaaccaaaaatagagatcagattatctaggaaagatccatggacgcaactcttgtttaatgggaaacattttcttgacgtacacaaggttcttcagaatttcttaacaacgtaaaaaactgacagctctgactgaaagggacagagactatgaaatgaagcataactgtcagactcacaaaattatacaggcaggaaatagactgataaactattcagttgcaaacatgtgctaccattcataaaaaaggaagcatgactcagagagccaagtctcatgaccagagggcagagcctgtaaccatagggaattattcccaggctttgaaacccaatattgtctggccatttgggttttgaaattgcttgcgattggtgactcattttttctttcaattttctctctttttgaatgggaatgtctatatactggtactccatgcctgtccgactattgtattttgaggagcagataatttgttttctaatttcacaggcatagatggagaggagtttggccccaggatacatcatgtttcactcatacctgctttacatgattgaggtgatgagacctgggaatattgagttgaagaaatgtaaatgagattttggactttgagttgatgctgtaatgggttgagacttttggggatgttgggatacagtgactgtattttgaatgtgggattgatacaaatctttatgcaacagagggcagactgtggtaggcacaataatgaccccccaaaaatgtctacatcataatttcccggacctgtgactatgttatattatgaaacaagggggaactaatattgcagatggagttaaggttgctaatcaaacgaatttaaaattggcatttgccttaaattattccttctctgatgttaaaattatgttagttggtttctttttgtttacatttccctggtatgcttttgcatatcatgttattttcagcttttcaatctgataagttttattttaggtgggtctgttgtatgcaacatagttttggttctttgaaatccaatttaatatattatttttattataatgtgtgagttaagccaatattgctttttttgataaatatatctttttgacagaaatatgtatatattattttgaacagatatattatatatatatttattttatactttgtaaagccttccttgaggtgttttatctctttgcttctgtagtgtgcatgtgtgtatgtagatacacacatctagatcttctgatatttaggaaaatttttgttattattctaagaaagtcccccttgtcttctctttcatttgctaccacaaatacttcttaaacgtaaccatgaggaagtgaaagactttttcacaggaaactacaaaagattgctaaaaaaattaaataagacacaaataaatggaaagatatgcatggattggaaaacttaatattcaatatttgtggattagaagatttaatattactaatatgataaaactatctaaacaaatctgtaagtttcaattcaatctttattaaattccaacaactgtttttggaaaaatggaaacatggatcctcaaatccatatgtaattgcaagaggtcccaaataaccaaaacaatattgaaacagaaaaagaaattttaattactcacattttaatacttcaaaacttactacaaagccatagtaatcaaaacaatgtggtaccagcataaggacagatattaacatatagtcaggtgcaatagaattgagaatccagaaataaacccaaattattttcagtgaagaagccaagatcattccatgggaaaaatagtctcaacaaatatttctgagaggactggatatctgtatacaaaatgataatgctggacccttccctcacactatatacaaaaattaattcagtataacaatgacctaaatataagaggtgaaaccataaaattttaaaagtaaccataggagtaaatctttatgactttggaatttaattcttagctatgacatcaaatgcattaccaatgaaagaaaaaatagattaattggacttcaaaatttaaaacttttatacatgaaaagacattatcaagaaagtgaaaagacaacatacagagtggaagaaatatttgcaaattatatatctgttgagggcctagtatcaagaatatatacatcttacaacttaacaaaatgcaattaaaaatagatgaaggccacaaatagacatttctcaaagaaaacatacaagtgaccaacaagcacaggaaagtagtcacatcattagccattacaaaaatggtaatcaaaatcacaatgagatactatttcatatccagtaagatggctagaattcaaaaaatgtagataacaataattaatgaatttgtacaaaaatgaaacccttgtacattgctggtgggaatgtagaatagtgcagctgccaaggaaaacagtttggtagttccaaaaaagctaaacatagaattaccatatgacccagcattttcattcctggatacataaccaaaagatttgaaaacagatagtcaaaaaaatgcatgtatacatatgtttatagaagcactattcatgatagccaaaagatggaaacaacccaaaagctcatcagcagaccaatggataaacaaatcgtagtatactgatacgatgtaatactatacatccgtacaaaggaatgaagcactgatatacaccacaaaatggataaatctctaaaacatcatgctaaataaaagaagctggatgcaaaagttcatgtattgtgtgattacatttgcatatgaaatatccagaataggtaaatctatagagataaaaaagtgacttgattgccagggactggggacagggagaaataggaagtaactgcttactgggtatggggttgtattttggggtaatgaaaatattttagaaatagatagaagtgatgattgaaaaacattttgtatgttctgaatgatactgaatttttcactttaaaatggttgatgttatgtaaatttcaccttaagttttaaaaataattgaataatttttaaaaaaacaatggagaggagatgcttgatgcaggtgaattgtaaacatcagcctgagctgatgtctctacaggactgacttttgctagtcctctaataaagccaaccaggtataaatgcaaaaaacaaaaaaattattggattacttgattaattaaatatgattgtaatatagtctctttttataccttccttaatttgactttatatattttttacaacaatatcgtgagtgatattggcatatattttcagaaatctttcagtctttgactggttttagtattgttataatatccttaatcggaaagttataatatcctcagttggagaatattcattttttaaatctctggttgagtttatataagataacaattatctgttctatgaacacttgttaaaccatctggtaaatctagtattattttagtgagtacattttaaactactgatttcattgttaaatatactattgttcagatattatatttcttcttcagtcttactaattaagcttttctaagaaaatggttaggattaaattttattggcttggagttaaaatttattggcatcaactttttcatagtattttaaataattttaaaaaaaatttatcctgtatctgaagttacattatattttaattttatgctaaatattgtttttttgtgccttctctctttttcatccatgacaataatctcagaggattgaatatttcattaatgttttctaagaaccaagttttaggttggttgatcatttttattacatctttcccccaattttattattttttgctttattttatgtttattctgtgttcttttctattttcttaagttgaaaataagctcatttattttcagcttttctcttttttaaaaaatataagcatttctgggaataaatttcctcctaagaactctttaagctacttcctatgaatttcaatatctggtatttttctttacattcaaataatatgttttaagtttcatttatgacttctttaacttcaatttccttagaagtttaaagtttttagtttccaagtagttggaggtagatgtgttggtttttttaaaaaaagattctaatttaatttatgatgctcagagatgtgggctatatattaatttttaaaatatgttgagacttacattattaactagattaatttttaaatttccatgtatgccatcgaaacacattctcctctgttaagaaggagaccttatacatgttcattagaccaagcatcaagcatgttaattgtgtgaaaatattctaaatctctaacaaattttgccagcttcttctattaataacagagtagtaagttagattacaaagagagagattcacatagaggcgagagatttctttttatcaatttactttctatcttgctatgttacttactgtacaaatttcaaattattttatcttcagagacactgactttctttattcctaataaagatttatgcctgaaaataagttgtatcttacattactataacaacctctactgtgtgttagttaatatttgtttggttaatctcctactatcttttacttttaattattcagtacattcatattttagaaaaacgtgttacaaaaaagatatcgatgtttttctttttaatttaatagaaagtctgtttttttttaacctgtgaatttacatataatcactgatatatgtggaattagtgtcatcagcttatcttgcgcttgctgtttgtcttacctttccagtgctctcccctactttcctgccttctgttggagagtttagatatttgattgattgtttagaattggattagttggatattttaatcagtatttaattttgttttggccatttttctgagaatagtatcatctatccatttatttatttatttttctttgagatggagtctcaccctgtcacccaggctggaatgtgcaatggtatgatcttggctcactgcaacctctgcctcctgggttcaagtgattttcctgcctcagcctcccaagcagctgggatcacaggtgcccacccccatgcccggctaatttttttttttttgtagtttttagtagagacggggtttcatcatgttggccaggctggtctcgaactcctgacctcaggtgatctgcacacctcagcctcccaaagtgctgggattaaaggcatgagccaccacaccagcctatccatttcttttaactattccatatcactatgtttttggaatttctcaaagcgtaatgctaggttttgtatctagttttagaataattgtcttttaaaagtaaagtttaactcatttgtgaatctgatgtcagtttagtgctctagtctgtgtatgtatatgtatattattgagagattatcttagtgggcatattttcttttttaaaaaactttaggttcgagggtcatgggcaggtttgttacataggtaaaatcatgtcaagggagtttgttgtacagattatttcctcactgaggtactaagcctagtacccaattgttatttttttctgctcctctcccatccttcaccctcaagggggccccagagtctgttgttcccttctttgtgttcatgtgttataatttagctctcacttataagtgagaacatccggtatttggttttctgttcctgcattagtttgctaaggataatggcctccagctccatccattttcccgtaaaagacatgacttcattctgttttatggctgcatagtattccgtggtgtatacacattttctttatccaatctgttatagatgggcacttagattgattctgtgtctttgctattgtgaatagtgctgcagtgaacatttacttgcatgtgtctttatggtagaatgatttatattcctctagatatatacccagtaatgggattgctgggttgaattgtagttctgtttttagctccttttacttttaattgacaaatactaatcctttatatttatggagtacaatgtgatgttgtgatacatgcatacattctggaatgattaaatcagactacttgacatatccgtcactacacatacttatcactacttggtggtgagaacatttaaaatctattcttttagcaatttaaaaatacacaatacgttattattaactatagtcaccacactatgatacactgctagaacttattctccctgttgaactgaattttgtaccctttaactaacatatcccctttccccatctaccctgcctcccagaatggtaattcagaattccattgattttaaaagtgtctttaaattttgacttccgatggcatttcatttggatcctagggattttcaataatgttagatgagtttttataacaatatctagacttatggttcttatataggctgtgtaaattcagacatcactcttgtgcatggtgactttcctttattactttttctaccatagtccttggactgacttcaagcctcctcaggcaacacttccagttccattctattggattttgtaagacttcaaatatcccagttttctgtttgggtctcagcttcagctgtctgacttctacgattcatgaagccatctttcacatcaccagatgggtgttagaatcgatttccagtctccagggccttacaggctattgttgataagcattccctgatgcatatcatttggctttgatttctgtcaccattgctagcacctgggaattactttttgtttcttgattatatttcattttttgtatatacttctgtattcaggagaatatctgcattaacttagttgactacattgtgaaacgtgtaaacaattttttttttttttgagatggagtctcactctttcgctcaggctggagtacagtggcgcgatctcagctcactgcaacctctgcctcccaggttcaagcaattctcctgcctcagcctccccagtagatgggactacaggcgcgtgccaccatgactggctaattttttgtatttttagtagagatggggtttcactgtgttagccaggatggtctcaatctcctgacctcgtgatccgcctgcctcggtctcccaaagtgctggtattacaggcatgagccaccacgcccagccaaaaagtccaaacaatttttttttaaatattctacttttaatgcaaaacgtcaggggatactttggatacttaggatgaattagcaattcatagaactattgaccccaaactgatgaggacatttttgtttttcttcaaatggcaggatctagaaattagagattagaatcacttgcactgggtctgttaggggggatttgttaatgagttactaaaccattggattcacgtttgaaaagtcacaaattgctgtgctttgaccttttgttcaaataagaaaaataaatcagtttttaaaaagaactaaaagagattctgacaacctggttggcatctcagaatacaagggagcagccctggaaaattaaccctctatatgtgcactgctgactattctgctaccatggtctttagatgctcatttcttagtctctctttccctttcactctgtgttcttttcttcctttcttctgcaaattactgaaaacatacagttaccttctctgtggtgctgaagaattattcttgttgcctgaggcccctgagctgggagtttcattttagtcattgcaatgacactgcaacccaagaaactgcccagccaggcatgattgccaagaatagctcaatatcctcacaatttagtcataactcattcattctctacattcattttataaacccctaacttcttattattcatgatacctaccctccctgactccatatatacttttgtgcccttttcacatatgactttaaattggctgagggtcagactatctatggtccttattaaggaacactttttttctctcttttttacagaaattgtgcatagctcttgcttccagtcacctgtctgaagcagagccctactcaactccagggctgctttagaatgagagatcactaaaaaataggtggtaatagaaattttagtaacgaggctgagcctattggatgagttcactatgggacctagtgaagccaaagtctaaaacttcacattccactcaaaccttgcagaatttcaacttcaaaactgggtccattctaacagaatcctagtgaagtcctgtagccaacagtttgcaataacacaagatgattttgaggccatatggaaaactctcagaacaaaatgttaagacttttctggaggggactttgcatatctttgtgaggtgtttgaacagtgaggtgtttctgagctcctaatgacatagaaatagggtctactgagtaaggtgtgaggaagagagctgtggcttgctctaagccctgatgggctcatttatttctctagttttgctctcagaagtgactcattaatctaggttatcaaaatgggaccgtcttctcgtagaaaatgtcatcttcacttcctagcaaagactttacaaaagctatgaaaacacatcaaaaatttaggtatcaaatatacagtagatagctgaaaaacaaaagtgtctactcaaatatcctttcttctgattaacgtaaacctgcttagtctagagtttcatggcaatgggtaatgttcagtcatagctgcttgttcctgtcttaggatttttgcacaagctgcccaaagacttccttccctctgatcttcacctggcttgtgccttcatgtagctcagatcttagtgttaagtgttttctcttcaaagttgcttctcaaagcacttgatacttttcctggccacccaatcaaaaatatattcctcttcattcctattacgtgactctttaaaaattcctctatctaacctacatcaccgtgtgataatttattataattgtaactttaatatcactttctccttccatccacatatggatttacatgcctggtaattttttattggatgctaaacagtgagaattttaccttgttgagtaccaagtattttgcattaaaaaaaatgttctggaactagttctgggaggaagttaaatatttggatcctcttatattttgcttttatggtttgttaggcaggcccagagtggtatttagtcaaaagccaatttttcttcactattgaggcaagacccttcttaatacattatccaattctccttggaatataaagtttttcactctagctgttagaaacagttactattcccaacaatacatggcctccaggtgctactccttcaaatcatattggttgattattcctcagcctcaggtaatttcattaaataaatggctaatattcatctgaatacttgtgggagatgtactgcagaccattctcttttgccgtagcatctcttctgcagcatttgccctgtaaaccctggcctccctagctttgctagacttccagctcctttttctcaactctgcaaatccactgggctgtacctgagttccccacaacctcaaccttgtgccatgatttgaaaacatccaagcagtacgccaaaaaaaagtagtgttcacctcatttcttgctcaagaaattaataaatttattcatttgataaatgtcaaatgaatatgacacgtgctatatttcttcaaccgttgtgaatatggttaacattgtaaataaaagaatgtcatatttgtttacatatgttttaaaaatatcgtttgattatggttttcgtcttttccctattatattgtaatctctggaatattttaaagaattataattttattatcaggtacacacaattacttgaactcataacacaaataaaattgctttagcacctagactgtaattattttaattgaatgaaaataggtttttctaaaatgtttttgcacatttaaaaaatactattgtatttctgttttttactgtcagtttgctaattaaattagtttaactgatataatgcaaaagtaacattcatacagcccctgtcaaattgtaattggtggaagcagaaatggtattttcctgttattaatattagaatgtataagatagaagaaatcttctaactattcaggtttgaaatgtgaaattttataggttgattggaaaatagcctcatgaagaattgctgtataaaaatattgagggggaataggaaataagaattctcgtatgttagtgagaaatacttaagacatacagctttctgttaaacagttcacaatatatagttttatttccagaccccagctagaaaacggaactcataactgagaagcagatggagcagcagaagctgctagaggcagtgaatgtgcttcacagagagtccagtgctgtctgaggctgggtcactacccagcacagcaggattcactccagacacttggcgagtgaccaggtacctgcaggtcatctcaggtcaagcacagtctagtttacaccctgccaccaccatctaagaaagatcctctaccaggaatcagatatgttgctggtttgctcttttaaagtgtacttcagagaaaattcatcaaaacaacatcctcacacagaatcctaatgcaacgaaacagcaaaaatcctttaaaattttctgaaaatgcatttgacaggtgatacaaagatgaaacactttgaaagtataaaaacagaggattgctttagagatgttttctagtgactttttttcatgatagcattctctaacaccttacctgtgatagatttaagatctcatacaaacctttagcaattaactctttaaaacatatccaccaagaaatcctacttgaatgttttccttatatcctggttctccttgattttatgacctcttagatttaacaacaactctaacttctgaaagagcaggcacctatagtgagggtgaaggtctttaactagtggttaaggagacttagaattccagaccactaaaccatgtgacttaaaatttctacatattcacagataaagttttcgtcctataaagtgcccttcaatgctggtgggctcaagggcaggaagtcacacttttctctccttctagaattgacacaaagcatttgcctttacaaactaagctgtcatgtgcttttaaattgcacatgaacatcacagcaagttcatttcgtacacatttttatgatggtgactttcttgtacagactgtaaacaaaacaaatttcacatcttattaaaccttagggagaaacacacttcaaccctaacctttatgtcaaaagcagttatttttttcaagttatgtcatttcaatttttaaatatttacccttagacagaatttcttcaaagcctaactggtcttatttttatcctcctttgtgtcatgaactatagctcaaatcttcaaattgctctagatgtagttaagatgtaaatataaatacatttaaatgtaaataaaccggtttgagcctttctgagcagactggacatatgaaaaaaatgaatgagtcagtctttttaaaatcaatttgactggccatcatattcagcgatggtaagcagaggactcactagaacaataggcaggtcatttaccatgagggaggagagcagaatgacctgattgagtaataggcttacaacactttgaggacttcccatggtcttcagactaacagtgtctaggctgggatttatgcacccacccccatcgcatgccatacttctttctattctctagctatactaactctttctaagttccttgaatgtgccaaactttttcttgtatgttaatctgccaggaaccttctataccaaaccctccccttctcctcacctgactaagcctgactcctcttttgggtctcagctcagccatcaccttcttaaagaagccatctctaattacctctgtcccccactacctcacacacacaggcgtgcgtgcacacacacaagcaggcacacgtgtcatatctgcacactagattaagttaaacccccaagctatcgctccccatgatactggtcactttttttttttgagacagggtcttgctctgttgcctaggctggagtgcagtggcaagatcatgactcactgcagcctcagcttcctgggctcacaggatcctcccacctcagcctcccaaatagctgggaccacaggtgtggaccaacacatccagataattttatttatttatttatttatttatttattttgtagagatggggtttttccatgttgcctaggctggtctcaaattcctgagctcaagcaatctacctcccttggcctcccaaagtcctaggattaaaggcacttctttttctttagcctcatagagtttgtaattcttttttagtgtctgttttccccacaaggctgtagcaccgtgggggcagaggatagtgagtcttattctcatttgaattcatagcagaacatctggcacacagtgactgctaggaacacacagaagtagcaaagaaaagaagaaagaaaaaagaaagaaggaagaaggaaagaaggaaggaacgaagggaggaagggagggagggaggaaggaaggaaggaaggaaggaaggatctatacaaaaagagtctctaccctagtggatttggaagcatataaaaaatacattctctgatgtggctggctagactctactgtagctcaaagtccctttagttctgggtcaggttaagtcagctataccttcagcaacccctgatctgttgaaaatgcagctcatgtgtggttcaatgggaagattctagagaagaactgcactgcttagctcagctaagagtacatttatctcaattgatctcaggtaaccaagggtgagatatggtcactaatgtttgcccagtcccttctctgtgagaagcaagcaataaaatgctttctttggcagagactgcatctttatattccacaaacttcagggcaccactctgtgcagagaagaataaatccatcccctgaccaagacagccttaatattctcttcagcttgactaaactttagacaggtttcttcctgagtacaggcccctgacgtcccttttctaagagcatttactttggaaaacctaaaactgtaaattatttctctgcctttttgagatgtagatcgtctagtttcttgctaatttcagaaaccaaggaagttttactgaatgacaaggacctgacagccatccctttaaatgtaatcatcaagaatagtggtaaacccctcccttccagtttctgtgggatggcaggagtctaatgtgacaattagcaaacacagatgcctaatcacatgggccgacctcgtgccagtggccctccagtacttttccactagctcacccgggactaaaaaccttcccatcttttattttagcagagttgggttcagtgtctctcatatgttgtaatagtcttgaacagagtcttctttgcatgtttagctttgtctggtggaatttgtctttgataccctcataggcctggctcacatgtgcacctgaattaaactggggctacattacgtctggtagataggaatgttctagaaggtgatcacatttcaaaaattctatctaactgaataaaatgtcagtgtgctcccatttagtgagaaggagaattctttttataatttgagatgagattgtttttctttaatgctgctattttgaagtaacattaaaaaaatgaaaatatctggctacttctatgggaggcagatttgaatgatgtcccaggaggaaaaactgtggttggcatgtttcagaactatatcagttttcttatctatgtaaggtagctcatgtaatgatcttcgttgcaatgctgaaaccttgttgagctcttattttgaaggtcagcctctgaggtacctagattttattttcttctggtttggagagtgactgataggctttgtggctgaatgtcttccctctcagtaaaagtgaatggcgcagaatctgatgactagtgaatactcatcgaactttaattgtaagtgttgctgtcatcatctcatcatcactttcacaattgtgaaaaacaaagaaacaaacaggatattatgctttcaaaactttctactctctaccaaaaaaaaagttgatgggtagtaatgctggcttaaaatagtctgtagccttttctggattgcttcattcatatataactctgagctctatttgtgagatgtttgtctttctctctccctaccccaatccctgcattttttagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggtaactcatgttcacaaaataacaactcagaggtttggtcatctcttctagatttattgcaacttgttgaatgagaatagaaggtgccagggctagagatccaaagacaaaattgccatctgtgtttataaaatgctagaataaggaggaattgtgtattaccccagggattcatggcaatctggaaagacaactttggtctctgttggagcaagtgatacgagataacagaagtaaaggaaaagcaaactgaggagtcaggtatctagtatttaagacagaaggaagagattttattacaaacatgtttaggagaccttagccatagacataagtcagcaatactggttagatcctcttttttctttgtggcttgtttagatacagaagtcaggagaagatgaggtaatgtgaccctaagccacacgaccaacaaaagtgtttgtgggcataggggccaagaaactgcactctgatctttcagtcagaacaatggttcacagctggacagatgagccccatgcactactcactgatgccatgacaggaaacagcagcacattgttccaagttcttcaggggtgtggtgaaatccacaggatgtcctccttgcaacccctagtactaccataacccagattctgaaaactgtaacttttatgagtattattattactgcatagggacattgctgtcccctgtccttttcagtattttctatgctgccaagataaatcatctatgtcctttcataatgccattcaaagccagttgttcttactgggtcgatagcatagaataatggagcactcatgataatgggtgatggaatctatccatgacctaatttgtattgtagaacagtggtgcgacatgtatatcctgtatgtaggctacgcagatattatttataaaggtatagaatcatattacgcccatgtataaaacactgtatatagcaaacaaagggggatagagaagcgtataatccatgactcttgacctagagaggcttgccatctctttgggcaaatcaaaacagatcacatacatgaaatagacaaataacaatagaggacaacgagtttttgcaggggatggtaagaatatggctaattacataaaatatttctattttcaatagtattcatagtttgatgttagaaaatgctttcagataccaatatatgtaaatgcatcaatgtatgtttggcttcataaggttcagcagagttcaatgggaaattgcctggtatggatctattttcaaataaggaagtttcaatcttttagaacttcctcagtgtggcttctagggaggcggcgaaaggcaggagaaaggggagacattgctaaacaataacccacctctgccacgtaggtgtttctactttctctgaaataatagacatctcctttctctgaaataatagataaaccaagaataagcattctaatgaaccaataaatcatccaagacagtctccttatttgcaaaacagaggtgatgagggtgaacaggggaaacagtttccctaggctcataaggttaatggcagcaaagaaacgacaacccacacctcctagacaacatagtgcctatttttagacttagtatttggtaatatattatctctcattgctttctaattgtttcctaagaaatgtttgccatcttcaactgtaatatctttgtagtcaaagcatccttacttgcttcatagaaccctatacaacatggatctctgggagctcagtcaattcttgttagctaattgatcagttaatttacattttcattcagggtagggagttttgctgaagggcccaaggagaagagcagtgaggagcctactgaaaaagcaggtgaaggtggtgaattgggcccggtagtgggaagcaaagtggagagaagtggtttgatggtgaagacatgttgagtgaaggttgagatttgctgacagaattgtcaagaataactgtaatctgagcaactggaaagatggtgtcaccattgactgagacagaggaagacttcaggaaaaaaagattagggaaagtccaagaggctgattttggataaattaagtctgagatatctgatggtggtccaactacagatgtcattttgtcattgtgttttattagtaaaattcaggatactacttatgcttagatcatttatataaggatttctaggaagatattttgttgagctctcaaaacaagttaaaactctgcaacaaggtacactaatattttgggtttttaattgtgacagtacataaatgtcaaggttaaagcttaaactgtgttagtattcacagcaagaaataacaatttacaaatcttgatttatttttatgctgtgcttgaatctcaaagctgtgtttaagagcttcttatatgattacaatctttatgaaacatgtttatatttgcatttcattctggagtcaagttcagcaaatatttctcttttttaggtctaaggaaggcaggaggtttatttaacttttctatttgaattaattcataaaacttatttatgttttatgcagcaaaattcttatacttttatctttagcagtgtttatctatattatctatgatgtatacattcatgtatacctaccttggtcttcggttttaatctctatatttctgtgaaattggcttcaatgttattgaagaacaataaactttcacttcatgtattattcttatccatttgagatccttgaatatcaaatgaattccataatcttctaacaaatatgcagacacatctatgaaaattagtgtgaggaaggagaattaacctttccatactattgatagctactgtttctgtcactcctttttacctcttctaattgggtcacttctagtggtttggaaagttttgatattgctattagtttccatagaaaccattattgaacttaatcccagatgtcactatttaaataaagagtttatgtgcactagattgccagtttgaatattaaaggtcccaaacccaggctgagtagtttaggaatcactgtggctaattaaaaagtatttcatgtaaagtacacatcactgcttaattagttgagtatatcaagggattggaggtgtgttagaaaagcactaactgaaacatcaaaacataacttctaaaaaattaatcattgtaggacagtggaaagagctgtaaagcaaatcagagtcactctcttccagtaaatgtcttagctgcttaaaagatttgtatcatgtttgcaatggcatagtgctttttcattcctgatgagacttattagaaattccatagaagctgatagggtgtagcattttgaagcactatcactgggtccaataccagttcagttatgtatcagccgcacgacttgcatgacctcacttaacctcagaacctcagttttggtaacatgacaacaatatccacctcacacagaactctgcatgaattaaatgaaataacacaaatgaactactttacaataaaataatacaagtgaaatactttgcaaactgaaaatacttaacataaatgtaaaatgttactactagtgtcatgtcttattagaaaacagggcatgacatagatcatttcataaaaattatatattttgtaattgtaagtttaacttaactacatcccaggatgtggaaactagaaaaaacaagacaacaatctttaatcaatcacccttacatagttagtgccaatatagatattttctcttatattttcccatgcagtcttttataatttttttctgatgatgaaagtaatacgtgcttaatatgctattgcatgcacttggaaatatacagaagcattagaaagctgaagagaattaagaatttgctcttatctaaacatcattagtcactgttaaaattttggcatgttttcatctttctctatatagttttaaattatgtattaatattattttatatattgctgtattaaaagaaatgttttatacattgatacatttgtctttgtcgttaaattcttttattcttaatggctgcttaacattttgcattcacataagctataatttaggcatttcattctttctatttaggctgtttttgcttattcacaattttcaaaaatgttgcagtgatataataaaaaaattttcattctaaactttctttttttacatttggataattttcttaagttgtatttctagaagttaaatttctagaagtttaatcaagagatataaacatttctggctgggcatggtggctcatgcctgtaatctcagtgctttgggaggctaaggtgggcagatggcttgaggtcaggagttcgagaccagcctggccaacatggtgaagccccatctctactaaaaatacaaaaattagttgggcttggtggcgggtgcctataatcctagctactcgggaggctgaggcaggagaatcgcttgagcctgggaggcagaggttgcagtgagccgagatcgcgccactgcactctagcctgagtgacagagcgagactctgtctcaaaaaaaaaaaaacagaacatttttaagcttttgaaaaggagttccaaaaggcagctcctactaacgctgcttgaaactctatgcattcttttcattttattttgcataattatcatcacagtgtgcatacaattctctatcttatttcactcaggattatattttacatagttttgatgttgcttcatggtctttataaccaccattttaaaagctccataatattctaaccagttaaaatactataactactggccattcttatgttgtcagtcatttagacgacttttaattttccttcttacataaaaaaaaaagcactgaatatgatacacagatttttcacagttgttgttactgttttgggattgttcctttacagtagattcctaaatataattattagtaataacttgataaatttggggtcccttaaaaatataaactgcattttcttgcaatatggcaatatttgcatacttaatatttgctccggctagcagtatattaactgtatgagttcatggggtttattctgtccttatcagcctttttcacacctcagtgaagttatagccattattttattttctctccatattctttgtaccaattgagaacagatggacacaatgacttttaaaattagtctatattacatttggctattttagaagacataatgaaagaatctggctggtatctaattctcaccaacagctcaggactggtaagatgatgatagctagtctagtgaaaacattttaagactttgaagcaaggggactcttactccaatagtttggaggctgccattcacaattttagactgatactaattttcataatatatttgccttattaggtttcaaattttatggactccacttggaattaacttattttataaggccagataagatcagtccattagagtttgatccagattaagatgttccataaactgagatgggttccagtttacttcagcccattaggtcctttggtaataacttctctttatcttgggaagtttgacccaaatgtcaatatgcactcctgaagaatatcatttgctttcaacccagaagttggtattattagttggggtttgtggaagacattacatttcttcacccctttttgtatccatgctctttgaaatatggctttgtagcatctctcctcgagaggtagagttttgttccctacctgttgaatctgaattgaccttaccatttattaactctaagtttaggccttaagagacttgacctactctcattttctttcctggaaccttaccttagccatatgaataagcttgaatttatctggtagaagatgagaaataacatggatcagaaacaggatgacctctcagttgagaatgtcctagatcagccagtccctggccaacccaccacctgacagttgacgcctgagtgagccaagctgagatgagttatgtccaactcagagcagcagaacttcctagttgactcctagattcatgaactaaataaattattattgttttaaaccactaagccctgggatggtttgttatgcggcttttttggggcaattgataactgataaaggtattcatagctttgtaatccatggagcaatagttggtttaattaaattatgggacataattcctcaacccaatagtagaatgctcagtcttttcccatcataagaagaatggtgcaatattgcacccaggatctcgtcgagcaaagccaaaaagttttatagatcctgcaatcaaaagaattttaaagcccccttgatcctaggcagttaaactattccacttaggaaatctgctgtgcatacaggaagtgctgaaaaaatgaggtacagttatagcttagtcaaacaaatactctcaaaataaaacagtcatatgttctcatacagtgctgttataagttgctttatgggaataggttttacaagtcttagaagtgtttatatatcttagttggaagaatgaaagtgaactgactgtgtgtctcatctggaccttataatttctcagacaaatctgattatcacacagatgaagctctgagagtaactattcaataggcacaatattggcctacctatctcttattaacacttttgattggcactgccaaatgtgttagccactagccacatgtgtctatttgtatttaaatttaaatcagtgaaaatcacgtgaaatgaaaccttcagttcctcagtttcactagccacagttcatgtatcaatacaggtactagaatatacatttttctgtttaaaatagtttatttcttataaacataatagtaacagtgatacatgagtaacagcatgaacttacaaattgtgaaaaaaaatacttttggtttcgtagttttacatagcatgataggtaacaatactttgttaatgtgctgttttgattgatcatatgatttttcctgctctattttctggaaccttatttattaggtgattgaaatttatacttttagtaacctcattttcattacatatgattgagaatgttatcatttgctcttggaaaatgcaagatcacacataattttttattttaattttgagaaggatctttctgctgatgcaattgttacagtaactgttaagaatatttaggcctggtgcggtggctcacgcctgtaatcccagcactttgggaggccgaggtgggcggatcaagaggtcaggagatggagaccatcttggctaacacactgaaaccccatctctactaaaaacacaaaaaattagccgggcacagtggcgggcacctgtaatcccagctactcaggaggctgaggcaggagaatggcgtgaacccaggaggcggagcttgcagtgagctgacatagcgccactgcagtccggcctgggtgaaagagcctgggtgaaagaactccgtctcaaaaaaaaaaaaaaaaaaaaaaaaaaaaaagaatatttagtaagctttgactccattgagacaaattttttgataaatcatcccaaaagacaaattttagcatagagttgatgattatctttgaacaacttttctaaaaagatttaactcttcatacagatctggtttttgcaaatctgaatttgagtgtaaatttatgaaataaccattttaatgtcattcttctgacattttctgtaattagtgactaccatattggacagcatagatgcagaaaacttctactattgcagaaagatctattgaacaatgctgctctagactgtgttctattttcctaactccacaaatgcaagtttgattgtttctgtagtatttggatataattcacaagttagtgatttgagactgatcaacttgttgaatatcctgacgaattacaacagctgaaagttgactcactctttggtatgagccaacgctgccagcttgcttggtaattcctacagatctgatgcccaacatagggtggactggttcccacacagaccaggcatgtcttaaagagcctagttaagttctttaatccatgtcatttttaatattggatggaatcagagaaacatgcacatgttctgtcatccaaaaattataaagattgatgcaggggcatgagttattggttcttttaccttatattcatcttgatttgtttcccaaaagctcaaataatttttagtagcagatacagacttgaggtataaaaatggaaattatctgaggcatctaatggcatcgagagagtaaacagttactattttatcttttatatgcaagtgaattttatttttactatgcctgcaaaccagttacctagagattgacctaagtttcatatactttagttattactagaatttggttataactattaataagttctttaattagatcagttttcttcttattgaataaaatatgtatttctgaagttgaatggtctgtcatgtggttcagcttgccttccaaacaagtttgaagtgagtgttttcaatgattaaaatctatgactgttcataaatatttcaccctggatgagtatctatttaggttagtatctatttagattgtttctatggcattttcccatgtcgtctaaaagtgtcgcttctcatcaggagaatagttttgtatttcacgccttgtatacatttgctgctgggaaaattcatataaaataaagtcatattttcagccatcataaaaagtaacagttgttcaggatgggtgtgacccattatacttggggtctggcccatttactcttttcttcctttttatagttttattaaggtataatagctacattacacacatttaaagtgcaccaaaaaaattgatcaattttgatgtatgtatatgcccaagaaacatttactgcaattaagatactgaacatattgcttctcaaattcctttgtgcctcattgaaaatccctctcgtctacccctcttcatcccatccccaggcagtcacttattgattttctgacactatattttatttgtaatttctatactttaatataaattgaatttttataaaagagtacattataaactcttttctgcctgccttcttttactcagcacaattattttgagattcatgattgcactgtatatatcaatagttaattccttttttttttttttttttttttttttttttttggagacagagtcttgctctgttgcccaggctggaatgcaatagctggatcttggctcattgcgacctctgcctcccaggttcaagcgattctcctgcctcaatctcacgagtagctgagattacaggcatgtgctaccatgcccgattaatttttttttttttggtatttttagtagagatggggtttcactatgttggctaggctgatctcgaactcctgacctcaagtaatccacctgccttggcctcccaaagtgctggaacaacacttaactcctattaattgaagagtagtgctccattatttgtgtatcataatgtggttatttattcacctggtaatgaacatttgagttgtttccaggttttggttatttcaaataaagctgctatgaatatctttatacaaatctttgcataagcatattctttcatttttctttggtcagttctttggagtgtaatggctgcatcatgtggtaagtgtgtgtttaacttcttttaattcacctgttggtcttattcactatggagatatatgattgggaaaatagcatcacaaagggattgaacactgagaaggcttgttaaagttcaaataccagtgagacttctgaactgcttcttgaagagtgtattccatcattccattttttttttatttgcagatggcagttaaggtgaaggggttattttatgttcatattatgagccaagtcttgggtcataatagctataaaacatgatttctaattagctagatttcttattagctactatggaatcaaggttgtcgtatctctgaacaatttcctgagtatgttccctagtgattaattctccagtgactgcgtttccgaaaaactagcctcttacccaaagttaaaatattcatttgtgccctaatgactgggagattgccttgtataatcaacccacaagttatatttatggtatagttcccatgtctctaggccacagtaatgcactggggagttatattttatatccaagagctatttgtcaaacttcacaccaatgagctgtgtgaggccaggagttcaagaccagcctgggaactactgcaagaccctgtctctccaaaaagttagctgggcacttttagaggacatggaaaaatgccatagaaacaatctaaatagatactaacatgcacctgtagtcctagctgcttgggaggctgaggtgggaggatcacttgagcccaggagatcaaggctacagtgagctatgattgtggcactgcactccagcctgggcagcagaatgagaatctgcctcttaaaaataaaagtaaaaaagaaatgccagtgaattgaatccttagagatgtaaatagatctggactgaatactccagtcagcttaatactattatgcaatccatttggctaaattaatagcttaagcctttgaatgatgtaaataaaaatctggtccttcagagctgtagttctcaagcatggcttattaagaccatcgggaaagcttttacacaaaactttcctatattaatctgggtcctacgccatacaaatagaatcagaatctttggagtgaggccaagcatttattttaaggacaagaagaaattcatacttaaaatttatgagccatttaaattttcaaaattcagaaccatctgtcactgtccaagttgagagcctgctaaggttttggccctggctgtggcatctgagatagctaatgagattttagtaattcatgatctgaatcagtctcttttgtttatttatttattggtaggcttgttttgcatttgaagtattggcattccgaaaccagtaagtcataaccaaatactgtatgcctccctgtccagattgggtaattcttagatgtattaattttgtattgctgtcataacaaattaccacagactcagtggcttgaagcaacacaaatttattatgttacaattctgtaggttagaagcctatgacgtaacctctaagaccctgacaagagtctccctggggtaacattagagggtcagcaggcctgcattccttatgaagaccctaggagagaatgttcccttgctttttctggcttttagaggccactcacgtgtcttggctcatggcccccttccttcatatccaaagccaggaactttacatctatctgacttttcttcctcaaccacacctctctctggacgtgaccagggaaatttctccactgttaaggattcatgtgattgagacctaggtaacccaggataatctctccatctcaagggacaattagtcacattcgcaaagtctcttttaccatggaaatgaatttattcacaagttcagtgattaggacgtggcatctttgtgggactgttacgttgtctaccacactaggtgtcaagacagcacggcatcagcctctctaagtccctaccggctgattctttagtgccttctactgctgcaggctgattctgtaggatataagtctttggaaacagattcgaaaagtcatttgtattgtgttcctgtgaaaggtaaaacatccaggcagttgacgacatatatttcttgcatccactctcagggaagtctcttatttcgcatcatcatcctccttggcgtcctctgacggagcatgctcctctgattggggactgtctttttgagggccgggggactgtctttttgagggcctggggactgtctttttgagggccaggcggctgtctgcctctactacctgaccctaaaatgttgaaggcccaaggtccatttcagatatttgatgctcacagtctcttttagtctaggctgccagctttttaatttttctaagaaaaatcttattttaaatgtagtttcctttttaactagtttatcaggcacaacctgcgttaatagccatgcctacaattcttgttagacaagcctcgccttccagacttactttgaggtacattgaacctaacagactcctagtgaaaagccacagtcttagtctcttgtttcttagccatttccttcatctgaaagatttatgtgtgccaaattattattttcagagatttttaacaaaagaatatgagtcttgatatggttcttgccattaatctgagttttcatgggtcttttgtggtacaaagaccttgtcagcttgctctttaagagttcgaaataaaaatccatttcacttttatctttgcacatttaatttttctacttccttgcctaaacatgtaagctcagttgataaaactgctgccttccaagttattgcaggtgacaatactaatgagtgttttgccattgcataataatggaataattatgtccttttagaccctggtcacagtttctttgcaaattgcttcctgtatctatatgccttgtattttatgtttcattgttggtttcgttgtgttataggaacccccctactttttggtaccaatttctgtatttgtcaggataggctagatatactgtgacaagaaattaaaaatagtttaatgccttataacaataaataattatttctcattcatgcaacatgttcattatatgttagttaaaactcccttatgttttctggaagccaaactatagaacagcttctatctggaacattgatagttgcagcataaagaacaaaacatagccaatgtgaacttagtttaaaacttccactaaaagttatatgtgtcacttccactcacatttcattgaccaaagcaagttttgtagtcaagccagttattaatggagagaggaaatataacccatctcaggggaagggtatctaatatatgggaacaatcttcaatctatcaaactaataaaccaggcttagtactatagccatttattcataagagggcaaatcttatggttggaatctttaaaattttaaactttttaaaaacttatactttaagttttgggatacatgtgcagaatgcacaggtttgttacgtagatatacatgtgccatggtggtttgctggactcatcaacctgtcatctacattaggtattcctcctaatgctatcactcccctagccccctatcccccaacaggccccagtgtgtgatgttcccctccctgtgtccatgtgttctcattgttcaactcccacttatgagtgagaacatgcagtgtttgcttttctattcctgtgttagtttgctgagaatgatggtttccagcttcatccatgtccctgcaaaggacatgaactcgtcatccttttttatggctgcatagtattcaattatgtatatgtgccacattttctttatccagtctatcattgatgggcatttgggttggttccgagtctttgctattgtgaaaagtgctgcaataaacatacgtgtgcatgtgtatttatggtaaaatcatttataatcctttgggtatatacccagtaatgggattgctgggtcaaatggtatttctggttctaggtccttgaggactcaccatactgtcttccactatggttgaactaatttacactcccaccaacaatgtaaaagtgttcctatttctccacatcctctccagaatctgttgtttcctgactttttaatgatcaccattctaaatggcaagagatggtatctcattgaggttttgatttgcatttctctagtggccagtgatgatgagctttttttcatgtttgttggccacataaatgtcttcttttgagaagtgtctgttcatatctttcacccactttttgatggggttgtttttttcttgtaaatttgtttaagttccttgtagattctggatattagccctttgtcagatggataggttacaaaaatgttctcccattttgtaggttgcctgttcactctgatgaatagtttcttttgtgtgcagaagctctttaattagataccatttgtcaattttggcttttgttgccattgcttttggtattttactcacaacgtctttgcccatacctgtgtcctgaatggtattgcctaggttttcttctagggtttttatgacttcaggtcttacatttagagtctttaatccatcttgagttaatttttgtataaggtgtaaggaaggggtccagttttcccaacacaatttattaaatggggaatcctttccccattgcatgtttttgtcaggtttgtcaaagatcagatggttgtacatgtgttgtacattatttctgaggcctatgttctgttccattggttaatatatatgttttggtaccagtacctgctgttttgggtactgtagacttgtagtatagcttgaagtcaggtagtgtgatgcctccagctttgttctttttggttaggattgtcttggctatatgggccctttgttggtttcatatgaaatttaaagtagttttttctaattctgtgaagaaagtcaatggtagcttgatggggagagcattgaatctataaattaccttgggcagtatggccattttcaagatattgattcttcctatccatgagcatgggatgtttttctatttgtgtcctctcttatttccttgagccgtggtttgtagttctccttgaagaggtccttcacatcccttgtaagttgtattcctaggtattttattctctttgtagcaattgtgaataggagttcactcatgatttggctctctgtttgtctattaatggtgtatagtaatgcttgtgatttttgcacattgcttctgtatcctgagactttgctaaagttgcttatcagcttaaggagtttttgggctgagtcgatggggttttctaaatatacaatcatgtcatctgcaaacagagacaatttgacttcctcttctcctatttgaatatcctttatttctttctcttgccttattgccctggccagaacttccaatactacgttgaataagagtggtgagagagggcattcttatcttgtgctggttttcaaagggaatgcttccagctattgcccattcagtatgatattggctgtgggtttgtcataaatagctcttattattttgagatacgttccatcaatacctagcttattgtgattttttagcatgaaggggtgtttaattttatcaaggccttttctacatctattgagataatcatgtggtttttgccattggttctgtttctgtgatggattacgtttattgatttgtgtatgttgaaccagccttgcataccagggatgaagctgacttgatcattctggataagctttttgatgtgctgctggattcagtttgccagtttttttattgaggattttcccatcgatgttcatcagggatattggcctgaaattttctttttttgttgtgtctctgccagattttggtatcaggatgatgctggcctcataaaatgagttagggaggagtccctctttttatattgtttggaatattttcagaagaaatggtagcagcaactctttgtacctctggtaaaatttggctgtgagtctgtctggtcctgggcttttttttttggttggtaggctattaattattgcctcaatttcagaacttgttattgttctattcagaaattcgagttcttcctggttcagtcttgggagagtgtatgtgtccaggaatttgtccatttcttctagattttctagtttatttgcgtagaggtgtttattctattctctgatagtagtttgtatttctgtaggatcagtgatgatatcccctttctcatattttattgtgtctatttgattcttctctcttttcttctttattagtctggctagcagtctatctatttggttaatcttttcaaaaaagcacctcctgaattcactgattttttttttaaggatttttcatgtcgctatctccttcagttctgctctgatcttagttatttcttgtcttcagctagcctttgaatttttttgctcttgcttctctagttcttttaattgtgatgttacggtattgattttatatctttctcactttcccatgtgcataattagtgctataaacttccctttaaacactgctttagctgtgtcccagagattctggcacattttgcctttgttctcattggtttcaaagaacttatttatttctgccttaatttagttatatacccagtagtcattcaggagcaggttgttcagtttccatgtagttgtgcggttttgagtgagttttttaatcctgagttctaatttgactacgctgtcgtctgcgagactgttttgatttctgtacttttgcatttgctgaggactattttacttccaattatgtggtcaattttagaataagtgcgatgtggtgctgagaagaatgtatattctgttgatttggggtggagagttctgtggatgtctgttaggttcacttggtccagagctgagttcaagtcctgaatatccttgttaattttctgtcttgttgatctgtctaatattgacagtggggtgttaaatctcccactattattatgtgggagtctaagtctctttgcaggtctctaaaaacttgctttatgaatctcggtgctcctgtattgggtgcatatttaggatagttagctattcttgttgcattgatccctttaccattaagtaatgcccttctttgtctttttttatctgttttggtttaaagtctgttttatcagagactaggattgcaactcctgctcttttattgctttccatttgcttggtaaatattcttccatctctttattttgaacttatgtgtgtctttgcacgtgagatgggtctgctgaatacatcacactgatgggtcttgactctttatccaatttgccagtctgtgtcttttaattggaacatttttgttcccttgctggagaggagctgtgatcgtttggaggagaagaggcctttttgcaattttttccctcatcttcatggatttatctacctttggtctttgatgctggtgaccttcggatgtggttttggtgtggatgttcgttttgttgatgttgatgctattactttctgtttgttagttttccttctaacagtcaggcccctctgctgcaggtctgctggagtttgctgcaagtccactccagaccctgtttgcctgggtattaccagcagaggctgcagaacagcaaagattgctgtctattccttcctctggaagcttcatcccagagggtacccaccagatgcccgctggagctctcctctatggctgtcgacccctgctgggaggtgtctcccagtcaggaggcatgggggtccgggacccacttgaggaggcagtctgtcccttagcagagctccagtgctgtgctgggagacccactgctctcttcagagctggcaggcaggaaagtttaagtctgctgaagctggacccacaagctccccttccctgaggtgctctgtcccagggagatgggagttttatctatcagcacctgactggggctgctgcctttcttttattttattttattttattttattttattttattattgttatactttaagttttagggtacatgtgcacaacgtgcaggtttgttacatatgtatacatgtgccatgttggtgtgctgcacccattaactcatcatttagcattaggtatatctcctaatgctatccctcccgccctccacccaccccacagcagtccccagtgtgggatgttccccttcctgtgtccatgtgttctcattgttcaattcccacctatgagtgagaacatgtggtgtttgttttttctacttgcgatagtttgctgagaatgatggtttctagattcatccatgtccctacaaaggacatgaactcatcattttttatggctgcatagtattccatggtgtatatgtgccacattttcttaatccagtctctcgttgttggacatttaggttggttccaagtctttgctattgtgaatgtcccgctataaacgtacgtgtgcatgtgtccttatagcagcatgatttatagtcctttgggtatatacccagtgatgggatggctgggtcaaatggcgtttccagttctagatccctgaggaatcgccacagtggttgaactagtttacagtcccaccaacagtgtaaaagtgttcctatttctccacatcctctccagcacctgttgtttcctgactttttaatgattgccattctaactggtgtgaaatgatatctcattgtggttttgatttgcatttctttgatggccggtgatgatgagcattttttcatgtgttttttggctgcataaatgtcttcttttgagaagtgtctgttcatatccttcgcccactttttgatggggttgtttgtttttttacttgtaaatttgtttgagttcattgtagattctggatattagccctttgtcagatgagtaggttgcaaaaattttctcccattctgtaggttgcctgttcactctgatggtagtttcttttgctgtgctgaagctctttagtttaattagatcccatttgtcaattttgtcttttgttgccattgcttttggtgttttagacatgaagtccttgcccatgcccatgtcctgaatggtattgcctaggttttcttctagggtttttatggttttaggtctaatatttaagtctttaatccatcttgaattaatttttgtataaagtgtaaggaagggatccagtttcagctttctacatatggctagcctgttttcccagcaccatttgttaaatagggaatcctttccccattgcttgtttttctcaggtttgtcaaagatcagatagttgtagatatgtggcattatttctgagggctctgttctgttccattggtctatatctctgttttggtaccagtaccatgctgttttgtttactgtagccttgtagtatagtttgaaatcaggtagcatgatgcctctggctttgttcttttggcttaggattgacttggcgatgttctttcagagattccctgcccagagggaggaatctagagaggcagtctggctacagcggctttgcggagctgcggtgggctccacccagttggaaattcccagcagctttgtttacactgggaggggaaaaccacctactgaagccccagtaatggtgacacccctccacccaccaaggtctagcatccctggtcaacttcagactgctgtgctggcagtgagaatttcaagccagtggatcttagcttgctgagctctgtgcgggtggcatcccctgagctagaccaattggctccctggcttcagccccctttccaggggagtgaacagttctctctcactgacatttcaggctccactggggaaaaaaaataaaaaattaaaaaaaataaataaaatttaaaaaactcctgcagctagctcagtgtctgcccaaacagccacccagttttgtgcttgaatcccagggccctggtggtatgggcatctgagggaatctcctcatctgtgggttgcaaagacagcaggaaaagtgtagtacctgggcgggagtgcaccatccctcagggtaccatccctcacagcttcccttggctaggggagggagttccctgaccctttgcgcttcccaggtaaggcaatgccccaccctgcttcaactcaccccccgtgggctgcaccccctgtctaaccagccccagtgagatgagccaggtacctcagttggaaatgcagaaaccacctgccttctgtgttgatcttgctgggagctgcagacctgcactgttcccattcggccatcttgctagccacctagaattttaaacttaattaaaattttaactgtcaaaattactgcgttaaaatgccttgagaaatttttaccaaagatgaagagaaatttcctccttctctatcaagactccagtaaattaattataggtactttatattaaggcagtgaatgaaatattccgagctccaagacagagtgacatttgttggaagagcttgtcaacaaaatatctttattttctaatcaaagtaagattaagcaataatcaggcattactgtcctgagtttcatgtttccactagtgaagtcttcttctctgtttaaaggttttgagtaggactggagcttattttcatcataagagggacaaaaagaaaggagtttatacatagtccacccaatataatgaacttctttctacagagggataccagcttccagatctatcctgagataagtgacacggatgagcagttgtagaatttcctttcttgcatgggtgtgagaaaccaatatcatcttttctaacaagagattgttcttgcaaaagaacaagcatgtacaagttattatgatatagtacaaagattgttgaacacctcaagtccatatttcatccatttgaaatggatttatttacaccttaccctaggaataaaatggcctcagcctggctgtaccatgctctcttagtgacagttttccaagtctacatgtgcagaggttaaggaaacattgttatgtagcaaacggctaggaatcccacattctctgatccaacattcttcacaaaattgtccaggggtccttggaacactattattaggcattatacttttcaaatccttaaattaatctgtgaagatttctgtcacattttaatttatatctttttatatatcactgaagctgaatattttctcagcttttataattttatcttctgtgagtttctttgcttatgtcttttgtcagagtgccttttcttgaaattaaaattgattttattttaaatttcttattataaaacatccacttccttatatttaaacccttaagtcatatagaaaattagttttggcctttgagtttttaaaaccatgtccttagcgccaggtttggtttgtaagtaagcacacatttagttattagaacataagtgttggactctaaaatgaagtgaataagtcagagaagtggtcataagcctattggaattgacttaattgaaaacaaaaatagaaacaaaagttagattgtgtttgaggacatgcttataaatcacagtttttcacaatagcaacgatgtggaatcaacctaaatgcccattaaagatagattgcataaagaaaatgtggtacatatacaccatggaatactatgcagccataaaaaagaatgaggttatggcctttgcagggacacggatggagctggaggccattatccttggcgaactgacacaggaatagaaaaccaaataccacatgttctcactcataagtgggagctaaatgatgagaacacatggacacatcgagggaaacaacacacactgggaacttttgaggggcagagggtgaaaggagggagaggatcagggaaaataactaatgggcactaggcttaatacctggctggtgaaataatctgtacaataaacccccagaacacaagtttacttatgtaagaaacctgcacttgtactcctgaacttaaaagttaaaaaaaaataaaagtgatatgaataaataatagtaaaattaataagtagaaagtaaatcaaaatataaatatactgtgcagcaatctcactgttgcatggcatagcccacattagctaacaacattgtaaaaaactttactgaagactatttatttaaccaaaagtttatatttatatgcctggatgtgttttatgcattaatacatagctgttttccaaaatatacttaaggcaatatacaaaaatcctgacaatatgactaggggttgttgagtgaacagaaaataagaataccaggaagttagctgtggtataatataaggttcccaatatgtgccttgattttctttaaataaacttttaattttagaaaagttttaaagatttacaggaaaattgtgaaaatagaatagagtttctatatactccacaatcagtttccctgactgtaatatgtaacattagtatgttagatttatcacaatcagtgaaccagttttgatacgttattaactaaagtccatctgctattcatagtttcttaatttttatctaatgcctttttttctgtcccaggatgccatccaaaggataccactttgcatttagtcatcatatcaccataggtctcttggctgtgattcttatgactttttaaaatatggaaagtttgtataataagggttacgtaaaatcagataaattcaaggttgtgtttagagacaaaataggtgttatgaaattatgttctgtctctagaggtgggcaacaaatatgaccctgaacccccaatgtccaaaagaaacaaatacaccagttgtttacagtgcttcacagaaatgaaactcttcctgatagtgagtcctgagataacctcctcatacagccttcaataagagaccactttgtagtgtcctaagcattttccgtaacatacttttatgtaaagtaaaaaatggcttacaaaggctattttctatagcatctttgaggttagccaaggtcgtaatgactaagtgtatttcaggtgtggggaggaaggatcaaagtggagtcaaggcctgaagctatgcaagttcctcagaggtctgggaaacttcccttaaataataggtagctgatcctacagggctcttctccaggcttccggaaaagactgtccaactcagtcatcgccatgtctatttcacaatacacccactgagtccacctcaccccccactttccctagtttcttctttgatgcaatacaagcaaatgacttttaaacctagctatttgaagagagatttcgatgggcgatttagggtcagtggacataaggtcaggtagttgttgaggctggtgggactataagggactggatttccacaggcaaggatgtgaggcgccccacagattgtaggatagctgcctgctctgttttttcctacatcacaatttatttggtcaggggcagctgctcataaaaatgaaacatattttctttagccacatctgtctatagtgcacggttgccaaaagtttgaagctaccttttctatgcatttctaatatgccagaaaccagatgggattttctgtaattgcaatcatttatattgttctctagatttagaattcctatgtgaacaggattgtcaattaaaccatctctgcaattaaaataaaagtgatacccactacgcctaagcccatacacacacacacatatacacactgacaaaagacatacacataaagacacactgacacaacaactgttgtcactgacctaggtctgtaccctaggattagtagactcttatttgatttctggctttactccttggtatgtgtggctttggaaaaagcaaattaacatctctgggcctcagttgcctcatatgtaagcaatgtgccaatgttaaataacaaagtgaaataaattatgtgatcctcctaaaaacattaaatagtaatattatcttaactatactctttacctctttatatacacatatgtaatgtacatatattcaacactattttacttatctaatcatgacatatgatctctatcttctatatcacaattagaaccatgtgccctttcctgtgtgatatttgtcataaggttcccctcgtatttctttctgttcttttgaattcttcacctttccagttgtcagatctatgcataggctctcaagatactcatctcaggggaaatttttattgattaggtgcagttgggaatttgtctctatcttcatttgatccttacctaaggagaaaagaccccatgaccctgcagaggacagacactactgtgggcatgttatccttcatcctcaatagggcaggctatgccagtggcgtggggcagcctgacctgtccatctgtaagtaaatgccactagtgtgaacccttctaaccccaccttaccacaccctgggaccatctgttaccatctgttaccagcacatctttgatctcctcctgaggagtctctgtttttcttgctgccattgtcaaacttttctcttagatcatagattccttaaagattgtgaatgtaggatacatttttctattgcctccccagcaagcacaatgaaaaggtgagtgtgtgatacacagagttgaacgaatggaaaagagatgacattgagcatccctcagaagttccctggcatagatctctcactgcctcaaagctcctattacctattataattcaagtactatttcagatggggcaccctaccagctttaatgctgctgcaaattccacagtggaggacagggatctgaaggacaagctcatgtgttttgtggaggattaaggtcatgagcagttaggatcttgagacccctggctttcttgactaaggcagggtgttgcgagagattggatatcatgaaagcaatgacaagagtttgggttccttagagggagtggccaaagatgtatagatagaaaggcaccaaaatcaaaccttgttacatttctaaacataactttgtgtgatttcctgcaaatcacagatgctccttgacttatgatggtattacatcctgataagcccattgtaagttgaaagtactataaatcaaaaatgtgttgaatacacctaacctgccaaacatcatagcttcatagcttagcctagcctgccttaaatatgctcagaaattttacattagcccacagctggccaaaatcacctaacacaaagcctatttgagaataaagtgctgaatatttcatgtaatttattgaatactgtactgaaagtgagaaacagaatggttatgtgtactcgaagtccagtttcttctgaatgtgtatatcttaagtcaaactgttgtatgtcggggactgcctgtatttcttaaacttcccaagagttcttactgacaggcctaacatgccagtgttgattaagtaggctttttgctagtttcagaggaaaataaatgtgtaaaactataagtaagaacccagttgaccaaattgagcagtagcaagtttcttgaatggcagaaaaggtgactgtgtgattatgactgaacaactcaaagaaccctggacctccctttaattccgctggctgggagggaaacatagtgaagattcatgctgcattggttttcttttttcttgttaaatggatttttgttggttgtcttagatacaattatttgatttagcttggaaagttactcaggatctaaagagaaaagtttccggagagaattggtgtatttttaatgagtttttactagggaaacaatgtaaaattataatggaaacctactgggaattttcccacactcccatcactttatcaaatttgccatcacatgtctttttatattatagacttttatcctatacataacaaactcctacatgttatagagatatttttgatccagtcttgtaatctaaattttcaattttatattggatttaaaaaaaatctttttctcttcccattgtatctgtagcccttcccttatcttctcttaattctggcaagtctaaaaaatacatcatcagcgtggtgttatccccaatctattggttacttttgtttataatgttgctttgttttaaattctttaatgttttgaggaaaactaacagggcttaatacatatattctgcaataaaggcaggatcaatcaactacttaagtaaatctagcagttgttcattatatactattacatcataattaacttgtgagtgtgtaagaacatgctatgggctgaaaaaaattatttatatctgtgcccacagaagtttatagtcaagttgaggtgttggggcatactcacatgattctataactaacaggaactaatcatatataacagcaagctaagctgaaataatagcatgccaaattgtgagatgcagagactgataggacaaggaagcacatactatacacgatgtgctaattgtgaagttcagatccatgcagaaagagagagagtgcaagagtgccctgcagccttcttgtatcatcagggaaggagtctcagaagagcggctgataggggctgctgccctggcagcattcagagaggagcaggaatggatttccagtcactattggaaatgatctatgagctatactgggctgtttggtggaatgtgcttgtctcatgccctcttagagctatagctcaccacggccatggctctgagagtttgtgccagccctgagagaacacattagggaagaaagaataaatctctgtagaacaagacattcttgtgtttttacatttttactagctagagaaaaaatggatagtaaacaagaaataatggaaaatgatattgtacaaaccaaagaagagagaccatttcactatatatatatcacagagaatgtgaagggtgtgtgcatgtatagatttaaaatcctgataataaatttataaacctgtcataagcaagggatatcatttgttgctatcaggaagactagagactcctgttaggaaacaaacagagttaatttccatctctagcatgctgcttactaggtatgggtctgggagcaaggtcaatttcatcctctgtggaatgagagcttttgtgtcttcttcataagatttgaagggagacagagtacaaacagatgctagtttgtcctgttttcctttaaaaaaaaattctaatcccaaacatgtttatttttgaaggtgactttgagcttgtgttaagtagcactaaaaagtctagtctagccatcagttgcccttgaagaacggccttaaggtcaactcattggttgaaaaaaattggccttcggagtgaaactatcatgtgatagtttgggaatccgaaagaatcacaggactagtatggagacagtacactctccagttatcatttgagggatatgagcactctttatttcttaaacactcagaggaagtactcttagaccattacagtattgatcataatggtagatttcatgaaatgtgaaaacccattgtctttttcatggagtatctttttatagttggctgggagctaatgcattgtgtgtatctgccaatgagagttgttttagttttctctgcagccttaacaaattatcatgatgttagcagtttaaaataacacccatttgttatataacagttatgtaggtcagaagtctcagtagagcatggctccattgagtcttgtttagcatctcataaggctctggggatgaatcaatcctaagcctgtttaagttgttgcatgaattctcttcctggagctgttgtcctgaggtccccatttctttgctgcctattagccagcagttgttcctagaggttgttcctgtaggttgtctacatcccttttcgtgctttccacatgacctctctggcaacaatggacgcagtccctcctgtgcttccaatccttacatttgtgccctgtttctctaatcccaggcagagaaagttctcactttaatggcccatatggtttggaatttgcccacttgaataatctagaataaccccattattttaaggcatttaatcttaattacatatgtaaagtacctttgccatgaagtgtaactttcacaggtttcggaaattagggtgtggacatctgtagggggccattctgccccctgttaaaagctattactctgctatcagttttttaaggtattttgtcctcctcaaaatcactttttaaatttcaattccatgagcttggcgaccctgccatctaatatacccaaaatataactctcagagggttagttcctgatattccggtgacactgctttgcctcaaatatacacttattcgttatcatggattgcctcttaacatgagtactgagtattttcccccatccctgttacatttcttagttgtaggatctattttctagattatcaaattaaaagaaagtggtttttattgataactatgcttcattacacttgaatacttgtctgtgaatattatatgggacaatgatcaggaaagtagttaaaaatatatttgaccacatttcctggtagtgatgtgggaaaatgtagatgctgaaccatctgttgtcatttggtaggattcagctggcatgaggctcaggctggctgataagagaccattactgacatgggtactctgagacccttcctcatatgggtgcaaacaatggctcctgggatgtgggtgaactcctaaaggaccaagagacaaaagcctacatcctcaggtgttgattctttttttttccccctagtatttacttcctttaagtgtaggaagataaattgaggaaaatcacacattattactgtaagattgtaaaatccttgttcttcaggctgtttttctcttcttcattcctttggcttacttgtccttcagccatttcactgctaatataatttctaccagcaagtgaacggtggcagagaaatgacagttatatcttactctaattatcagcctgatatacggtttggagaatgagatggtgaaaaccaggggccagaagagtgggctctttagtcatcattacttgtctccaggatcccagtaacaatccaagtagcctatagatggcctttactataaagacctgggcatacttagaatccaagtgggcactgttggagcttacctagataatcctttccttattttacaagatgaaaaacctggacctagaaaggtttatgagctgtcacagcccagagaagcctaaagaaacaaggaaaataaatgaacagtgatatcctggatagaattctgggacagaaaaaggaaaaaaaaatgatgaaatctgaaaaaaataaaatggagtttagtaaataatagggaaaataaaggaagtcctaccctgggacctgcccattgaaaggatgcccactctgggtaccctcaagttgctagtgtctgcatgactcttccagcacttcctgtttccattgtcctaacctgggttctccttttcttgctgaacttatttgcctgtgcctgtccctgttcctagtttcaggaagggcttccacactgcagaactccaagggcaccattatcatcatgttctttgtcaatgacatccactggagatgtgcagtccaggcagtactccttgggtaaaagtttctgcctctggactagatgtctgtagcagaacctggcagcctactgcctagacccatcctcttccagtctctctcatgtcccaggttctgcctggagaaaaactatatgacatcaggaatgcttttacttctctgtgcctatttccttctaatacttttcctctgttaattaaaaaaattcaaaaatcataagaggccatcaaatgcttctacacatttggccaactaataatggtcttctgcatgggcacagaacacaaacaccatgtacatttcctcatacgatatttagaaaattgcccctgtgatcctcattcatatgtatggttctccattctgtcctcagaatttgttactgaaagttgcattggtcagtatgaataaactaagaccagaatgcaaatccactgtattttctccgtacgggcttcccaccagcttatgtctggccaggttttgaacagttgcagagaaagtgtgcttactgtaacagagtggctaggtggggaggaaagcacctgatggatcatcatttgcatcttcatatgccctttgtgctccaggatgccttatttcccactaataaatcaccataagcttgaggcctttgtcttgacaacatcattttctctcagtccaagagcatttcatggtcttggtgatatatgatgagacttcgtactcatgtggattcctgtgtaaagaatttctctttattggattttttccctttgaaatttagccaaaatttaatgagaaaaaattatccattatgggggttttgcttttaaagcaaatatgactgtccagttgcaggtgtcttataggtgctatctgctttcagttaagagcaatttagatatcagattagaaacccttcccgttgactgacatcttacaaatgaaatctgcagcctcttgaacttaattatatcttcatgaatattgtaaggcttcaaaacttggctgtggttttgaaactcagccagggaggtattaatggtgttataatttgtatttatgtaatgttctttcttccagctggttcaaagtacctaacgcattgtttcagtctctctacatagactgaaaacctcactgtacccatttataaatagggaccctaagggtcaacgaagtgacacaaattagtaaagtccacataaaactctaggaggtttctttgtgctctgaatgcctccctaggaaagttgtgttcactgttgagatgtgttttatttatatcacattgtgctaaatacacattcagtctcaacttctgcttcagccatcaatcccagctcctgttccccttttctctttctttgcccacccacttgatttccatcaataacttcttcctactccaagtcctagaacatcatttttaatctttaaagttcaagacactttcccagggcccccaaaatggtaatttttttaatgtgtaggtctatgatgagcccggaaatctccattttaacagatacattaaaagagtacaatgcttataattttttaaatacctcatgacatggtttggctgtgtccccacccaaatttcatcctgaattgtagctcccataatccccacgtgtccaggaagagacctggtgggaggtaattgaatcatgggggcagatttttcccatattgttctggtgatagtgaacaagcctcaagagatctgatggttttacagagggcagttcccctgcacatgatctcctgcctgtgtccatgtaagatgtgcctttgctcctccttcaccttctgccttgattgtaaggcctcctcagccatgtggaactgtaaatccattaaacctctttttctttataaattacccagtcttgggtatgtctctataggagcttaagaatggactaatacacctcacaatcagtttggatgtggagtgggagagttggaaagagtgttagtatcttgagcctgagcattatggtgtagtagaatctaggccatccattctttcttaaattgagttctcaagaagcagagccagaggcagagattcctttgctaatgatttgttgaggcgtgctgtcaagaggagaggaagtaagctaagactggggagtaagttaagtaatgtctcagctggagagaagctgcaatctgattccaggaaatcctctgaaacacagattgactgagagttagcaaggggtccaggcttttgaactccactatccatcattggttgagttctggcatacagcaaacgatgggggaacagagtcttcctgatgaggcatttcctgttcgcctgagagcaattcctcacagaagatggcagctgtgggttgattttagcaacactccatcagctgtgctgtgagtgttctagttgaaaaggtggtctaggctggtcaccaaaagtattggctacatctctccactcaacaagagttacctttgctcctcgccttgacctcctggcttttccctttctccagtattggcaactcttctgatttgatgccaagacacagtcccatcttgaacccagttccagtacccgactctgtatatttttgtgcctgagtccctgtcttggtagcttctatgataccacaactaattaaaaacttgttctgaataatgcttttcctaaagagtgatgtcctgccctggggcctgccattgaaaggttgcccactctgggtaccctcaggtgtttgtgtctgcatgactcttcctttacttcctgtttccaaggtcccaacctggtttttcgctttcttgctgaacttatttgcctgtccctcttcctggtttcaggaagggcttccacaccacagaactccaagggcaccattatcatcatgttttctgtggatggtgatggtgacctctggagatgtggagatgtgcggtacagcagtccaggcagtactccttgggcaagtgtctgcctcaggactacacttctgaagcagaacctggcagcccactgcccagacccagcctctcccagtctctctcatgtcccaggttctgcctggtgataatccatataaattcaggaatgcttttacttctctgtgcctgtttctttgtaatacttttccacttttaattttttaaaaaattggaaaatcacaagaggctatcaaatgcttttacatatttggccaactaataatgaaattaaatgtttcaatcaaatcacttgggggatatattcctaaaacgttctttggacagagtaaacaaaggaactaaactatatatggaaagtaagggatagggatattaagccagcttcctagtctctgggattgctgcctgcacacgacttggccttctcatgaaattcagggtctgtgtgctgtggcagaaattcaaaaagcgctgcttccagcttcttccctgccaggaaatctctcttctaaagatacagcacaatgatgtacttggtgaatcagactcaaattttgtgtttatttacaggaaattaacaaaagtgaaaaaattataacgacttgaaaatactataataaatgttatcattataattttaaaataatgaggccacaaacaggaatacacaattcccccaaaagaaaatgatttacttcccctagtaactaaagaaaacaaaaagaataattttgcacttgtcaaactggcatatattatacaaaatgatagtatctactgctggtcaggatgtggtaaaatgggtgctcagatatgcagctgatggtaaaatacatgctatgatttttcctggggggaaattttccaatatggatcaagagtctaaagaaacgtcttaatcgaacaattttactgcaaatgattcataccaaggaaatgatcacgttatgcaatgctagaaatatttgtgtgcaaacaggaaaaataaaaacttcctatattcctaatctccaacaggtcaaatattagataaatgctaatatatttttaccacgaattataatggctccattttactgggctatggcaggtatgctatgaatcggctttttcaatggtgatataatccaggctcaaaggttcctaagactggcatggaaaagacagagcagggttgaagttacttgcatctaacaagctcagccccaacaagtcctctatgtggtctatcttatcccgtttgaattctgaatttggtttggggcccaagccccagctaaaaagagagtgttaactttgctttctttgcctccacagttcacacatccttctcagggcctcttgcatgtctatggcttagagtaggactcatgagcttatgtatgtttaaaatagtcactgtggactgaacaccatctagcagataaggccttcaaagaaatgatagtccactgagcctgtctatgctaaacgtctataggagctccctttgacttattgcttcaaatctaaagccctctgatttgttaaagttcaataaatatctgttattattccctggcttcctgcagtggaatgttatgggggtacaagttatagaagcccagagtagctctttattaaccaagttcataaaggcttggatctgccctgccccctccacactcggtatctcctctctgtttgcaccactatcaataccaatgctacttagcagccccttcctccttcttctcttctctactctgtgtcttattcttgcttaatagccatcttatgcccagcctcctccataaatcttccctgggatgccacagtgactgcagcatttcttaaatccttgtccttatagttggacccacaaagtttgactgtattctatacaaacagcacagagttagacatatgaaacatactccatgaacagctaagtaggcaattttccaaatggaaatgcaatcactgtggtattaaattcttgttctcttgaataacttcaaagaatgaactggcattctcattttaattttattctagaagcaagtaaaaattcctattatatcaggtgctgacattttcatcccatcaaataactgaatggacatgagcattcaacaattcccttccacccaaactcaattcacaaccttaacatggaacataatttttgctctatgtttaagggacttgaagaacatctcatagtttcagactaaaataataatctgaacttttccctttcattttttccatttatacacactcattttatttccacagacattaagagctctgaatttgactaatatactaaatagacacctcatttatattacagcttttattcaataatcttgagtgatagcttatagtcatcatatcaggttttcttttgaatattcttaaatgtattgtagtcaccatcaataataatcatgcttcagttagatcatcatcctattgctgagttatcagtcattcactataagaataattgagataatatgaaagacaattgtctaaataacttattactgcatgaaaataagcaaagtgcgctgatatcacagagtctactctgacaatacaaagaaggttttgcaaattggtggcaggaataggggaagtgctgtgctggatttctggcagcacgctagccctcagctatcctttcccttaacatcataagctacgttgggcttctgtaacttgtaccaccataacattccactgtgggaagccagggaccatggaaacccattaaactgcaacatcccttggcacacaaaataggcttttcctccttaatgaacacagtttgaaaacaatccaccaaggaattttgtatgctgtttcagtttacattagcagttgcagacgtacctggtgactatgactcagcagtcgttgaggcataaggaaatcatttctgccttcactttagattctgtgagctttcagggggcactactgaaaaatcaatgccaggtatgtacttagagaagcttctgttaatggttttcctgttgacctagcccatagaagaatctgtcatatttaattagtgtggcagtatcatgctgatcaatcttttccctggtttttctttcttaactatttctgagcatatacagaattaatacacctatcttggtactagtgcccatttttcagcaaactagtctctgcaatgactttcttgtcccttgttgaagggtaatctctgctgctgcatttttgtttttgtttctagctgtgtaagaaattagtgcaagggccataccaccctgaatgctcccgatctcgtctgatctcagaagctagacagagtcaggcatggttagtacttggatgagagaaatcagagcatgggaccaaagccatatttcttttttttgttttttgttttttttgagacaaagtctcactctgttgcccaagctggagtgcagtggtatgatatcagctcactgcaacctccacctcccgggttcaagcgattctcctgcctcagcctcccaagcagctgggactacaggcatgcaccactacacccagctaatttttgtatatttattagagacagggtttcagtatgttggccaggctggtcttgaactcctgacctcgtgatctgcctgcctcagcctcccaaagtgctgggattgcaggcgtgagccaccgcgccctgccccaaagccacatttctaacctcactcgtagcttagcatgtcctcttattgagaaggttgcctctttctgtgttcagttcagttggaggatgctacaaaacaacaggccccaaaatagtagggtcctctgaatgcacacattctagtatttaacccaaagcatgtgcaaacccacatgcatgcacacacatggtgagagagttctgctgtactaccactgcattttgtacccagaaccaggactgccctcaactaacacaggctttggtgtaaatctagtacctcagtctagattcttcctttatgttgagttaaaggtatccattgctcattccttcaatctagccttggttaggtatgactaactatggtctatttttcctgttttcttggttttggttagaaaaaccaagtggttagcagtatgttaagatttctgtctccctccctctctctagaattggctccttgtttatgcagttttgagaatcaaatacatacagcgaagcggtagagggaccactcctatttcatctaaattccaagctctagttgaagatgtttttcttgtaatattataaaataatatacttttggcataaaaatgaacatggaataagtgtagacaaataagcacctgaccacgtttgtgtttgtctcatatattctcatctcaaaataactagaaaccatcagggagaatcttgatatgttgcccaattagtattttggtaggactgaatcccacgatgaagacatcatccgaaaagggaataacacatgactctctagaaagcaaagttccccaaagcactaagaaagttccacagtcaacagaaacattggcccagagatgctaaactccgtatgttcctcaatcacatttctgatgagtgtgttttggtaagcttgtgcaaggtcactttgcaaagacctaaccccaacggtgcagccagtcttaacgagaagccttataggcatgggcgctgcttctctgagacaattccttgtggcaccttagagcttctttaaagtttgttatcattatttgggctctaaactaatattaacaaccatgactgtatgcctgcctcaagggccactcatttaattagagtcttaagttaaccttttttgtgtatttacccctagaagagaaggtgcacttgaaactttttaagtgcatgaacaatgactatgtcagaagaaatgaccatgtaacagtctgggaactcagacaaaaccttagggaatcagttaatagtttattgtggcggtgttggtctgagggttttagaatctataatactgacttttagtggtgagcttctttccaaattagttttgcctgttgatttttaacctcctctatgcagtgatgaacaaagcatctatataaagagctatgcaaaaatttggtctctgtattaacatcattcatgtgaaataaatcatggcaacattacatgtgataaaatgtggaaggtctctttatagattatatattgtctgcaatcagggacaaattttattttgtacacacaaacatttgttaatattgtgacaaatatcacatcttcccattagcttgctgagtgtaatgttactctgggacagtaactaagcaagagacagaagtatcttgtacttaagagtaagagttgcagagtcaggcaggctgggtgttaatctagtgacctccacatccacatccagctgtgtgatcttggacaagttatttgacccactagtctttagattgttcatcaataagttgaggttagtcctatcaaccgtttcataagtccttgtgagatgaatagaacagcacatgtaaagcacctaatggagctcctatcacagagcaaacctttaatcacattatcatttatttcctgacactaggtcagatgttagactagttcttggacatattttaaaactaaagtttgcattttagaatactgttaaagaaaagttgcaaagatagcacagagttcttgtatatcccacatctagctttctctattattaatgtcttatattgctacgtaacatttgtcatagttaatgaaccaacattaatgcattattattaactaaactctattttttttcagatttcatcttttttttttcctttttctgtcccagaattctatccaggatatcacatttcatttattttccttgtttccttaggcttccctgggctgtgacagtcctcagcctttccttgtttttgatatctttgacagtttgtagaggtactggtcaggtattttgtagaatgtccctaagtttgactttggctaacttatttctcatagttcagttgggattagggagaggaaggccaaaagaaaaagcgacattctcaaatatatatgatcaatttatcagtgatgatgttaacattgatcactcagctaaggtcgtgtttaccagacttaccataaacttactttttatggctttttaaaaaaatgctatgctctttgaaagctactcactcagtgtacgacccacttaaagaatggggaattatgtttcaccttgctgagaacagagtatctacataaattatttgaaattctcctgtgtagatttgtcttttctctctcatttgttttttacttaatcatttatttatatcagcatgggtatttattttataccctggattataatccactatcatcctttttattttgttactcaattttttctgtctctgatggttggaagtctttcagttggctcttgtgtccctttgacatatctccattttttattgttgttgttgttgtttttatttattattattattattattattattgagatggagtctttctctgttgcccaggctggaatgcagtggcacaatctctgctcactgcatcctctgcctgcctcccggattcaagcgatttctggctaaaaacattgttttgtttactttctggcactaccaagtgctctaggctcatcttgtatatttccttcacctgcactacacatgattttttttccccaaaaagtcctgatcccttttattgaagaattgtattagaaaccaagatctgggcattgggtgtgcttactgctattggagtgttgttgattcggtgaaaagagctaggtatatacgtatgccagaccacatgtaaacatgtatctgtaatcatttctgtataagtttatcagtttatataccaaactaaatttaaattcatgctgatgtttccaacaaccctttccctgtaccacatggtttattctagctttctccttttgcgtatttgtaacctcccaacccaacaatgataaaatgctgacttctaccacctgctattcatttatttgttcagtcttggtatacgtgtgtgtagctatttgaaaattattaacgcataccccatgagagacaactttactatctatagtgcagtgcttatatgtcattcctgagtgtcattttaatagatttcgctcagactgtgacctctcaaggtgatccttcttattgtagaatctgtatttgtcgttcttgtttctgtaaatatgccctttacaacctgagcagagtggctgatgtatccagatagatttgcattaagtctggaccctgcatttgttttatcaacagatgttactaagacctccttgcctgtgtgctcttgataacattaatcttcctaaattctgggatagatattgactaaagtttcactagccatgagtttttattaggccctcgggaattctaaatttgactttttgaagagatgctattgggagacaccatataaaaggcaacattaaagaaatcctcacaattacgacactgagacagagtgtcattatttaactgggctgataagtctacataaagtaccaactaatagaagaaatgaactttaaacaaaaatccacagtatatctttttcgtttttcttttcttttttttctttcttttttttgagacggagtttcactcttgttgcccaggctggagtgcaatggcatgatctcggctcaccacagcctccacgtcccaggttcaagcgattctcctgcctcagcctccctagtagctgggattccaggcatgccccaatatgcctgacaaattttgtatttttagtagagacagagtttctccttgttggtcaggctggtctcaaactcttgatctcaggtgatccaccctcctcagcctcccaaagtgctgggattacaggcgtaagccaccaagcccagccaaaatccacagtatatcttattcccatgtgttgctaatactgtagtaaaccttatggcctatatttaaatcacaaagtctgttcagaacatggcaggcttctgttccttgcttccatttcatctacttggcatattaattctaggaaaacagctgaaggatactctttaatatgtcctaaaatagactttttaagtgcaacatcttgtcaagttatagatattttgttgcattcatttagagtcagtcataaaagtggatttacaatgttaatgccatataacatttatggttttgttttgtaataagcaagacctcatattggttaccagaagatgttacattagaccctaataaaacaggtcagaaataagtagagcttttacaataactcttgtatttcactctgtattttccctttgtgttattagctcagcctaaatcactgcagcatgaaaatagagatactcagaaaggacataccattgcttgggattcaaagaggaccataatagcataaactttgaagctttcttacatatctaaaggaaagcatccttcctatcacccataaataaatagaggtggtgctatgagcatagatctgccttctgccttcttagagtgtgggagaggccaagaggaataggcttggcaaggattctgacccagcaggttgttgagtaaggaattggttctgatggattcttacaacagtctaacttcccacactggctaaagcagtcagctctctgtagcatactctgtctctgtgattacctgccaaatgcctactgcagacctgcaaagattagttacttcgggggagtggtttattactccacaacactgttttgagccaggtcaataataacagcaaaggcacacagcaagcagcccttgtttcctctcttatagaaacaaagagccccacaattcaactgttactgattgatcctcggcatcactttaacacccttgtgattgcccttatttgttttccagatacaccataattttttgaaatatgaatcagctaaatgcaattgtattttcagagaatcaagatctaccataccttattgtcaatttgcaaagagcctgctgtttatgtgtcatgcacatgagaaatttctgttttaacaatagattggaatgatgcatttagaaaagtatctgtattgtttgcacatgtaaagcccaggtggggttaagcaatagaaattcaactaataataaccgtgataataacatgtgcttgattaaatgatcttttctttcttctcttctatcctacatagcagttaatttacattttaataaactgaatagaaaataatggatttgttatatttttctatgatgtcagcagagataaccctttagggaaagagtaaaatatagtgtcagaggaaacaattcccaggtcctagacttgggcacaggcaaggctagacagttctgaatcttatctcaaattctccctggaagagcataaagaaactttagcagccaggcctccaagcaaaattgagggcactttatccctttgaggtcattatttaaaaaatgacctgattaatcttccttcaataaatctaagactcaggcaatttaaaggaatctgaatttcattttctttgctcgatatgttaacaatataaaataattacagccctttctattttgatctgaattgagattgtatcaaattaggtattgaatatataattctgtcaggcaaaaataagcagtggagagctacaaatgtcgagaaatcagaagaatattttctccagggggagtcacatttaccattgcttccccgaatgcttccttgctttatgaggagatagaataacgcggtgtttgttcttttaatttgaagttaatgacaagaatttagatttgaaaaggtaccactgtacctacgtgcatagtgatggggttgcattaatgaactcaaacaggcatcaacaaatgtactttattggagctaaacattctttcaatatttttcaattctgaacattcaaactggcacaatattactaacaactcagaacaaacaaacattaagctaataatttttgctaacaaatgtcctgttgtctgtaatgggactgctccactagttgggtaggactgctgctgcgtgcatgcacagtgctgcctaatagggagtgcctgcatatgaattcctcatctgtccttgctgactctgtgaccttgaacttaggactcctgattttagtgggccagccaatgtatttcattctcaaatttagatccgaataagaagtagacctaggaatatacttgtgagtgcacatagaacattcaaaggaatttataaaaaattagaattaatatgtacatttagcaagcttgcaggatacaaagttagtatgcaaatatcaccagtattcctgtatactagcaacaaacaattaaaaaataaaaatatgccaattgtagtagtatcagaaaaatcaaacacatggattctgcacactgaaagataaaaaaaattgctgggataaattaagaaaactaaataaatgaacactttcttctagaaatgctccataccatgacctgggcagcagttacatgaatgtgtacatatgtaaaaagtttttgacctataaagatttctgcactttactatatgtgatttatacttcagtgaaaaacaaaactaactgataaacaaaagacatactggatcgggaacatggttttgatatgtgcccacaatggagagcctgcgtgctgctgcactcaggtagccgtttatagcccttgttgagctttcacaataagaacatgattactatttagaaccaaggcagctattttcataacccactgtgaagcagttaggcaggtattcttttgaaagtaaataaacacagtcaactacaattatttggttccatttagcatattacaaaaagtaatggtttaatgatatcctagtggtcccaaataaagtaccacagaaaatgatcataaaatttccttctcactaataactctgagacaagtgttatgaaaaggcactaaaccccaggaagccaaagtgttttcaccttcccaccaggtgacaatgttattagtttataattctctatttactagccatgaaaatataggagctttagaggacagggcagcctataatagattttgtttgttcaataatagatccttacaacattatctagacagttgctgtagtaaaggaaatggccctataaaagccacatgactttccaactttatgtcacatgttcctgcatgctagtttattagacttggggccagcagggctgagactgaggtagtagctgaagagagttcttcctgacagtaggaccctcctgggtgtacagagcccaggggactggcagagtaagagagcataggtactcacttcagatggacacaaacacacaaactctgtgtttattttggaaagaggtgtgagctattacattgcaaatattccccaggagcatgtatctagcctcccggctctctatatgacactgacagaatgggcttctttgtcatcatttgctgttggtagattgggtgccagtacttgtagtcagggagacagctgtgcacatctggaatgatcccagagagaagtcctaaaccaggcttgacaatggtgccagggcactgaaggatgccctgtcctctgtcaccagaaaagcttctcctctgtagatttctatacctgcccctgcattgccactaagtgtgacaggaagaacaaggagtgaggaggcatttggatccaggttataccacatgctttcctcacctgtaaaatagtgagactaatgtttagttggcaggattatagtaagcattatagctcatttattaagtattgtatataacaaacaagaagtggtagctattattattattattattattattattattattattattgagacggagtctcgttttgtagcccaggctggaatgcagtggcgcgatctcggctcactacaagctccacctcccgggttcacgccattctcctgcctcagcctccagagtagctgggactacaggcgcctgccaccatgcccggctatttttttttttttattttttttttatttttagtagatacggggtttcactgtgtttgccaggatggtctcgatctcctgacctcatgatccgtccgcctcagcctcccaaagtgctgggattacaggcgtgagccaccacgcccggccgtattagtattattgtagatatgaagctattgcctttactttaaatgctctttcccaaatatttgcctgattcactccctattcttcttcaattattcactcaatgctcctctttttagtgaggtctactctaaccaatcgacatgatactgtctcaacatacccactttttctttcctgttctcttgtatttttttctgtaacactgatttgattgtaattattacataattttcttagttgtgttaatttttagaaattttctatagccttttacaagaatttaagtccggagacatcaggtattcttgtatgttttgtctacataataccccattgaaaaaagcagtgccagatgtatcataggtatgaataaatatttgtcaaatccttaaaaaattacataactgtgaaattagttaaaaaataatgacattctactgactattgtttgtatatacatatgtatacatctatgtacatatatttacgtgtgtctatacatacatatttttatgttaatcttacccttaataacctcagaagataagacacagttagaaggcacctgacttaagagagatgacacaattttcctggtttgccttatttacacctgtgttctcaaaataattgttgctaacactaactttctctctaaaaaaacgacccaagtcataagttctatgatcaccctaaatgaggatcaaaaggaaaagactgatctcacagatatccaagaacagttcctgtctcagtgctgatgaatgaagtatccactagacaaccactggcactggcttaagaaatttgtactggggacaccaacataattttttatctatgtaaaataaatcttaaatagtagttataaaaacaagaagagcaaactcagtgtccataaggcttgtgtctaacagataatttttcatttggtaaagaacattgtgtatttattctgatatttttctacagtttgaccctgttgttggttgtaatgactgcaactttgggtgatggttttagtattgacaggacactttaaggggctgctgtcttcaaggttattttgccactcaatttttgtgtttttttttttctttaactcttggtaatttctatgattctagtagctttaatatttagcatttggggttctaggcgagcctataagggcttgtttaagagttatcaggcagatggcacaaatttacctcttttatggtcccagtaagttggagagggagagaaagaaaaccaacagtaagggccatgggttctgagtgacagacataagctactctgtttaaatgaatctgcaatttttggaaggaggatcttttctttcttatgtaactttctatacttattttgtgtggtttgattttaaaatgcccttcctctatcttactcctcatttcctcttggaaaatttcctttaaatcaggaaaatattgctttagcaaattacacttttaacaatgtcttatcttgcaaagctggaaaatggattaaaatctaatcttcttcccctttaacctagcctgggtattttatatgtcactctcagggtagatataaggatatccttttcaaacttttgactacatctaaataggcctttaaatagaactctttaaaaatgtccattttcatcccaagttcgatatcaaagtcaaaactctttaccgtttcttctaaagactcaaactgtctaacatcctaaatatttctctgctagtcttagcctgggaaccttagtgtccagtgacctatttaggttggaacaaagggcagctggcagggagtgtgaggagccccatgttgttctcaaccccatatgcagctaaattgctgactttcccaccttctagtacttcaaacacacatcacatcgaccccctactatcagtcaaatgagggaggaaatgctcactgcagagagaagcaaatttcaggaaccaactaaagtctctgaattatgccagtgatgttttccaaatatattttttgttttccaaacctcttacctttatttcagcaaacccagttggtcccaaaatttctcatccatatctaagtcctgaagtctaggcttccaatatggagcttatatctaacacaataccattcttgcaaacctgcttggcagtaggggagtttttgatcacctgtgacataggtagaaatgattgcagggtttttgaaattcacaggtaaaatctaaaggctaaaattaatgtgtagtgtgactcttccatcaagaaacattttacctgagtttccaataactagcaaatctgatttaaatatttcggccccatcaaccgtatataagaagagattcatactgaccagttctaactctggatttttgtggccctagaaatgaaaaaaaaatagtggaatcaccaaaagaaaataccatggtttagataatgcataaattgaattcctgtaaactgtagattgtcataaaggaatcaaaaaatgtttttccagtaccatgatataggaagatatttaatataagttcctgtgaacaaagagggagtaagagttatttccattactccttcaggatttctttacaatattcaaaagtcctttattttcgcctctgtggagtttgttttatatctcataaaaccattatcgaatagagagaataaaactgaataaatcatttgcaggtggaatctgctagagctagccacaagtacaaagcttgcacaggtgggcgtggcttctgccagtgtcattgctcattcccttcctctgagaacccccaaaagcatttgagaattaaacctgggagcctagtctttatcattgtgaccttggtagtgatctatttttattgttacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtaatcttttcagtaatcaatctaagtaaccttgtgagccttcctgtgccagacagatggcaactgtggcttcatctggttccatggtttctgggtgccatgaggatagatacaactaggtagcaaaaagtccagggataatatcagatgaaattaccaaagaccacaccactttttaagacattaaaatacttctttttcaacacccaatacccagtattctaccagtgccatcccctaactcacctatcacttgaccctttttccagaatgcttgggaccttcctgcaagcccaggaacctaaagaaattacacttggccagcagaaacctctcagaccttgccagcaccaggccagcatctttctgattgattgactatataccattctggttatgaaatattttgaatattacacctggttaaagagctcagtatgcaaagagaactaagtcctgcatatgtgtcccttctcctcaggctaacctatgtttgtgctaacatatgtcttggagcaagaaaggaaacaactttctttttgggattgagcccctatggcttattaatcaaacaaaaagcagatgaaaagtaaaccaaggtatatacataaaatcctctccaagccgttttacatacagtctgctctgcaatacttgttttgatactaccagttagctcaagcataattggtacataggaaattttgttagtatcaagaatagttgtgttcattcataaacagtttcttaggaaaggcataatcagaatggcagaagaattaacaccttcaggaagaaggaaaaaggccctcagcttggctaccactcagcaagcccagggtcttataggccctgtcacctgtcagtctacgatgtcccagacttagagctttttagaaaagcatatgctgtgttcaagtggaacatcaaatcatttaatcttcattgctgtaggtggatcattgtctttcttttacagataataaaactgggtatcagagaaactaaggaactcacctaatgtccacagattgcaagcggtggaggcaagtgctctcactctgaggcttctaatcttttacaacatcacactgccttttagcagatcctaaaattaggcaacgtggctggcaatcttcttttcggtttttgagaaagagtctcactctgttgcccaggctggagtgcagtagcacaatctcggctcactgcaatttctgtcccccagattcaagtgattcccctgtctcagcttcccaagtagctgggactacaggtgtgcaccaccacacctggttactttttttgtatttttagtagagatggggtttcaccgtgttggccaggctcatcttgaacttctgacctcaagtgatccacccaccttggcctcccaaagtgctgggattacaggcgtgagccactttgcccggcctggcaaccttcttaatgtcatttcagaagtactgtaagggactgtttgaccctaagtaagtctccatgtatctgtttgtgtcagcttgaagtcctgcacttagggagtaccttgtgagagctaagtggattctccctgttaaaatctgacagctctaggaaggataaacgatatcagtcattgtcagcaattaaaatgatcaatttatcagatttcttccaagctgctagttagatgggagcaggttttgactggaatgcgagtgaggtagatggaatgattcaggaactgggcatgtgaaaagcttcgaggaaatggtactaggagcaacaagtgagtctgaggttcagaacattgactacctgcctctgtaaaccctctttcatcctgtgtcccactggaccctaggctcaataagggtcagaattagaatgtaaaccttccttcatgattcccaaagataacatacaatgtgcctagcacaaggccagatgcatttttgacacttcatgtattcaagtttactcctcttctctctctacaagttatctaaaatgtcggtgcataattttagcttgtttcttctccatctttaattaaatattcaaatgttacttaagctttcccctgggtcttttcttagggatcatatccttctgcttgcaattggttggcataatccgttttcaatttctgtttcaaaaatctccctgtacttcctcctcctgtcataccatcgttcatgcttttggtccctcttgtaattatttcagttaatcatcacacaatgtaaactgaatgcattgagaggatgttgtaaatatgtaatttatagcataaaaattccaaaataaaaaccaacatgcctggaaggaaccctggggtcaaaggaaaagggcagtgttcagtaatacacacagtatgaggaaggcttcttaaaatgaagtcagtatttttccctggatatttttccatagtttttttcccagcttttgggactttttaaaaaaatgtgttttataccaaaatattgtgaattttttttgtttctaaatgctaatgaagtgtgaactgatttctcttatgaaaaagcaaatgaggaagctaaaataaaagtctttggaaactgatttaaaggaaaaagacattctagagccagcattgcagcaaagccttctttgtatgtgagaagctgtattaatgtaatctgaaataaaacacaaaaattcctggaaatgaaaatggaaattactcacatcaagcactcacaacagcacaacaggttctatagctctaatgaatctaaaatggaaagatatcagaggtgtagattagtgtcattgatcaacaggatgagtgtgagccagcagcccacagttaattctcacttggatatcactcagaaagatactctgaataactttctggtatgtctagcaactgggggctaataactctttatcagtcaaaagtcaacacagcaaagagatgaataatgtgctctgggtgtaccattctctcttctcattctaagtgcattttgtttacctggcaaaggagagctttctttactttcccagaataccttttcttttaggggacaactatttgtagaaattgcaagaatctggatgtggagaagccattagctaccctgtgggtgacagaatgcatttgcacattaagaacaagcagaaaacccaatcaactgacattccttgtctagattgaaaaacaaacaaacaaacaaaaaaactaggccagatacagccaatagatttcagatgccaacttagtttgattggctgtagcctcctggagtgttaggctgagagggattgtgaacatgagtcagtttagagagaaagaattgcaggaaggattaagcaggggcgtgtgagaggggcgagggatgaagagagctgatgaagaagagtatgtgttgattaattgccatttccttcagtcaagcacaaagagcaagaggccgtgactcatcttctagtccaggaggacgagcactttgcataggtactgcagaatagaatcccactttgcagaactagtaaggagcaaccaagcatgcagctttgggaaactgcagcattaattatagagtgaatagcaacatggaaaggagatgtaagaatgccagagttcccatgactgagatataaatggttatgccagtacaaagttgttctccagtattcgtatagtaatgaaaataaccagagtattttagggcattaatagtaatagaaatatgaatgaaatcatgctattgacttatagattgtcttccttcatttgggatgctgtagcaaaatatcataaactgtatggttcataaataacagaaatgtcttgcgcacagtcctggaggctggaaagtccaagaacaaggcaccaacagatttggtgtctagggaggacctgctttctggttcacaaatggcaccttttaattttgtccttgtgtggtggaagggggctagaaagctttttaaggctgcttttactaatctcattcatgagaactttgtcctcatggcctaatcacctcctgaaggcccttcctcctaataccatcaccttgggggttaggattttcagcatatgaatggaagggggtgaacataagcatttcgaccataggacatatgcatttgtcctgaatataaagcagttttttacatgtctatcttaataaatccccacaagaaccacgtgaggcttaaagagtttagtggcattcctaagtagtataatctactgttaaaatgttagaaaagagaccagcttgtacattctgatgttagatcttgcgttctttagattgcattgtagaatgtcctataccatatacatatatggtgtgtggtgtataacatgatgttttgatatactgtatgtatatagtaatgattactatagtgaagagttctaagtgcaggttttgccattgtgtagtgttccggcatttcaaattactgaaataactgataccagctatttggtttcaaaaatatttatcctaatcagggaagagattagtttaaatgtcagtgcacaagacattaaatcctcaacatccttagtaattaaagatgcctttctcagatttcttgctctattagcaccttaaaaacgttccagacttggtaaaactcatcccttttaatacagtgtaatgaaaatgacaacttaatgtgaaaaagaaatttggattaatcaaataaaaaattaatgttcttattgatacttattcaaagaataacttaataaaccataattggaaggacatgatcaacttagcaaacatagcattattttttggaggataagcagagagaaaagtacaagagtaatttaatttttagtgaatatggatgatacacagagattgaagaatggaatatacacatttgggataatcagaggaaacataagaaataagctaaaatattggcagtagctgatttaagatgattctagctttctcttgtttctattattatctacttaccaactttctttgttttctacattatgtctatattctataagacatgcacattgtgctctttgtaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggtaagccacaaatgcattcttgcatggtatctgtgaggaggttggctgcctggacattagtaaagaacaacacagacaattttaaaaacataactgtctagaaagggtgtgccaggcttacagttttggctcttgagtttaggtaaaactgaaaagacaaagattaggaaacagagtgagtaaactcttagaatatttgcatagtctttacttgaatcacaatgatggactggaatctttaacacaatcttggcaggaaacggatgagtaatcaaattttaaaaatcaaaaacagaagtaaatgtgaaaaccaaagtcaataatagtgcttagtcatagttctagctattgttaaagaaagcagaagctgaacaatgctaaataagcaaacaaccaaaataccagaagttgaaatagggtaacacagactgcttatcattttccgtttctctacctagtcctttgattcttttgaaactggcatttttttctacaaaagacagcgtccccactttctaactattttcaggagctatttggagggtgggtggggcaagtgagtaactatgacatcagtatatatagaaaatgacaacaaacaagcatcaaatcctcggcggggtgtgctaaagaggcttcttgatgaagaaagcatggaggcaacactctctgtatcccaggctatttaaaaccaaactgggggatgcgctaggaaatggagcataggggagggattgtgaatggcagggtatggattagatgacctaatagatctttcccatccctaattttctgtgattcatcttgaggcacagacaggctgtcacgtaaatgtctcacagcacagctggagctggggtagatcaggcgtgaggctctggctcctgccatgctgacatgccgctgtaccattctttgcttgggagctgcaaaaacacccatggaggagagatgctctgataagttcactgaagggtccccagggcaagaatccagtcatataatgctaagtttagacagaggctggacatgctttatctcaactgactaaagaaaatgcaggatctgcaacctgtaccagcttttggcagctgagaagagctatcctggtggactcaaattctcagtcactccagccacttggacaaagaaagaaacttctgagatgagtcatcctagttttaggtatcttgtgccttctctgcagaagttatattaaaaatatttgatagttgttatgacaaccagtccatcagcatagactccattctcatgctgtgacacagtactggaggcctcatgccatggctatggtaaatctttgagttggtggatcatgggaaggtttggccaatgtgttctacatggctggggtcatgtgggggattcaggagacatggagacactgctagcttccaagcagtgcagaagtatttcagtagtctaagaatgtgtaaaagtagtatgtatgggctgattcctgactaggtggaatacttccacatgaggctgctgatgatataaggtatgttctctgaaatccacaggccccacatttctccttgcctgttatcatgagatgccagaccaaggcattctggttgcatcatcttttctgaatagtgggaaaaaacaggattatctgtggactgaagtcataaggtggggagaggacagaagccctgagcacatgcacttctgccacccaaaggatgtcacatgttggctcaggctgcctctccagtgtgggtgtagcattgagtctattgtgcagacaattactgggaaacagtttttggaactgcaaagttcagttttgcaggttatatatggaaaaaataaaacctggcaggagaaaacaaattgttgcaaggatttgctgtcctcaagctccctttcacaattccttactgttactctgactgccaggtgaccatgaatggctgctcacataccacgtgtgctcccctttacaccttccagaggagaggcctttgttctccccagttcaggggcaaggctgtccgcatttgtccctgcacctagacactgaagtgtttctgccatcatgtttgtgctatgcccatgcgtgttatcgaaggagatcccagaagttgttgctgagccattacagagcattcactataaatgcaaagctcctgggggccaattttagaaaattgtataccctgcagaaggaaaatatgcatgctctcaataccaacctggaatggaggtgaggggggatgtttgttttgtttctcataagcaccttgggaggtatggaaacaaatgaaatttgagtcgtatttaccaaataatattatgcacattctaacatcactaatttgccacctaccaggcccaggatgcatacagccagatcagtagccactgtcaagatataagagaaacaggcagcttgcaaggtgattgtaggacatacacttgtattaactgggaaatacagcctttaggaaagggttattttaaatatcaaatccatttaaactgctaaaataataatttgatgtcttttctgataacccacagaactttcttaagatcatttcctttgaagtagtcaaaaatccagttttcttatgttattgatttttagaattataaatatatcttataaatataatatctcatggaagaagagaaaaatttttgtcataccacaaacacaggtgaataaaataatactttttattgttgtgtgtaaccttagggtccactcaggaaaaaaagagcccatgtcagatggtttactaggggaaatttaatagaagaaaatggtcacaaaagtaaaatggggtactgaggcaactcaaaggtgaccaacagcagcatctactcccactccagagctacagggaccaaaggaaacctcacagctactacctctgagctatccctgaagtgggagagtgagggcaccctggtttttctcttctgcctcccattagttgctcctattttaccaaacccatccagaagacagctggcaagagatcctggaaaatgtagttcacaagtatcttagctcaggttcccttgaactttaccaactatgcaaggattaattgctaatacattaatggaagattcaatcctagagaaacaagaataagggggaaagggaagtgaggtatggaaggatggggaaaagcaaaacaaacaaaacaaggtgacatgttattgagcaggagattgcttcactgagcataactaatcacgtggcctcaagaggtcactggataggctacttggactattggaggaaggatgggagaggaatgaaagtgttcacttcatcctatgttctgcttcgtgtggccaaagtttatgctcacaggaagttacaggcagctactgaggaagccagagcccaggacttgtaacacaacacttcttcagattctgaaagcaatgtgaggagtgagagcctaggtgggtctcctatggtctgacctgggtcctgctatggtgagtccaacaggggcagttctggagcccagagcctactcaaagggagagagagacagcaagagatgacagaagatgaacgagcagtgactgagactgcagtagcagtcataacagcaatgtctagaactctccgagtgctgatagccaagggcccaagacacaagtacagccaaagagagtctggggcaacagataaaatctgaacagtgttatgcaagcaaacatcaggggccttgtgtgtgtgctggtctcacatacagaacccactgctgttttccttgctgtagtgaaggacaggaaaggggtagaaaggggaggaaaggtaaaggaaaagaaaatgctggaaaggagaagggaagtaatggagatcagggactaacattggtcaagtatgttcataagcaagtacaatagatgatttacagacatcatttcaattactccttaaaaggacccttttaaagcaggtattatcatccccccattttatagacgagggaatctgagacccagagggattgagtcacttgcccctaagctctctcagctagaaagtgccaaagctgggcttggagccagctcaaagctgttatcatcccacggacacatgttgttcaactatctttcattatatgaactggcacatttccttcaaatgcatatttcaatttctaagcctttattttttcaatagctcacaataaaatcataagtaataatccacttttaaaatgccgagggaacagaatccagaattcagcaagcaatatttgtgaaggaggctggaagagtttaatagagactgagacattgacagagaagtgagggaaaggatactgaagattgatttcactggcctcctgttctttcttcccctctctcctctctctgctctcttctcctgctttctttttcgtcttaagtttgtatttgaattcttttctccaagacgttggttttgggttgggaggttgcagtaagagaatagaggtaaccttacctcttcttatcatcacccagccaatcatgacagaattctggagatattaggtgaatgtggcacacatcataaatgtttctcctcatttacacatgccctattgctgtaaagtggcaccttatttatatagaacaaagtccacttacacatatcttacacactgtagactttagaattaactgttttcatttatgaaataagacattccggccgggtgcggtggctcacgcctgtaatcccagcacttggggaggctgagacaggcagatcacgaggtcaggagatcgagacaatcctggctaacatggtgaaaccccatctctactaaaaatacaaaaagttagccaggtgtggtggcaggcgcctgtaatcacagctactcaggaggctgaggcaggagaatggcatgaacctgggaggcagagcttgcagtgagccgagatagcgcctaggtgacagagcgagactccatctcaaaaaaaaaaaaaaaaaaaaaagacatttcatctgattttttggaattatctactagagacataaaattttcatcttaaaaggcattagaaatgtggccctaagaaaagaagactgcttaatttaaacctctagcgtgctccttgctcaattttagcttcttatatgactgattttttcatgggtgagcaaagaggccaaagagcagattcattgagaatcaaagcaaagggaacatgatcattctcattacgacctaagatacgcttaaaaatggatggaactaagagagtccactaagaaaccatttatatttggctggaattggaacgttaaatgtgcccaggtttgtgctgcaagcattattaaataatgctgctacaggagttcgtatctggcttttcctgttagtagatatagctacttgagacaaattgccagtggagaaaacttataatttctaataatatccttctttaaaaaaattaaattgctcatattaattttcagatcgacacctttcaccataggccattgattaaaatgtagccaagttatgttcggtcatgtctcttcaagcctctgcagagattggagttagggtctcagattccagagcatttgtcatcagcaacctaagatccttccttagctcccttattttaatatcatttccctcttcctctgtacattttcctgctattcaaagagctctctatatttacagttgcttagttaacctagcttctgcattactgggtaaaagatgctgtttatctggaagcttggatacccattcttgaccacaatagtcaagcaattagtacaaccctacctttcctgataataagaaaaggaatgtgataaggtgaaagttgatctctagaacgtaatataaaatctatgtgtatgtgtctatgtatgtgtatgtatgtatacatatgtgtgggtatattattaatatatttctactatgtgtaatcagtccttcctgttgctttatacagaaacagctacataaaataggtgtgttctcagctatttaaatggatgatgtcctcaaggagaaaaacaactttaataatgtgatagatgaaacttgtattctatggaaatcagctagatgaactttgaaaagccttatcatttccactttgcagtgatcgaaacattgcaacatgtttgtccaaatataggataacaaaaatatgctataacaccatttcctgataagagctaccactcaaaagatattgcccctctgttctcactggcagtggttggaaggttgaggaaatggcagcctaaaaaggcaggggaaaatgaggttgggaagaggatagacgacgcatccgcttctacctttcctattctcacactgaatccaagtagctcatctgctgatttgcttctaggtcacattgtaaatcatgctgggttgacgattttatactcaatttttccatctgcaattgctcccagttcagagtttaaagtgtgtcacattgtgactgtatttccttttacctctagctatttatttttgtttttaggggctacaccatagaatatagaaatagtttctttctcctccagtgcatgtgcttcaaaattgcttgtatgcatttgctttcctccacgacagtgtgaggaggaattttgtcttgaatatgatagcaagagaattgtttagaccgaaatctacctcaagtaaattatcctattctgcaaacaatcatcactatctgattactacctgattggcactggcatatcatgatcctgtccccatgacccactccagccagcccagctggctatagcttaatgagattattcctttttctttaactatttcatgcctactaacgtggattatctttgaacactttttacatctgtaatgagtatttttattcttgtccagctgtgtcttaaaattttgaccaaattaatgaatacctctcttttgttctcattttgaaacataaaagaaaatattaaaaaatagtacaatagttactcgcatatccaccaatctcattccagaattataaatcttttaccacatcacgcctctctctctctgtctgtctttctccctcttcttctattttttttttttttggaacaatttaaagggtagaaatatcatcaaattttataccttaatacctcagcttacatcttctaataaggacaattctcgtataattatcaaaccagctaagaaagttaacaataacatcttcagccgtaactgtcacatccacctcagcttttttccctctttgtgaatcaaaacaaactaaccatctaaatcatatagttaatgtaaccattttggcatccagtaaaacaatgattcagttcctccactgtgtaatatcttctcaattctactgcaaaatggcaagttctgagtacaaattgcccacaggcatatcaaagaatcttgtacttgagaagtctataattatgtaatgatgagatctgcctgtgctactaaaattttgaaaaggaattgaagtccaaacattgtctttagtgtcttgttgtgaatgtaaaaaaaaaaaatgaaattactgtagtatctttgaatgagggggaaactttgcaaacacagtcatagtgaaaaattccatggaaatatcattaatttatccacaaccactatgagtaatgcccacaccttcaccactcccactcagacctatatctgtgctgttctcttggtcactgaacttttttgttattacctcagatccagccccttcgtcactttcagggacagatccccatggagaaatgctgtgaatcatgggctattgggcagaacaggggacacagcaaggctgacatgtctttggtggcagtgatgtaagtgagccacatttgattttttaagtagacatttattaaagtataatatacacacagaaaagtagcggagggcagcacaagtatgaaaatgcagggtactcatcctacctagccttgctctagctgtcccctctgcctagaacactctttcaccagatagctacgccctttccctccctcaagattttacttaagtggcaacatcttagcgggaccttacctgaccaccatatgcaaaatggtaaccccgtatttcaggtgtcttcctatcaggacgaggaccagagtgaggcaggcacctatggtacagacttcaaggaggcggtcactctcaaggtcctgaaagctgggtgaggacttgcacgtccctgagggagaaagtctctttaaatttggtccctggacatttcccttgcctcatcttggtttctcccctgtgacctattcctctttcttgctttagtttttccaaagcctttttttgtagaatgacagctcctcaaaggtggggatagtatgttttgttcactgattattttgagctttgatacagtgcctgacacattgcatgtaggctaggcaatcaaatgcatatttcaaatgaatgaatgaatgaatgagtcaatgaatgactgaataaatatgctctccataggcatttttattgacacataataatcgtacatatttatgggatacacatgatattttaaaacatgcacacaatgtgtaatgatcaaatctgggtcagtgggatatccatctcctcaaatatttatcatttctttgtgtttgggaatattccaattgttctcttctagccattttaaaatatacaataaattattgttaactatagtccccctattgtgctatcaaacactagcatttattttttctatctaactgtatttttatacgcattaaccagtctctcttcattcacccctctcctttccccttcccagcctcaggtaatcagcattctattttctacctccatgagaccaacttttaaaactcccacatatgagtaagaacatgcaacatatttctttctgtgctttgcttatttaacatgatttcctccaggctcattcatgtttctgcaaataacaggatttcatatacctattggccatttgtatatcttcttttgagatatgtctaggtttttttccccatttttaaaatcaggttatttgttttcttgcccttgagttgtttgagttatttacatattctggttattaatctgttgttgaatggatagtttgcaaatatttttgcccatcctgtaggttgtctcttcactgtgttaattgtttcctttgctgtgaaggagctttttagcttgatataatctcatttgtctatttttgcttttgttgcctgtgcttttgaggttttatccagaaaatctttgccgagaccaatgtcttgaaatatttccccaatattttcctctagcagtttcatagtttcagctctgacatttaagtctctaatccattttgaatttacttttgtatatagtgagaaataggggtttagtttttttttcttctgcatatgaatatccatattttcctagcaccatttattagagactgtccttcccccagtgtattttcttggagtctttgtagaaaataagatggttgtaaatatgtgaactcatttctggactctctcgtctgttccactggcctatgtgtctgtttttatgccagaatcatgctgctttaattaactacctgtgtagtgtatgttgaagtcagatagtgtgatgtctccagctttgttcttttgctcaagattgtttggttatttggattattttgtggttccatgagaattttaggatttttttttctatttttattttttacttttattttagcttcccagagggtacagttttttacatggataaattgcatgccactgaggtttggtgtagggatgatccagtggcccagttggagagctagtaccagacaggaagtttttcaacccatggcccccatagtagtagtccccagtgcctgttgttgccatcttcatgtccatgtttaccgagtgtgtagctcctgcttataaatgagaacctgcagtgtttgcaagttttctattcctgaattagtttgcttaggatgatggcctccagctgcatctgtgttgctgcaaaggacatgatttttcttttttatggctgtgtagtattttacagtgtgtatgtacctcatttttctttattcagtccaccattgatgggcatctagcttgattctgtgtttttgctgttgtgaatagtgccatgatgaacacatgaatacatgtgtcttctgtgaagattgctattggtattttgataaggattgcattaaatctgtagatcactttgggtagtatagacatttaaactatcttatttcttccaagcgtgaacatggaatatctttttattgttttgtgtcctcttcaatttctttcatcagtgtgttatagttttgattgtaaaaatattttatctcttgggttaaatttatttacaggtattttttggtagctactttaaatgaaaaatgcttttttatttcttcttcagattgttcactattggcatatagacatgccactaatatttgtatgttgatgttgcatcctgcaaatttcctgaattcatttatcattttctacagtttttttttgggggggggggtagaatctttagatttttctaaatagattattatgtcatctgcaaacaagttcaatttgacttcttcctttccaatttggatgccctttattactttctcttgcctaatttctctggctagaacttccagtaccatgttgaataaaaatggtgaaagtgggcaacattaccttattccatatcttagaagaaaaagatttcaatttttccctattcagtaaaatgtcagctgtggatttgttcatatatggccttattatgttgacagacatttcttatataactaatttgtcgagaatttttattattaagtgatgttgaattttatcaaatactttttctgcatctattgaaatgatcatatcgtttttgttcttcattatgttgatgtggtattaaaccatccttgaatccctgagataaatcccaatggattgtagttaaaaatctttttgatgtactgtggaatttggtttgccagtattttgttgaggatttttgcatttatgtttatcagggatattggcttgtagctttcttttttgttgtgtccttgtgtggtttttgtatcaggataatgatggctttgtagaatgaatttggaagaattcacttctcttcaattttttggaatagtttgagaataattaatactggtcttctttaaaagtccagtagaattcagcagtgaattcatctgatccaggacttttctttgttgagagatttttattactgattcaatcattttacccattattggtgtgttcaggctttccatttctttatggttcaatctcagtaggttatatgtattcaggaaattatccatttattctagatttcccaatctgttggcatatagttattcacaatggtcctctgtatttctgtggtatcaattgtggtgcctttttttcatctctgattttatttatttgggtcttctctctttttttcttagcttgtctagttaaagctgtgtccactttgtttatcttttcataaaactaattttttaatctgttttagtttttattagtttcatatttctactttgatatttattatttattttcttctactaattgggggtttggtttgctcttgcttttctagttcttttaggtgcattatgaggttgtttatttgaagtttttctacctttttgatgtaggtatttattgctgtaaacttccctttcagtgctgcttttgctatatactgtaggttttggtatcttgtgtttccacctttatttgtttctcaatttttaaattttcttcttaatttattcatggacctattggtcattcagtagcgtgtcatttattttccctgtagttttacagtttccaaaattactcttgttattgatttctggttttattctattgtgatctgaaaagatgtatgatataattttgattttttttctgattttggggtcttattttgtcacccaatgtatggtctatcccagagaatgttagatgtactgctcgtaagaagaatatgcactctgtagcagttagatagagtgttctgtaaatgtcagttaggtccatttggtctaaaatgtaatttaactccaatgtttctttattgattttctgtctgaatgattggtccattgctaaaagtggagtgttgaagtctccaactattaccgtatagcagtctatctgtctctttatgtctatgaatgtttgctttgtatatttgggtgctctgatgttggatgcatagatatttacaactgtcatatcctcttgttgaattgacccctttatcattataaaatagcctgctttgtctctctttacagttttgacttgaagtctgtttcatctgatatgagtatagctattcttgctcttttaaagactcagcctttcttgatgttgtgcaagtttaagtgaagacttgcatataactgaaggaaaggtatctaactttgttccctaggcccttttctttcttcacctctgtttctgctctgtaccctatttctttttcttgatttagttttctccatagcctttttccagaatgacagctcctcatgggtagtgacattatctgctttgttcactgattatttctaaccttgacatagtgcctggtgcattgtaggcactcaaatagaattttggatgagtgaatgaatgaatggtgaatgaaggaattaatgaataactgaataaatatctcttcattggcattttatttccccttctagagatatacttaatccattgtataagatttttgagctctttaacttcaataatcgggtctttccatttatttattcccatgcataacatcatgtgggccacagcgggtcactaaacagaagttgattaattgaatatatatatgccaacccctgagatacaattttggctctcagaataatctgtcatcatgctggcagccattgtgatactgggaagagcctaattcttggaaataacttgactgaggcttgtgcaaggtattgggtccatctacacgtcccctcatttgcaaaatgtacacaattaactgcaccctgtggagtaatcaagattcgtgtaattctatatagagtgcctagcacatagtttgacttaatatatgtcaactttttgatcattttatgttcttaccattttattatactttgtcggtgataaattacaatgtagtcctacattgtatgatatgtttatgtagttctatgtctcttttattccaattgaattcttcatttccattttttctttctctcatagtctatattattgccttccattctttcacgtacattgttgagtaactgatatgtgccaaaaactgtgctagcactgtgaatgcaaaggaaataaacatggcctcttcttttgaggaactcatagtgtaactggggaaaaacggatcagtaattagattctattgttgcccaagctctcaaagaggatatgaagtgctatagggacacaggctagtggagctagctcctttctcttacagctgactctcccacagttctttttactttttattttaatttttaatttttatgggtacatagtaggtatatatatttatggggtacatgagatgttttgacacaggcatacaatgtacaatgagtgcatcatggagaatgcggtattccttccctcaagcatttatcctttgagttacaaacaatccaattacaatctttacgatattttaaaatgtaaaatccagttattattgactatagtcaccctacggtgctatcaaatagtaggttttatccattctatttcttttgtactcattaaccatccccatctcctccccatgccccaactactcttcccagcctctggtagccattcttctactatgtccgtgagttcaattgatttgatttttagatcccgcagataagtgggaatatgtgatgcttgtgtttctgtgcctggcttattttacttaacataataatctcaagttccatccatgttgttgcaaatgactggatctcattcttttttatggctgtataatactccattgtgtatatgcattaccttttctttaaattcacctgttgatgaacatttaggttgcttccaaatcttagctattagaaaaagtgctacaacaaacataggagtgcagatatctcttcaatatactgatttcctttattttgtgtacttagcagtgtcattgctggatcagatggtaactcgatgtttagtttttttaaggaaactccaaactattctccatagtgattgtactaatttacattcccatgaacagtgtacaaggattccgttttcttctcatcttcgccagcatttgtcattgcctgtcatttggatataaaccattttaactggggtgagatgatatctcattgtagttttgatttgcatttctctgatgatcaatgatgttgagcactttttcttatgcctgtttgccatttgtatgtcttcttttaagaaacatctattcaaatcttttgtccgtagtttgattggattatcagatttttttcctatagagttatttgagctccttatacattctggttattaattccttcctagatgggtagtttgcaaatattttcttccattctgtgggttgtcttttcatcttattgattgtatcttttgctgtgaagaagatttcttacttgatgtgatcccatttgtccatttttgctttggatgcctatgcttgtggggtattgctcaagaaatttttgcccagatcaatgtcctggaaatgttccccaatgttttcttgcattttcatagtttaggtcttagatttaagtctttaattgatatttatttgatttttgtgtatggggagaggtaggggtctagtttcattcttctgcataggaaaatccagtttccccagcaccatttattaaagatgatgtctttttcctagtgtgtgttattggtacctttgtcaaaaatgagtttactgcaggtgtgtggatttgttcctggattctctattctgatgaattggtctatgtgcctgtttttatgccagtactctgctgttttggttattatagctctgtagtataatttgaagtcaggtaatgaaatgtggtttctccagttttgtcctttttgctttagatagctttggttattctgggtttttgtggttctatacaaactttaggatagttttttctatttctatgaaaaatgaaattggtcttttgaaagggattgcattgactctgtcaattgctttagctagcatgggcattttaacgatattggtttattctaatcaattaacataaaaatttttcaatttttgggtgtcctcttcaatttctttcatcagcgttttatagttttcattatagagatcttccacctcttttgttaattcctaggtatttaattttatgtgtgtgtattagtctgttctcccactgctataaagaactacctgccactgggtaatttataaggaaaagaggtttaaatatgctcatggttttgtgggttgtacaggcttctgattctcagaaaacttacaatcatggcagaaggtgaagtggaagcaggcgcacctgaacatggctggcagaaaagagagaaagtgaagggggaagtgctacacacttttgaacaaccagatctcatgagaactctatcgtgagacagcactaggagggatgatgataaaccattagaaaccacccccatgagtcaatcgcctcccatcagaccccttctgccacactggggattacaatttgatatgagatttggggatgggggcggacacagagccaaaccatatcagtgtggctattgtaaatgagattacttttttatttccttttcacattgttcattgttgttgacatatagaaatgctactgatttttgtatgttgattttgtatcctgcaacattattgaattggtatataagttctaatagttttattgtgcagtccttaggttttcccaaatataagatcatatcatctacaaacaaggacaatttgacttctccctttccaatttggatgccctttatatctttctcttgccagactgctgtagtgaatacttccagtactatgttgaaaagcagtgctgatagtgagtatccttgttgtgctccacatcttagaggaaaggctttcagttttcccccattcagtatgatactatctgtgggtctgtaatacatggcttttatgatgttgagatatgttccttttatccccagttttgaggagttttattaagaagagaagttgaattttaccaaatgctgtttatgcatcaatttaaataatcatatggtttttatcctttattctgttgatatgatgtatcggtatcgcattgattaatttgcatatattgaaccatccctgcatcccagggataaatccctcttgttcatcatgaatgatctttttaatgtattgttgaattctgtttgctactattttgtcgaggatttttgcatcaatattcatcagaaataatggcctgtagttatacttttttgatgtatctttatctggttgtgatatcagggtaatattggccttatagaatgagtttggaagtattttctcctcctctattttttgttatagtttgagtagaattggtattaggttttctttaaatgcttgatagaaatcagcagagaagcaaacaggtccctggcttttatttactgggagacgttttattacggcttcaatcttgttacttgttattgttctgttaaggctttggatttcttcctggttcaatcttggtaggttgtgtgtatccacggatttgtctatttcttctagatttttaaaatttattggcatacagttgttcatagtagccagtaatgatcctttgaatttctgcaatattagttgtaatgtctcttttttcatttctgatttttatttatttggatcttctctctttttttgttagtttgactaaagtttttcaactctgttaacttttcaaaaaaccaactttttgtttcattgatgtttcatattgttgtttttcatttcaatttgatttatttctattctgatcttcattatgtttttcttctactaatattggctttggttttctcttgcttttttagttccttaagatgcactgttagattgttcatttaaagtttttttctcttttttgatgtaggcacttacagctataaacttccctcttaatactgtttttgctatccacactatccataggtttggtatattgtgtttttattataattcatttcaataaatttttcaatttccttgttaatttctttattgacccactagtcattcagtagcatattgtttaatttccacgtagtttgtgtagtgtccagaattcctcttgttattcatttctacttttattctgttgtgatcagagaagatccttgatattatttaaattttttgaatgtattaatacttgttttgtgacataatgtatgatctatccttgataatgactcattatcaagaaagaggaagagaggaagtgctgagaaagagtgtgtattctgcagctcttagatgaaatcttctgtaattatctattagatccatttgttttatagtgcagattaagtctgatgtttctttgttgattttctgactgaaagatctgtctaatgctgacagtgggttgttgaaatctccagtcattattgtattggggcctgtctctctctatagctctaataatatttcctttacctatctaggtgctccagtatttggttcatatatgtataaaattgttatattctccagttgaattgacccttttatcattatatagtgaccttctttgtctcttcttatagtttttgtgttaaaattatattgtgttatatgagaccgatgctcttttttggtctccattagcacggattatcttttgccatccttttattttcagtctaaccatgtctttataggtgaagtgtgttttttgtaggcagcagcttttagtcagtctatgtcttttgattggagaatctagtccatttacattccatgttattattgataaataaggacttattcctaccattttgttatttgttttctggtagttttatggtcttccctcccttctctctttccttccttcctgttttcctctagtgaaggtaattttctctggtggcatgaattaatttcttgcttttcttttttgtgtgtgtttccattgtatgttttttgttttaaggttacaatgaggcttgcaaatactatcttataacctattgttttaacctcataacaacttaacactgtttcaataaacaaacaaaaaagaaaactaataaaaacgatatgccttaactttgtatccctgcttttaaactttttgttgtttctatatttatcttattatattgactatgtcttgaaaagttgtggtatttattacttttgattggttcattatttagtttttctacttaagagtagtttacataccacagttatagtgttataatattctttttattccatgtactattaccagcgaattttgtaccttgaggtgattatttattgttcattaatgttcttttctttctgatggaagtactcccttaagtatttcttgtaggatgggtctggtattgattaaatccctcagcttttgtctgggagtctttatttctcctttatgtgtccttcatgtgtgaaggatattttcatcaaatatactattctatggtagaatttttttttccttcagcactttaaatatgtcatcccagtgtctcctggcctgtaaagtttccactgaggagtctgctgcctgacatattggagctgtgttttatgttgtttctttgctcttgctacttttagaatcctttcttcatcctttacctaatactatgattattaagtgccttgaggtagtcttctttgggttcaaactgctcagagttctataactgatatggtttggctgtgtccacacccaaatgtcaaatcgtaactctcataattcccacatgtcatgggagggaccaagtgggaggtaattgaattatgagggcaggtctttctggtgctgttctcatgatggtgaataggtctcacaagatatgatggttttataaaggggagttcccctgcacatgctctctctcttgcctgtcaccatgcaagacgtgactttacccctcctttgccttctacttggttgtgaggccttggaggttgtgaggcctccccagccatgttgcagtgggagtcctttaaacctttttcctttataaattacccagtcttgggtacgtctttattagcagcatgagagcagacgaatacagtaaattggtactgggagtgggggactgctgtaaagatactgaaaatgtggaagcaactttagaactgggtaacaggcagagattggaacagtttggagggctcagaagaagacaggaaagtgtaggaaagtttggaacttcctagagacttattaaatggctttgaccaaaatgctgaagtgatatggacaataaggtccaggttgaggtggtctcagatggagatgagaaacttgttagaaattggagtaaaggtcacttttgctatacaaagagactggtggcgttatgtccttgccccagagacctgtggaacattgaatttgagagagacaacttagggtatctgatggaagaaagttctaagcagcaaagccttcaagaggtgaaagaggataaaagtttggaagatttgcagcctgatgatgcattagaaaagaaaaacccattttctagggagaaattcaagctgactgcagaagtttgcataagcaatgagtagcccaatgctaatcaccaagactatggggaaaatgtcaacaggccatgtgagatacctttagggcagcccctcccatcacaggtccagaggcctaggaggaaaaaaaggcttcctggattagttcagtgctgtgcatcccagccatggctaaaatgggccaaggtagagctcaagccattgcttcagagggtgcaagccccaagccttggtgccttaaacctggtgttgggtttgtggttgcacggaagttggaagtgtgtgtgcaccctagggatttggtgccctgcatcccagctgtggctaaaatgggccaatatagtgctcaagctgttgcttcagaggatgcaagacccaagccttggtggcttacacatggtattgggcttgtgggtgcatggaagagttgaggagtgggaacctccgcctagatttcagaggatacatggaaatacctgaatgtccaggcagaggtgtgctgcaggggtggaaccctcatggagaacctctgctagggaagtgcagaaggaaaatgtggggggtgagcccccatacagagttcccactggggcactgcctagtggagctgtaagaagagggccaccatcctccagaccccagaatgatagatctattccactgacacttgcactgtgtgcctggaaaagctgcagacactcaacagcagcccgtgaaagcagccaggagtggggctgtatctgataaagccacaggggtggagctgcccaagaccatgggaacccacctcttgcatcagcaagacctggattcagacatggagtcaaaagagataattttggaactttaaggtttaatgactgccatattgggtttcggacttggatggggcctgtagcccttttgttttggccaatttctcccatttggaatagaggttatttacccaattcctgtaccctcattgtatctagcattgtgtctaggaagtaactaatttgcttttgattttacaggcttatagatgcaagagacttgccttgtctcagatgagactttggagtgtggacttttgagttaattctgaaatgagttaagactttgtgggactgttgagaaggcataataggtcttgaaatgtgaagacatgagatttgggaggggccagggaggtaattgaatcatgaggtccagtctttcctgtgctgttcttgtgatagtgaagaagtgaatgattttataaaggtgagtttccctgcacattctctctcttgcttgcctgccaccataaaagatgtgattttgttactcctttgtgttccaccatgattgtgaggcttccccaaccatgtgaaactgtgagtcaaacctttttcctttataaattacctagtctcaggtatgtctttattggcagcatgagaacagactcatacaatacccttcttgtacttggatattgatatcttactctatatttgggaagttctctgatactaccttttaaaatatactttcaaaccctatctctttctctacccatctttaaggcctataatccttagatttgcccatttgaggctatttactagtttctgtaggtgcgctttattgtttcttttctttattcttttgtctcctctgataggtattttcaaatatcctgtctttaaactcactaattcttttctctgcttgatccattctgcattaagactctgaagcattcttcagtatgctaattgcatttttcagatccagaatttctgcttgtttctttttaattatttcaatctctgttaaatttatctgatagaattctgaattccttctctgtgttatcttgaatttctttgagtttcctcaacacagctattttgaagtctgtctgaaaggtctcatatctctgtttctccaagattggtttccggtgtcttatttagttaatttagtgaggtcatgttttcctggatggtgttgatgctagtacatgctctttggtgcatggacattgaagatataggtatttaatgtagcctttactgtctgggcttatttgtaaccatccttcttgagaaggctttccagatatttgaaagaacttgagtgttgtgatccaagctgtatctgctttaaggggctccccaaccctagtaacactgtggttgttgcagactcatagaggtaccaccttgattgtcttggacaagatccaggacaagtctctgggttaccagagactcttgttctcttcccttactttctctcaaacatacagagtctgtctctctctctctctctctctctctctctttctcactctctctgttctgagccacctaaagctgtgagtggagtgacacaagtgcccttgtagccaccacaactatgactttgccatagttgtgctgacctcaagtcagcacagtattggttctttctcaaggcctgctgaaaccactccatgctacctgtctgctcaaggccctgggctctacagtcagcaagtggcaaagccagccaggtctgtgttcttgccttcaggacagcaaggtctcccagagccctgtgtggatttggaagttccatctgggagtcaaagactagagtcaaaaaacttagaagtctgcctggtgttttatcatactgcagctgagctggcactcaaaccacaagatgcagtccttcacacactttccccctttccaaagggcacccatcagagagccctttggcatctttccaaaggtagaggagactcaccccatagtcactgccaccccaggccataaggagtactggcagactacccctgatgttcccttaaggcccaaggtctctgaagtcagcttgtggtaaatgctgcctggcctgggacatacccttcagggcagtgggctcctgtctggcccaaggcagatccagaaatgtagttcaagagtcaagctatggaatcaaggacccaggagcccatttgatgtggccatgctggtacttaagacaaagcccctttttctttcccctctgcttctcccaagcagaaggagttttgccccatatccaccacagctggtaatctgttgagtcttacctgaagtcagtctcagaggctcgctcaaggccctcaatgtagtacctgtgtatcactgttggttatacagggcccaagggcatttcagttagcaggtgataaatgctgccaggactgtgtcctttccttcgaggcaacaggttcgcttctggcccaggatgtgtatagaagtgtcctctgggagctagggcctgaaacaggggcttcacaactctgatgggtgccctatcctgctgtggcttagctggtatcctagatgcaagacaatgtcctcccaactctttcctctcctttgctcaagtggaaagaagaggtctcttttggagctaccagctgtacaggctggggttaggggaggtgtgatgccagcgttcccttagctgccccagctgttgtcccagtatgttatctgcccccaccagtccactgtctctgggcctagttcagccctaggactcacctaaaagttccaatccttatgatctagactgcctttcaagtttacttggagaaacagtatcctgttgcccttggtggcaaggtttgtaggcacttaagttcaaacccatggaatcagcgagtatcttctagatagggctggtttaaatgctccctctgtgggtgggcatcagctgagtttgatctggttttcccttctattctaacaggacagcactgagttcagtgcctcacaattactgtgttttccctccctcagcacctagagatgctctctgcatcatgctgcagcatctagagggtggagaaagggtggcatcggtgattcaggactgttttttctgactctacagtgcctctttcatcaatatgaagttaaaaccagatactgagtgtttacttgatttttgattctctgtagatatttgttggtgtccttggtgggggaggcagacaatcggtagaattctctattccgccatcttgctccacctaggggccagaaacagtttactctttcctacaattctaattaaagtagacccagttcctttattctttttagtctttcagatgtttctcttacaaagaaaattttctcttttacctttttttagttacttttccaccattatgttctcttgatgctgtttgctttctttcatccattctctaaataaaattttaatttaaacaaatccatttccggttgcttcagaaatgtagtcccaaagtggacatttaatttcctatggtataaatgttttaagacactcacagtgtacataaagtgaatcataacattgtgtgtagcagcagatcacctagtctcactaacaagcatagaaccatgtacacaggatgtaaaaagaatcaaaacaggtaggtcttagaaagccttagtccttccagggaagtttcagtgaaatgtcaaaacttttactatgactcagagttgacataaaaagcattttattgtgacaaaaattaaacacttattcacttattgaacgtatacatcatacaaaagaaatatcagttactatgacaaatataaaaataattttaaatttgtcactttgggggaaactagaacatatataagagatataagaacctaagatttaaaaaaaaaaaaaaaacaacttgtctgaatgtaacatatctcccccatatttgtaaaacaattagaggacaaaagctaacctgtggtaataaaatatcaactatatttttgttgattaagagttccacataaaataatgctttgaaagactcactgctctaaaatactcactaaagcatgtgacttttgtgtcttatcttggaagtagtgacatggagggttttatgtaggaaagatgacattctaaatagaaggtaatatgcatttaagcatagagactacccttccttttttcacagacatatgtaagaaattaataacagacaaagtcaggtacagaaacaaaaactaggggccaagtgaatacatgactgaagaagttatatttcaaaggtattaaaagaggaggcactaaagttctttgagtgacctaattatatttttgaaaaatattccattcaacactcatttattggctgtgtgttattggtatatttctgtgccttgatgactatgctgtgaaaacattgaaaagatggcatagtcctttcctttgaggagctacagactatttggatgatcttggcagctgtgtgcatcttactctggagtgagaagaaattagaggcatggtatataagtccctagatatatacaatggatgatactatggggagggagcataatttcagtgtaaattaataaagtctgagtctagagggttgactatgaagatagaaaggataaatttcatcttacagatattatatggcaaaagtacacatgcttgatgcacttcgtgcataaagaaagaggattaaaaaactaactccatgtaagcatccctatttttaattctgtattaaagatataagctaataacttattcattaatgtattcagtcattcaaaagctaatgtcaaacaccttccatgtactagttatttgcagaatctactttcaccagtcatcctgcataagtaaattggtttagcattattgtcttttgaatttgtctaattagcagtactaattttacacagggagaaagatacagctggttgaagtgacatacaataattcatgatggctcttactgtactgcttatcccaattaaaataagacagtagcatttacttattaattcaattttttctcatatcatttagaaaagatatcttttataatttaaatttcttatgcctattttgaagataggtgtgaattttttcagaaaagacttaattgactctactttcaaaagttatctgaaagtaaaagtaggaacagaaaaccttatacacttgctgaaaatattctgtcatttaatctttttatgtaattctaaaacagtggtataaatgtcaacctgatgtgcaggaagataattttatttttatgaaggctagagtttctatcattttaaagtatggcaataattagaatttagtttctgattttacatataggaatatttgatcatttttattgtgttagagaggaacttctgctcctagagatgagggattaacagagtccagacttagccttctgccataagcaactagaaatcttgacaaaatatacaaaacaactgtgttcagacattggaaaacagtacatgaccttgagttcatggaagtgaagggaaacaaacaaggtgaaccctaaaatcactcaggctttctgcctggagacagaaagacagaaataatttcctgatggttgttcatttgagagagaaaacaaatggagcttggccatcttgctaatttaagaagacagaatcagagtttgggaggaccaaaacagctagaatttgtagtgcaaagtatggaagaagatggatctatgcaaaaaaggagccacagaaattagcataggcattcccttgagtatttgattgaatactagtctacatgtcagccggctggaattttgagtccgagtaaggaacacttagtagggagttggattcccagagctgacatagagccagaaattttccaacttccagcagccagagtagagatatcttgttgaatacataaggaattaagtaaaagctcttggaaggtcatgtcttaataatgaggctaaactattcctcaaacagtgactattctagacttgctctaataatttaaaatcaaagctcaaagggaacaaactaagctgtaagttgcttaactgcatgctcaaacaaagtccaacactcattttaaaaaggaagaaaaataaatccgcactctacaccttaatgcacacaatgtcttgcatctagccaaaaaattgcagatttgaccaagtggcaaaatgtgtcacattaccaggaagaaaaccaagcaatagaaacagttccagaaattacattgatgttaaaattagcagtcaagggcgttaaaacacaaggataaatacgtgctaaaagatttaaaagaagacataaatataaaaagaagaaaaatgacaatataaaaaataacatattagaagttatacagctgaaaaataacatatctaagaaaaaaacattttaatggattggattaacagcacattaattgttgtagaactaaaggtcagtgaactgaaaaacatagcaataggaaacaggcaaatgaggcacaaagagaaaaaattaaaagctaaaagaaatgagcaaactctcagttacttgcagagtaatacccagtggtagactataagtgcaactgaagcttcaaaaggctgggagagtgaagcaggtcagaagaaaacctgaagaaatggtggctgtaaaattttaaatgtaatgaaaatgtaagcccaaatccataaagttcaacaaatcctaagcaggataaacacaaagaagtcattacaattaagttgctaaaaaccagtgataaaaaattaatatccaaaataagaaaggggtgatacattcagaagaacgaaataacaattatggcaggcttcttatcagaaactataggtgagacaagaaagaagtaacatcttcaaagcactgaaagcaaaaataataataataatctttaacctagaattccattccctaggacaatggaatgacataacatgctgaaatagaatatatatatacggtcaacttaaacttccataccaagtgaaaatgttatttttgaaatactaaggcaaaattaatactttttcaaacaaatagaagctgagagaggtcatattctcaggctggcatggctgtaaatgttaaagaaaggtcttcaggaagaagaaaattataccaggccaaaatgtggacctaaacaaagtaattaaaagaaccagaaatgtaaatatatggctaaatataaaatataatatctttgttattttaaaaaacatatttcagggataattgactgtttaaagcaaaaataataattcatttgggaagggtctataaaataaatatgtggaagtaaaatgtataaaactataacccaaaggacgggaggggaaaatggaagaatattactgtagggttcttacattatacataaagtagtataatcttatctgaatgtacattgtgataaattagtggtgcatattgtcaattttagagcaaccactggaacatagcaaagaggcctaactagtaagccactatgcagataaaatagaatgctaaaaagaaggcaaaaaacaaagaacatataggacagaaaaaagaaaaataagagatgattgatttgtatttaaccatactgattattatgataaatgtaaatgtactaaacaataaaaggcagaaattgtcagactagagataaatgcaagaccaaattgtgtgctgtctacaagacgtgcacttcaaatggaatgtgtttttatgtttatttttgtactatggagtgtgaaagtgtttaccaagcaaactgaaaatgggggaaagtttaaactgctcagatattaagcagctctccagtaattttgaactagtaattttgctaccagtacttgttatgatcttttgaattcactagagaaagtcaggcagggcaatacttgattcttctttcttagctatcattctgtttttatgtatatatagttgctcttgagtgaaattgtctaataattcagtttttcataattacaacaaaaattgtataattacttagctttgatgaattaaaaggttttattacagacttttttagtaaaacattacttgctttctcagagaagaaaaatatatactttttcttttttgagagtaataaatattaatataaacaaggattaaattaaactgtttcatttttaactctgcaaaaaaatgtagtcaaataactctataaaatgaattattattgaaaagcctccaaacccagcatggaatgaattgacaattccatccaaactctaaggtaatcaaatatatacaaattcacattcttaagattcctcagcatataagattattttcatagttagtctttttttctttattcataatctgaaaacaaatcctcatctgaaatagaagcttttctgggaaaactatctttaaaattcatgaaatatctatgttataggttatacggaaaggagaagtgagctgctgctggatttgcacggcctgcaaagagaatgaatatgtgcaagatgagttcacctgcaaagcttgtgacttgggatggtggcccaatgcagatctaacaggtaggaactgcctcacttggaaaccttgtgcctcactatttgcctttccaatgtgtccatccctcaaatgagaatgattagctcatgtcttctcaatgttaatttacaatgcacactttttagtcctcatgtcaaggagtatacataaacctcataagttttctataatctatattgaaaagaaagttcatgtaaatctaaataacaatgaattgatgtgtggtaggctatgctattatagagttgttttctgtttttctttaaattgtatttgaaggtatttctggccacctgaatttatatttgcaatcatttcttgaacatctactatggatgaggcactactataggccctaaaaatagaaaagtaaatgtcccagcttttattttgtataaaatctatcagggaagaaacatggaaaaatataatataacataacataattattaaaataatcatcccggcttttattttgcttaaaacctatcaggaacgaaacatgaaaaatataataaaacataatataattattgaaataatagagatatctataaagtgcataaagtttgttaagcaggcaagaagatgaaaggaatttcaggcctaaagtagaacacgggaaacatgaaagtttatgacacatttgcagaaaaccatagaacaagtatgtggggttggtaggtagggacaatggtccagtagggtagtggtcagaaatgagaatagacaaggacactgatgggatggcagagtgcttctgtgtgacattcctctacatgtttggactttggctttgagcacaggagaaccactaaagaattttaaagtggtgaatgacattatgatacccgcatttctggtatgcttcttgtagtggtataggaagttgttgtattgatgcaagtgagttacttgaaaaggtgtggattaggacagctacagtaggaatggaaaggaataaatgaaacagatgattcactagtaaaaccaatggaactcagagggattgattatatgagtttgtaagtttcctaagagtgatgttcatataaatgaattttgtttttcacacatcttgttatgagcttacagaggagaaatgattcataaaactttgcataaattttaggagccatagaggcttttttatgtgagtacatagacactttgtcatctgaataatctagcccctcgtcttatcatcttagaaagagggagctgaggcctagagacgtgaagttgtatggccaaagtcaggaaaatagtgagaagcagaacctagtccactaacccctgactccatgtctttttgggtgctgttgaaaatcatccgtaaatgtaatattcttgatggttggacatttttttacttgtttccaagtaaaaatatgcaactaagaaatcatgcagtttattcagagtacataaaaaatgactaggtaagtagaactaggtcacgtaactaaaattatactaagtgacaataccttgtaaaatgttaattttgttagaaaaaagttaaactgagcagcagaaagcttttgtaagtcacctagtacaaaggtcctttttaaagagaagaaaagtagatcagaacgtttttgaaggtatgaactgcatctcactcatctttttatttgccagctaaatttcatgcctaaaaattacccaggaattacccacctccagagattccgctttgctcccgctggagtggaactcagcagatcctgatgcaattactctctgtcccacccattgagaaacaccactctctggcgcatagcctgatgccttgaacataatagctacttaatacatgtttgttaaattgagggaattaggaagaagggactcacccagggtcatcgaggtcaatgcagttggttaatagaaaaaccacagtgagcattcaagattgtttgtcactggatctaatgaatgctctcactctgccatggttgcatgcaatggcctggcttggaaaagcttttccaacctcattttggactcatgccttccctccacttacattatttctcttcaaatttgtatcctacttcatggtgtgtgcctcctgccaggcctctttttcttgtataagtaggtccgcttagatggccattgtgtttgagagctggggtttactgacagtcattccactcatctgtttgactgagatcacagctgactaggaaaaagctcaaagacaaaagtgacctctttatgaggttaatcttagaagtcagaagtcttggctttgaggtacaaagatttttctcttgtctacattttttgggctttctccaacttctcctactgctctatttcattttcattagggcttatctcacacattaaaaaaatttctatcctattttaaaacactaagataaaaaagctttttaaaaaacatgatatgatgtaatagtggaactcaaggtcataccttttattccttggagatgctctattgtgggattattgcatattttctgtccactgccaaatgctcatttccgttgattagggatctttaacttggtaaaatatttttaaaattctccttggttaaaaatggattaatattaatacaattacatttctaacgatttaatatgccatgagctatcatatgcataaaagtcactttaacattcaaatgagttgagccagcaactcctcagaccatgcccttagctaataacaacaggcatgcagctgcgactgggtcatatattcagatgattttgcaaatcttatctttagggtctttcacaatatagattcctcattctaatttatactaatgtcttaatgatccatattgattctgcctttcttttggtctcttacaggaaatcccatttaccacttgcttgatgccatgtcaagcacagagcaagggcatagtccgtgccaatgtgttgtgggtgttaccatggtagcggtagttatgaaatgagaaaacctatgagaacagaatactaaaaatcagtagaattactcagaaaagtaaacgcattgcctttaagtaggtgtttgatttatgggtaattttttttcactaaatattagttaaaatgagaaatcattcttctttgaaaaatagtgtattctactgaagtaaaatatactttttatttttaatagttggttaaaatatacttaaaatcactttaaaagttagctacttttaatatatactccatacattataatattaatgaataaaaacaggtttactgtggtttttatttccattaaaatgtggttttttttggctatgaagaaattagtatatttcttagagaaagtgctttttgaagctgttaaaaagtttctcatattttcttcttgtgaaattgcacattttaattcagcacttaaatttcacactttatttcttgtgatacaaaaacagggatcttttctaccatgatatacagcttgacagtagtttaacaatttgtggaccaattatatgtaatccaatgctactaatttatttgtagaagtaaaataagaatattcctcaaaaagacagactacgctacattttctcattaaaaaaaaaaacggaaaatgctttataaacattaactaattttaacaactttttttccattccgacagttgttgtaacctcttacactagtatctactaatttatttcattctgtaataaacactaccacctgttttgtgccaggtactttttaaaaactgggaatatacaggtgaattaagcaatgtctatatcctaagggaggagcttcatatgaaactagccatgtaaacagccaactataagtcctacaatagagttatgggtaaaatgtcagataaatatggagcggctgtttttccctgggaagaaaaaagcctttgcagaagaagggacatttgatctgagcactgaattacaaacagaatttcacctggtagaatttcattgaattgtaatagaattactatttatattgattttaaaacaatcagggaagcattttgatgaaggtttatatgatcatgatgtagtattgcaaatgttatgaattacctcaagacgctttgcatagagttttatttcttaatttatgttaaatttgacttgacctaattggaaaaaagtctgatagtaaatttcatcctcctccaatacatctggatcatataagatgtactggatcttataaggatcttataagtaccctaacatttgattcaaaaattagaagtagctaccagtcctcagatcagagttattgccaccttgctttgattttgctcagtaatttgtagttggcttgaaggaaactgacttgtctgatagctctgagttctctgtaataaccctaaccataaacatttgccaggacctcaagttcccaaggttcagatatgcaaagcacaactctcacaaagtcccccttttgagttctgaggttaggtggacgctactcaccactggttgaaggtagtctcccctctttctagttttgggataaacaaacacacctggaggttggataactcttttttaaaaacttcaaaacaggatctcaaagaaagccacataacatgacattacataattggacaaatgacattacagctaattccctcaagatggcaaagctaatgtttctcaaatttaggataaatttaaatttatcctaaataaaaaataaagaaagaaaagaaaaaaaggaaaaagaatctaaaacttttaagaaacttactcaaaatatagattctgttttggatggttccagattggcattgaaaagcctggtttccatatatgaaaaagaatctagcatcttcccaagagataaagcaatcatagtagaattgcaagtatgtttctgggtgtcatgacaaactgctactgttacaacacgagagtacttacatcccctctagcataacaacattgttcttcatctgtatttgatgcactgtataggacagagttattttatagctagatttggacaactttatgattatccttggagaggccttagtatctgtccttgactattgtcctcattaggggaacttggatttacgatatgcagtttaaagtttaaaatgtgtttggtggcaaccaaatcctgtttgctcactgatggattttgcctgaaatcaccaattagcttgatttggctacatgacttgggggtgataaaaagattccactgaaacttctgccctagctaacccaaagccaatattcatggtagagatcctggtagtccaatccacagttaaagtctatccatgtgtgaataagaacctagagagcttgcacctggttatctcttggtcccttggtgttgacatgcactgtctttctcgcaccgtattagaccttttgactttaaataaaattgttacatgagtgtcttctacaagtcttctgaatcttttcaaatatctaaactcatgcaatctttgcatatgcagagtattgttattggaaaagttagcataacatacctttatattatttcttttttaaaattatacttcaagttctgggatacatgtgcagaatgtgcagatttgttacataggtatacatgtgccatggtggtttgctgcacccatcaacccgtcatctacattaggtatttctcctaaagctatccctccctttgccccacactccctgacagtctctggcgtatgatgttcccctcgctatgcccatatgttctcattgttcagctctcacttatgagtgagaacatgcaatgtttggttttctgttcctgtgttagtttgctgagaatgatggtttccagcttaatccatgtccctgcaaaggacattaactcattctttttatatgactgcatagtattccatggtgtatatgtgccacattttctttatctagtctatcattgtgggcatttgggttggttccaagtttttgctattgtgaatagtgctgtgatacatacctgtgcatgtgtctttatagtagaatgattggtaatcctttgaggatatacccagtaatgggatcgctgggtcaaatggtatttctggttctagatccttgaggaatcaccacgctgtcttccacaatggttgaactaatttacactcctaccaacagtgcaaaagcgttcctatttctccatatcctctccagcatctgttgtttcctgactttttaatgatcaccattctaactggcatgagatggtgtctcgttgtgcttttgatttgcatttctctaatgaccagtgatgatgagctttttttcatgtttattggccacataagtgtcttcttttgagaagtttctgttcgtatcctttgaccaatttttgatgcagttgttttattttttcttgtaaattaaagttccttgtagattcaggatattagccctttgtcagatggatagattgcaaaaatgttctcccatcctataggttgcctgttcactctgatgatagtttcttttgttgtgcagaagctcttcagtttaattagatcccacttgtcaattttggcttttgttgcaattgcttttggtgttttagacatgaaaccactactcaaggaagtaagaggacacaaacaaatggaaaaacattccatgctcatggataggaagcatcagtatcgtgaaaatggccatactgcccaaagtaatttatagattcaatgctattcccatcaagctaccattgactttcttcacagaattagaaaaaactactttaaatttcatatggaaccaaaaaagagcctgtatagccaagacaatcccaagcaaaaggaacaaagctggaggcatcacgatacctgacttcaaactatactacaaggctgcagtaaccaaaacaacttggtactggtaccaagcagatatatagaccaatggaacacaacagaggcctcagaagtaacacacacatctacagccatctgatctttgacaaacctgacaaaaacaagcaatggggaaaggattctctatttaataaatggtgctgggaaaactggctagccatatgcagaaaactgaaactgaacctcttccttacaccttatacaaaaattaactcaagatggattaaagatttaaatgtaagacctaaatccgtaaaaactctagaagaaaacctaggcaataccattcaggacataggcatgggcaaagacctttatattatttctcgaatgatgtccaccaacagtagcttaatataactaaattattgagttagtgtgatgattgtctctagtatatctaggctcagataaattcctcttagtagtaagagaaataataaagatgaactcagatttttatagctttaaatcagtaaggaaagaagtatgaataagcaagaatatacaaaggagagtatgatatatacaagaattttataatggtgatcttgcacagaagatcattatatggttattagcatgctccaaggtctttgggtcagcagttaacttccatgccctttctgcttctggaggcttttgcagagcttcagtttaaaattactaatgggtgtaatcatcagtgtatcaaggttccctttcatttttctagagggttgggaatgatgaggtcatgaataaatattccggtgaaaatgtcctcatatcactggatttataaattagaatgttacagctaagaaatacaaatgtaattgtattttagccattgtgaggattgtggcttttcaacaggggaacgcttaaacagagtcataaaataagcacgctatttgaactagtacctagtaataaatcatagagaggcacaaccatatacaatccatctggagatgctcaaaggtttcttttgcaattttatcaatgtcccatacatttttttccaaattaatttaattacaaatgaagcatgagctggacacatcttctgctatcctgaaaatgtctttccattgctgtttaattggccaacttgtccttccagaataagttgcctcatttttcatgagatgtactgagtgttcacaaatattcttcaaatgaaacttctgcttgagatatctacagattttcttccataggctcccaaaccatagagagcagagaccttttagttggtttactgaaagatccataattatgttgatttgggttatttactttttaactctatctggaaatgtcaagccacatattagacattttctaaattggtaattttaaattataactgttttttcctcatttgattcaactaattcaggaggtctaagcctacctacagagggagagaatatggtcctttttaagttagttgttgagtctatttcagaactatttgaaagtttcctaaagttttttcttcatctttatttagtttacaactttgaatatttattgaaagaaaagcttctgaaagtgctttatgcaatgccttttctatttttcttttttaaatgttacaccactgggttactttaatcttctcttttctgctcttgcatttaaacatttttctccatcaaaggctaataattaattgaattaattggtacatacttgtagtatggacaataagtatctaataaaatttccaaattctatagcaaacattatgttctgtattcatgaagtttaggaaaattattaactataggtcttaatttggctttataccagtttctttaattcaacttctatagatctgacttgtgttctagaaagtttaaaatgttatactattttctggtaaaatctctgatgacagagtatttcatttagagagtcaggtaaagttgcatagaaaaagaatgaaatgaaaagaaggtagcattcagaaggttaccaaagccttgacaaaaatcatctttgaattggaaaatttgtttgcaggatgacagctaaagaaactgacaattcactgtggtattttatctcctaatttgtctagagctccttgtaaatattttaatttattgatttcatcataaattagttcccatatggccaatgttattttaaatatctattttcctacctatccatcatctatctatctatctatctatctatctatctatcgtctatatatatatatttatcatctatgtatcatctgtcttgcctgcattgggaaaacaaaaataaaattaggattagtatgtgactttatataggaagaataagttcttccagaaaaaggtttgtatttagacagagacaaatctctgatacacaaggaagagaggccactaagttctgtcaaaagtgtgtgcttgccaatggtgtcttagattcccaaagcaaacggagtgtaggaaggcaacacacaatcactaaaataaagtgatctttcataagttgacaacacgggaagtattcttgtaaaggttttctaagaaacctaaggctgagtgacctaccacttttggcaaattggttatcaatttaaaggagctccaaacattagcactcagggccagcttggattggacacttcttaggcttacatgttcctctaatgtttatgaactatcccttatattgtcaacagaaaaaggtgattcaaaacaaaacaaacacacaaacaaaacagaaaaatatggttcaaaacgaaacaaacacacaaacaaaaaagacccataaaataagactttgtgtatgtatgtaaataacagcaaaagcaaagaaacagcaagggaataaacagatatggaaaaaaatatttatcaaattgtgtatctctaaagtgaactatttattgacataataaaaagcttatgtctaattaccaaatggtgcatttcaaaaccaaaggttatatgacttaatatataaagatacaggtgaaataaccttacacaaagacctaagtttaagtgccttctatataaagacctacatgattacaaatcctaggacaactacataaattcagcaacaagagctcagtaaaattagccagagtgagaaaattattgagaatgactctcatgctagtacatgggaaggacagaatgcgggcacgagggggtccagtgagtgaccctgttgatcagagcatctcctggaatgttatcaaataaggagtcttcaaaattatcttggtgaagcctctagaaatatgaaacatggtgagactaaatacataaaattttttttaaaaagcacaaaagctggctgggtgtggtggctcatgcctgtagtcccagcactttgggaggccgaggcaggctgatcaggagatcgagaacatcctggctaacacagtgaaaccccgtctctagtaaaaatacaaaaaattagccgggcatggtggcgggtgcctgtagccccagctactcgggagactgaggcaggagaatggcgtgaatccaggaggcggagcttgcagtgagctgagattgcgccactgcactccagcctgggcaacagagtgagaccccgtctcaaaaaaaaaagaaaaaaaaaaaaaaaaaaaaagcacaaaagctaaacaaattgcttactatagtaagggatagttatgctaggcagatacattttctctgagcagaagactattcattttatatggagtttttagaaagtgtggagtttagggattgaaaaccttgcagcttctgagagctggttgacatcacctgtagcaatacgattactcacatgagactgttgattagttggcactcatttattgaagtgattctgatcctgcctgagtgattatcagaagtaagggctgacagtgcttgcttggcatccaaacacatgttcactgaggcaagttgttgattgactgacaggtttagcactggttctggtggttccttgttgccatggctacagaacaatgagtcttttcctaaatttatggaaatgactttattctcacaatttgggaaatattggcccagaccaaatattttgtgattacaaaattctgtgaaggggttgtcccagagcctgacaaatttttctctcactctgaaatacaaaatacattttattctccatctagaaggaaaagataagccaggaatttaggaacaaattctagtctttcctttcaagagatgggttaggggagatttcattcttcctggatatgtccactagaggttactaactcaaaggccctcaggtttcagatacagatcattcatgattcatgagaagagtgagatttaaggtataatatagagttatgcaggaaacaggagaatgcagattcttctaaagaagtccatgaaatttacattgaaaacactctgctggccaaaaacgacttgtctatgagctggacttgcctacagacaatggctgcatcaaaagaaaagttttgttagtttatttcttaataatttattctatcccattatcaccatttaaccctcactggaaataaagttttatttgggtgttttctttttctgaacatgtagaaccgagtcccattcacagaatgacatctatttataatgctgatgttggaagaaaagatcatttttataggttcaagtatgtcacattaggcttgtaataagattaagtttggggacataattgtccaggtaagacaatgatgtatctttatttgtgtaatagtgtgcatttttaaaaaagcattaaatgctgtaaatcatgaaggatgcaaagatgactgtgtctctggtaattaataggcaagttgttattcctagcagaaaccttggattcatgctcaaatgatttttctcatcacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagtgagttatctgacctgtttgtctctcttttctcttcctttctctgtctctttctctctctctctctctctctctttctctgtctctcatatcttcctctagttttctgagttgtctcttccatttcccccatgtctttctcttcctttcttaatcttttctccctttcttaaatctcacattctgttgcagtaagaatgcagaactgaggctcctccctgttttcatttctttgaaagaaaaggagcaggaaacaatctttattcttgcctagaagcggaagcttcggttctgccagtaacttaccctttcgcatgggacctccttctatggagcatcattttgcccctgggggctgggtcagagaggcaagcactaattataatgtctagttctgaccatggtgaaagtagcttctggtttatttttatcattccggaatcacaccacttctaaaccggggtgaaagggaggaaaacttagcacctggagaaattgccatttcaaaatttgatcactactgagcaccaagtatgtcctaaaataagatcctgcaagcaactgacttatcatatctctcttatttattgaactggaatgtacattgtaataaacatgttccacgatgttatacatgaattgggtcatctctgctactgcaaagtcatgatcagaatagtttcttagtcataaagcaccaaaaaataaaaaaaaataaaaaaagggaaccaggtgataagccccaatcttgagactttgtgtgaacattaaagtccagatgaattccagatgaattctattcaaagtccagatgaattatatttctataattcttctgagttgtttttataataagcactttcctatcctttttctattttgagaagaagcatatgttaaatttgcatatgtcacctctttctgtgacccatgaaaacaaatttcatgtaacgttttttatttcaaaaatagcacggatgcttgaagttctaaaggtaaccgaagtatccaaagattaagtcattttctccaccagcagcattaatttcactctttcaaacaatcctttaaaaataaaaagttttaataataatcatgataaggtacacattgttaataatcattccatccatctgaacctgtcagcaggaacattatttccccctattttgtaggtgagaaaagtactctgctgtaaatttttataacttgtatttatttattattattattttcttaatcccaaatgtgatagtagaatttttgtaacttttcaatgtaattccccttagttattctttatttagatcttaaatgatatgatacttctcactttaacacatgccaaaaattctacatcctttaaatttcttggtttttgtatctttactttccaagaagcaacgtgggcatcttttgcagaatttatatactttgaggatctaacaagggagtctttgggaaaacatatctttgaaatccattttatggatttcaagtaaagacatccctaattttctcaaaactaggatgaagccaataatgtacgcttacttcttggtatatcaatttttaagtttgttataggatgttgatcataaaagtggttagccttttttttcctcttaccatgttttttttattctagccaaactcccctcaggagcaaactcctggcagggagttatcagggagcatgaaagcaaaccaacagtgccacgaaatgggaaaaaataattagacaattagtccagatgtaaaatggcatcactaacaatttccattaagagggaagaaataagaggaaagaaaatgaaaagaaagaaggcatttcttaaactggagtgttcacaaggattaaaagattcactttattgcaacacctatggttttctgagggctccattacaacatccaccattattccactccatgtttctaattaccttgcctttattatggttcttcagaagcttccttgtaatttttaggtatgggtcatttttgaaagtttttcttctaaccatttatggtaaagagaaaacctatataattaagttatcttgtgttggtgcccaggaatatgcatttttgaaagctctcccagtgattctatgtacagacagatatgggcacctgtttaagagaacagtgactaatgaagagtatgtagtgcctgctgcagagatgagttggagctatctgatgtcacattaacaatgctgagtatttctctcatgtccaggcattgctgcaagagattaccttcccacacctggaaccactttccttataaactgagagcattcccttcactattagaaatttagaaattaatttcatgtgggatcttgcttttgagagaaaaatcagcatggtctaaattaactggattggttgtctaggaagtgctggtttcatcagtaaactgttgaactattagctgcaatttatcaagcattattacattcatttaataagaaatatatttctaattaaaagttataacccgcagctttctgagtacaacttatacctactccaatatgcaccaagcaaatgagctgacccagagagggtatttgaggctaaccttctacggaaaacaatcatctgtttactcatttttctcatttgttctgctgttgctcctgttgtaactatgtgagactgtaattttagtatataaaaaagaatctcaatgctatgtttttacctttttattgccattttatattttcttagtttgtctccaaagttacaaaaagcacaaacagtctaatatttttacagcagcaaaaatctggtagagttttgccaactgaagcaaaggggctaaaaactctagagaacacatcacccaatgagtttattgctattctagatgtgtaattcctacatttatggtacactgagggtgttcagcagtctgcatgtgtagctataaacacagaacagatgctgtaatgaagagcttccaactgatctatctgtttgaacattgttttgaggagttgcaagtccaacggcattctcatgacaggctgtttctgagatacgtggttggaatgatgttgcgttgtctgtttttagcaaagtttacttcaattttttattttattcacagctgaatatctgacacaaccaaaggtttggacacttgctttacattttctggaatataatataggaggagtttaatcaatatactgggtgtttgggttgcttgagttatttataatcagaagtcccttcaggcatacttgtatcctgggagatcagctgaagttacctttgacacctctcatttctttagctttttaaaaaaatgaacatgaatggaaaaatatgcaggactcagtagactttaaaatattgaaaaaatcgatttattggcaatagaagaaaatgaaaatccctggacatttatgaggaagtaaattaattagatccaagtaatttaacacttccttttaaagaaaaatgagttaacattattcaactgaaaaattcaaatatcatataaatgacatgcttctttaaaaagtaattacatcagtgattacatgtcaatctaacatctctagttaattcctagataaataaaatcactgagtgccaaacaatttgatggcacatggagctaaaatgtgacaatacattcctatgatattttgcatgcaaaattgtgtacaaaactaaaaacaattacaacctttcctccctaaaggcatcagactgacacaaggaagtaattttaaaatataggttactaagtaaatggatattattatatgctaccttgattatttcttgagtatttgagtttttttttaactgagtcaagaaccaagtgaaattctaaatggaatgatgctcagaggaaattttccactttgttctctgctagaaatatattttgtccaccagtagaagcaaataagcctgcagcattagtcattatgtcctgggtaagcattttggttttctttcctctgattatgaaaagaaatgtattagtgagtttacagatatcatggccaaatggaagtggcgtgttctcctcttttttatttttgatacagttctcatttatgtctatagctctgctaaatttttattatttttaattgacacataataactatacctatttatagggtacactgtaatatttcaatacctgaatgccatgtgtaatgatcaaatcagggtaattagcacatctatcatttcaaacatttattatttcttagtgttgggaatattcaaaattctctcttctaactacttgaactattgttaactatagtcactataccctagtagaacttatttgaaagaactcatttactattctggctcacaaacaggataatcttgtcattttgtaattatttttctcttaatcacacaatatatagctttaaaagctactgtaattcttcatgatatttatagtaaacatcagaagatttattgaaacatttgtgatagaattttactactggatagtaatatttattgaggatcaatttctcattcattcatttatgtaatcaatcattgtttcaacagtaagcttaaaagcacttaggtacttgatatggtgctaggtagtcaagataaaatatatatatataagaggcaggccctgactgcaccaatcttgcaatatgggaagggagacactaaaaaatataactaaatgtactgtgctatgtgccatagtagaaaaccaatataacattctcagtgcccagggaagaaagagattaagtccagttaatggagtagtatctgtagaaggattggaaagatcttcgagtaaaagtagcatttgaacttgaccataaagcatgtttttcaactggagaaattgtgctatgctagactattttatatagagaaaataacataagtgaagattcagaaatgttaatgcactttcatgccacgatgtagagtttgttatgcatgaagcacgtagagagatgtagtgttgggcaactttgcaaatgcaagaagagtatagaatatagataatggttaatgtaccaagaggaagtttcagtactttttctataaatcacaaggtgcaataaaggtttttgtgaagtttcatcatcatgtataagctttaggggaagaaactgacttatagaaagaccagttaatagagtgccacagtaatccaataacaggtaaaaataaaagccttaaactagagcagtaaagttgaatccaagacatgcatatgaaaaagttttctgagcttaattcactagacttgaaataccagttatgcgagctgaaagaaataataagaaaataggactcttatgatttgagcccaagtgaaatactgctactattaaaacagataaggaatacaggaacaggacagaggagatattgacaagatgggtttcagattaattaattgaaagtgctataaagtcatccaaagggaggtatccataagattcttagaaatttaagtctggagcttaagagaaaggtctaggccagacctctagatttgaagatcaattgtcaaaatatttaaagtgcccaagagggtggttatgacatgagaaaagaagaaataccgggaagaacaaacattagggaactcttacacttaagagataacataaggaaaatctgaaggcagtagacaaaggttatcaaaaagaatgtgggaaataaaaggatgcaatattatggaaaccaaggagaccttgtattaatgcgctcaggttgtcaaaacaaaataccaccaactgagctgctgaaataaaagatgtgtattttctcacagttccggaggctgaaaatcaagatcaggatgccaacatggtttgtttctggtgaaggctttcccattgagtcacagacagccaccatcttgctgtgtgctcacatgacttcttctttgggagatagaggatatagatagcaatgatagagacagcgagacagctctgttgtgtttttttgtttgtttgtttgtttgttttttacatgggcactaatcccatcctaggagccccatccttatgacttcatctaaacctaattacccaaagtctccatctccaaaacattctctattagggcttcaatagatgaattttggggagaatgactcatatattcagtcaataacagaatgtttcaataagatagaacttgaggtcttatccttggaatcaccaaggatggggactgtatggttaaccttgagaggtttcagtgctataatctgggtagaagttatactgcaataagttgaggagtttggcattaaaagaagtaggaaattccgacagtatttaaggaggttgaagaagagggaggaagggtatcatagaggagaactttaagcttctttgtaatatctgagaaaagaggtgacaaagaaggaaaagttggaaacataagagagagatcatctggtgtgtgccgggaggcctggccgagagctaggctgttagcagagccatctgacattaatggagaactatgacaatgaagcaccaactctgaggatgtttgtgggtgacactggttctcactcacctgtgttgatgtgtaatggttggtattaacatagtatgaaaaatcaggctgggaacttatcatcatttttattaaaatttgaaaataaaccccatcctactgattttattgggcctctggacttataaacattgacagtaagatttgagaagggacaaatgagggaaagcctggaaaggaaggtgtgttcttctggaattactgatgggctggagcactctcagcctgtaagtaggtgccctttgtagaagaaagaagggtaggctgggcatggtagctcacgcctatagtcctagcattttgggaggctgaggtgggtgaatcacctgaggtcaggagttcaagaccagcctggacaacatggcaaatctctgtctctactaaacatgcaaaaataaaattagccaggcgtggtggcatgcacctgtaatcccagctacttgggaggctgaggcaggagaatagcttgaacctaggaggcgaaggttgcagtgagccaagatcacaccactgcactccagcctgggcaacaagagcaaaactccatctccaaaacaacaacaaacaacaacaacaaaaagaataaaggagaaggagaagaagaagaaagaagggtattgtgtatccagagttagactcagttggggatacagcatgcacatctgttctgtgtgattggaaagagttagaaatccttagacccatccctgacgggtcatagtgcctaggtggccagcgcaaggatatttcgtttgaggtaaagtcctgtgctcctcaaaaaatcaggccagaatgttctcacttcctgaaagatgccacactttttcttcacatgaaggcccttagaatactttagaacgaacgtagcttagtaagtaaatggtgtgtggaggacaatgctgctgcaggagaccacctggaaagccacatgctcaagtgcaaggaaggggcgaatggccccaggataatggagatgcacattccctgtccccagcctggtgcagcaaatttgcagtcaccaccatttccttgatttttctcttgcaaataacacacttgctccacaaataacacagaaatagctacttttaatacttttaatacttatggctcatattttcaagttctcacctgagacagaccatgggcacctattatgctatatcttcaaagagaacataattccttttaaatataggtcatcttttatatttcagattcagataaacttgtatagtcaatgcatattcaagttctgaaacttaatattttattctcatatgttaatgtgtagtttctaaactgaatccataaatattcccagataattatgtgtaatggcccaaggtgggtacattcataacaccatcatgcaaataaagaatctgaggcttggaaagctcaatgccatttttataagaggagtaaatggggccaaaaatcattgttttctggataaaaatcacttatttttatcattcagtggctctctaagtgtgttacctcaataatgtatttattattcacgcattaaattcaattaataagagatagagcccattcccaaaaaattcatggtataacacgtggttacaatctcattgtgtgcatgaaatgataagaaacagtataatgtggtgactcatgtgaatgggaaatttcagagtcagatgttgtttttagtcagtttgaactgctataactaaaatatcatagactgggtgacttaagagcagaaatatattgctcacagttctggaggctgagaagtcctagattagggtgctagcaggtgaggtcctagtgagggtcctcttctggtttgaagatggccatcttctcattgtatcctcacatgatagagagcagaggagggaggaagcaagctctctcctgtatcttcattagggcactgattccttcatgagggcaccaccctcctgatctaattatcttccaaaggccctacctcttcatactctcacattgggagattttaacatatgagttttggaaaacacaaacattcagctcatagcagatgtctatcgagtcatctgttttctttcaaattactagtccttgggcaaattgcttaacttctatgtgtttcagttataaaaatggataataatagtgcttatctcatagggttctgaggaggataaaatgagaaaatttgtataaagagcacagcacaatacctaaataattgagaaaaatctcaataattgttagcccgtgacattaaaattataaaaacatgggaaggtatatgaaagttcttatactatactaacataaaattcgtaattaccccttcaagtaaagagagttctagaaactggggatatgccttagccttatgcattcattatattcgtgctataaaaaatagaggagctgtaagtctgctggaagtggaggcatgctactgttactccgtgtgagatgtgtgaagaaggacaccctgtatgacacggtttggcaacctgtccctgcttggcctcagctaaagaaagatgaggtcatttgcatcccatctgctagccttagtgtccagtgtaaagtgttatcaacttaaaagtgaagcagactgtgtgaacgtgttgtaaagctagtccaggagcaaaagtattgagagtttggagaatgaagaaaataagagaaaagtctcagtgggtttggaagcttcagatcacaagaatagagcctaaagggtcattaattagaatactttggctgcaagttatagacgacaacttaagctagcctaagcaaatggggtggggtatttaatgtaaaaatataagaaataatatcaggtatctcatatgacatagaagactgggtccagagtggaaaggctccaggtttctgtcttcttgcctcctgtctcgccctatgccttcttcatcttctcctcagatatctttatttcgtgagcacgcatggtgagtctaaggataaccatgccaatgctcatgagttcacatgttattataggtccagatacccaaagagaatgactgaattccctcaacccacagggttctgcatagcacagagagaaatactgtccatggagggggaagaaaactccatggctctgttagaggatccatttgttatgaaagtttgaggtgtagagtcaactaagtttaaaagccagaccttatcttcacttctattatatagatttctggctataaaatgcctctccattgcctcgggatgaagactaagaaaagacgaacattaagttttgtttttgttttgttttgttttgttttgctttgctttgtcttataaagaaaatagatcattaggacattgtcttctgagttaataaaaatacattttaagttacaggacaacaataaaatattattaacattagttaatagaataaaaaaagaaaatcagtgagtatttaatcaagttaacaaaaaatgtacctataataacattttatttcaacagagtaagggaagccttctataactgaaggcaacttaatactagcctctatgcaaattatctgtaagatatatgaggaattggctgctaacaaaattaggctgagcccctaggtgatgctgctccaggtaatgaaaaacaactctttgaaagaaatcaataacagtaggaaatactttccttccccaaattttccagttataaaaatatattctcaagttaccatgctcctagcaaataccctcaaatactgtgggaattaatatctttttccacttgatcaaacttcatatttctcatattatttggcttagatgggtatgaaaaaatatagacttatgtaataaaagtacattaaaagaaattatgatagtggagttggagtagggatgagggagaacagggatgctgtcagccagttctgtgactgtagctgttgattccattagtgtcttactgcaaacttgaagtaaggtttttataattcagtccttaatttaaaaaaaatacagagtcgactattttgcaaactgtggacaatttattggtaaagaaaatagcacagtctgtgatctttgctttgtcttataaagaaaatagatcattaggacattgtcttctgagttaataaaaatacattataagttacaggacaacaataaaatatgattgttaacattagttaatagaataaaaaaagaaaatcagtgagtatttaatcaagtttgagtgtaggggagtagaggaataccagcaagaaacctggccacaacaatgtgacaaagtgaagttctacaacagaggaggtagggaatgtttgggaggcacctagagggcctctagtaaaggccttggaggtagggaaggtctacgaagctctatggacaatagttcccattagctagaccaagaaggagattaagaaagagggggttaaggtggaggaagtgcagagagcgtattctaggcagagggaccacgatgtaaagagatttggaggcaaacaagacctcagcttattaggaaaatgaagaaaaaaataaaaggtttcagtagggttggtattccttataaggaatgtttgtttagcttcaagtatgtgaagccaaaagttatttcagggctaatcctagtataaaatcacttttgctaggatggttagaattataggcttggtttcaagggctgaaacatacctcttaagatccagaagataaatactgttgactcattcattcaataaacaactttcaagcacctaattgtgtcaggcactgggacaactgcagtggtgaacaaatagatctggctcctgactttgtggaaactgaaatctagctagtagactgggcattgaacaagacaatacaagcatagtgagtgtttctatgagaagtacgggtgttatgggagtgttattagaagtctccaaccagtccaagaatgctggaaatatttccaggaagcattaccctagctaagatttctgaagaaggagaagcagttggttaggaaaggaagaaggctgatggattagagcagtcagggaatctggatgtaaagacgggaaaaaaagcactcacagatgatggaaatgaagcaattccaggatgcctggagcagaggaagtaagaaggaaaacagtgagacaagactggacaggcctctagggccagattacttagaactagttagaggaagccttatgagcttggaccttatcttctggacaatgagaatccactcaggtcacagagcagtgtgcactgtgattggtgagatgtgtgtttcagaactatcactgtacccccagtatgcaggatgtttaggagacgagcaagatatgagcctgagctccaggaggagactggtacagggtccagggaagagattacagtggcctgacctgtggctttgacaggtgggacgaagacagtgaacaaagagaaatacttaagtaagaacaaaagtaaaagtaaagttgctcaaaaaattcaatgttaagatatacacagagccaacagagacatgcctttgcctcaggattgttgggctacaagacctataaaagttgaactatcaccagaataaatgtataaacatactaaaacatgactgatctggaaaaggaggagagcagagaaaagcagtcacccaagaaaacattggaaatggccacagatctctgtaaggtggaggtgggtgaagggcttggtgaccaatgggttcattacaaatttaagatgaacctaactgtcttcatttgatgccatcaaatgtttaactattgaaccttgtaaccctccatcccctccttctgcctccctgtgaacaagcaatggtcaagtcttgtctccccttacaagtctattgatatatgttgcagcattgtcaacgctgtatgttatttccattgcaaatgaaagtggaatgaattctggcatgtgacaatcttacttcatgaactgtttaatataagccttatcctagctgacatatcgttctttcaggggcagacaaaaataagccctgcatttaggattgacctgagaggtgagtagtgggaaagacaacagcaagaccgagagccagatcctggctggcccttggaaaacccttcattaggaatgtgcagtctttggggttcatagcagctcaccatgtttttcacatttttttttgtagagttcagttcatttacagtagagatgacaatacccacattctgcttatcacactacccatgaacatactacattcatatggcatcatactgttctaagatattgaattatgtagtaagtagattttaagaatcagctcaaagtttgtttcccaaagcctaccttattatacctgtgctcagcttttctgacagaaattcatagatggctcatgtgttaacatgtactacatctatatttcatttctcccacaggaagaatcctaactcccaagaaaacagatgagagagtcagaatatctcataagtatatatttttattattccatgatagtcatacaaatgtcctagaataactactaatactaccactaccaactcattactgagaagagttaaaacaaatttcatactaccttcccatctcctccttttaaaatagttttactatatctacattatctgagtacaataccatctttcttttaacttttatttcatcttagttctataattaaggatatgtttaacacttacctcctgttcctatgatgatggctccctagttatttcactagtctgaagcttataatcttgttctagagtagatttctcaggaaaagttcatgggactaaaacttagattttgcttattgaaaacattttgtctacaatctttatctcaaaagccaattttgctggatataattcagggtgcacattttatttttctgaagtgttttcaatatgttgttccagttacctttagtataaaagctttgctgcccccaaatctgataataatcttttttcccttataaaacccttactgatttttcctggacatccaaaatatatttttctttttctataaagtctagtgattttactagaacaattattggtattgattgtattaggtcaatattcttagaaatgtaatgctctcttttaacatggatttacatttttttaattttaggaaagttttcttgaattacagtcttcagcatttctttccttgctttagttttctttgtcaagaattcctagtatctatatattaaatcatcttttacacattttctgtaatcctttttattctctcatttcatgtacatgctattgaagtataattatatacaataatatgcattgatattaatgacagtttgatatattctacaaatgtgtaatacactcatgaaaccaacatacaaccaaaacctaggacattgccctcactctagaaagtttcctagtgtccctttttaaactatcctgctctccaattagagacaaccattattctgatttcttgccccatatattaatcttgcctgttcttgaacttaataaaaatgaaatcataaggtagatattattatgtctctattctttcacacaacatgagattcatccatgttcttgcatgtaacaagagcttattccctttaattgctgagtaatgttccattgcatgaatacacaatgtttattcttctggtgatgaacatatgggttgtttctaactctcactatgacaaataaaggtacaatcaacatacatacacaagattttattaacatatattttcacttagtgtggttatatgcttaggaatgaaattgctgcatgataaggcaggtgcatgtttaacttataagaaattgccaaacaaatttacacaatacttttgtcattctgcctcctaccaagaatgtatgagacgcatttggtgttgatagtcttttaaattttagccactctaatgcgtatgtagaggtatttaattatagtttccatttgcattttcctgatgactaatgatcttgagagtctttttatgtgtttattggccatctatataccatctttttgtgaaatatctatccaaattctttcttcttttattgggccgtttgccttttattattattattattattattattatttttgttgttgttgttgagatggagtctcacactgtcgtccacgctggagtggagtggcacgatctcggcgcactgcaagctccgcctccgggttcacgccattctcctgcctcagcctcccaagtagctgggactacaggcgcccgccaccacgcctggctaattttttgtatttttagtagagacggggtttcaccctgttagccagaatggtcttgatctcctgaccttgtgatccgcccgcctcggcctcccgaagtgctggcattacaggtgtgagccaccacacctggcctgccttttattattaatcgtataatctggatttgaattctttgtcagatttatttattgcaaatattttttctcagtctttgacttttcatttcttattggtattttctgatgaatgaaagtttttaattttgatgaagtccaattgataaattttccttttacagttagtgcatagttcagtgcagaaaccttgcctattcccagatcatagagatattctcctgtgttttttctaggaggtttattgttttgacttttacatttattactgtaatgcattattactgtattgcattattactgtactacatcttgtaatacataagcaacatgtcttagtttgtgtggctataacaaagccatccatagactgggtggcttatataccatagaagtttattttttacagttctggaacatgaagtctgagaatagggtagcagcatgggcaggttctggtgagggccctcttccaccatgcagactgttgtattctttttgtatcttcacctggcagagacattggaaaactccctggggtctctttcataaaggtagtaatctcacttctgaagcctctaccctcatgacctaattgcctcccaagtgccccacttcctaatatcatcacactgggagttaggatttcaatgcataaatttggaggaggcacattcagttcataatagaatggatcgaggtttttgtttttgtttttttctaaatatacattcagttcacccagataaatttttgaaaatattgccttccctcattaaatgactggtacttttgtcaacatcaactgaacatacgtttagtcctgattatgaaccctctctattctgttctatccatgtattcatctatctttttgcaaataccacactgacctgattactgaaactttagtctgaaaatcaggtagtgtaagtccttcaacttcgttcttattttccatgattgttttggccattccaggtttagaatatcattttcattattcaaaagttcatcgttatgtttgatgctatctctaggttttgcagagatgcccattaatagggttgaagatattcccttatactcttaagtttgctgagaaattgatcacaaataagcattgaattttgtcagattcttctgtatcagttgaaatgattatatttttctatgttactgggaaaatatattgaattatcaaatattaatcaaaccctgaatttctaatataagctctcctttgtcctctatatagactactagaaacagggtctactttgtctgacattagtataactactagcttttatttttgtttggtacttgcatgatataccattttccatcctttgattttcagctttctaacctttgactttcaccttttgtgtttatatgtttaaggattgtgtcttatatgtgcagcatgtaagtttgattttgcttttcagtcagtctgataatgtttacctttaaattagaatatctagtttatttatatgtaatataaatgctgacataattatatcaaccacttaattattttctatttgtctcactggatttatgttccattttattttttttccttcttttgattagtctaatatttatcaaaataataatcactagtattttaatattcaactttctcctgtattagtttgttagctctacattcttttattattttttatggttatcatagaaattacaaaaaaaattaatcttttatagtctcaaataaattagtagttttatcactttccaagcaaggcaaggatcatgaaacacttaaatttatcttgcatcactgttgtgcttttttcacatgcatttcatttctatacatattttacatcctatcttatattattattaatgtgattgatttgcataatcaatatctatgtatccccatatgtttctcctttacgttataatccagttacggactgagctgatttgatgtggactgtggttttataaaacttgttctgcttcacctggtgcatcctgttctgagggtagagctatccgggggtcctggctgagattctgggttccgatggtgtacttgaacctctaatcctttgaaagtcttgactccaattttgattcctcagcaccgtgagacttccagaaactttactctgattttcagcagcttactgcttagttttgtaccctgtgccttgtgtagcctaaaatgtgataaatatgaaaatttttctagagggaaaccaccaagtgtcagtctcacttttctttacttccctctctccaggatctcggttcctcaagttctagctgccttggagcacttgaattcaaaattttatgtctacagtcctgtgaatgtatcaaaaattttccttgcttctttgcctcttagttaagactctctgcctggattcttagtctgttgtcctgtatcaagaatcatcaaaaattccaaggggaaaaacagcttgaagatgatccgcttacctctctgaagtcctgttccttctaatttgttgatccgttgcattctggtgctgtgacagcttctcaatatcttccagtggtttaaaaaaatttatctggtttttcttgttgttttcagtgggagagttagtttgccctggggtactacatattagctgaaagcagaagtcttcttatgccaatcttgatccctcccttttatattatatctaccacttaacactattggaggatgttagaaaaccaatacctttctcaataggctgtgatgtggctatgatgttctttaggactatggtgattacacttgtaatactatgagagaaattgtatgataattgcttattcagttctgtttcaggttccatgtgtgatgacatgaagctattaacgcctctgcttcaagagaaatactagtgtaaaataaacgttagtggaagtaggcatctaatattgaggttagtgctatagccaagaatttcagaattctcacaaaatttaggtttttgtgttataagtcctttataattatcattacatcttcagttctaagcctcttactaaataattatttcttcttttcaaaacatcctgaggtgaaaattttaacttttggcaagttgttttcatcatccttttctcttcccctctgtaataaatcaaagtaaggtaataaaaagtctgactttggaagtttgtcatctaaagtctctctggaagcacagcaggctattttcccttttgtgtaacttgatctaccttttttttcctcctaattttgagcggctgctttctcattagaaaagatgcctatatgtgagaacaaacacttaaaatgtatgtacagttaaataatgtatttacaacatgaaaagtactaactgtactctactgtggagttctgaagtaagaaaagcttcagtagtaattaacttaaaaatattagtactgtgccaaattctgtcatttacatttggcgtgtctccttagtagctgttcatatcttttaatatacagttttagaatgtttacattatatctttttttaagtgaaagaaaatatgtatgcagccccatatagtatcttagttcctggggtaaagctaagaggaaaaagaatcatggtctgaattattaggtcatgataaatttatttttataatagaagttattgcttatttttatattaaaaataataaatatttacagtgtgcaatttggaatatattgggaagcacaaggaagctaatattaattacttccaattatacctagaaagaaaaatcaccactgatatttttatgtatatcctcattttaacacacacgtatacatacatgcatatacatacacactatttttactatttttttaatttaaattttcctggggatattatgacattcaatattaaattttataattaatttaagaatttataataaaaataattgcttttgctatcccttcaattagcaaagtaatagagaagctcaaaattatttcttgctaatattcatacttggaatatttccatattctgttttgatttattcagtcattcatttaacactcataataagtagagtggccatatgtctttgtacctacccaggcagtcccaatttatcccttttttatggcttaattataaagaaaacttctttcacgcttaaaagtaatgttcgcatgagaaattctatggttttcttaattatttgaaaaaattggggcatatgaaagcagaataatgtggcacataaggtaattctgacatgaattatgtcagtctttagagactatggcctatgggagattagaattaacattaataacatataaggagtaaaaaggatcacaggagaggtactgagatttcgcctacattgcaatgtgaattgtacaggaacttgacaaacatgttggaattgtgaaggaaacatatgcaagattccacgaaggctaaggatcctttagggaacctaaacattatcaaagaaacagacggaagaaaaatattaagatatcattttacaatccttggtttggcaaaaattaagaaataaagaattctgatgagacttttgttttggatagcatgaaagagactgtggcggaatagctcccaagaagaataattggaaaaacaataggaaggacaaagataatttatttacagcatcagggagctactgaaatgatgaagattaatgagactcaaatttcagagagaagagaaatgaaaactgagacaattatctgcaacagtgtttccacgggacaagcactaatagtgcaaatttgccagttcagggcactatatggaggctgagtgtatttgttcattctcacactgctatatggaactacctgagactaggtaatttatgaagaaaagaggtctaattgacccacagttccacaggcttaacaggaatcacgactgggaggcctcaggaaacttacaaacatggcagaaggcgaagggaaagcaaacacgtcttaccatggcagagcaggaaagcaagtgagtgaagggggaagtgccacacaccttcaaacaaccagatctcctgagagcacactcactatcacaagaacagcaagggggaagggggaagcctgcttccgtgatgcaatcacctcccacgagaccccttctctgacatgctgggattacaatttgagatgggatttgggtgggacagagagccaaaccatattcctgagtttccaggcttgggcttggcagagaatcaatggaaggaccagaggaaacaggaaatcttttggtcacaaaggactggggtgaggaaatgaaaggccagagaggcttcaccacaggtccagcttctccctcaacacatttgctgatgtctgccattgggtgggtcagaaagattaaaagataagctgaatacatctgacatacaaaataggtttccatggagttctccagtgctgagagacagactcatcgaggagagggctcaaaaacacttttgtaatcatgtgaagctaaaatgacaaaattgaagactcaaagtcattcaaacacatgatcaaggctccctgacaagatattttcctaattttgaagctatctgcagcagaagaccaaaaatctaaatagaaaaatctttaaaaagcagggaacgtaaagaaagacccaccagatgaagtgcactagtgcacagccaggctttctgttgaaagtcccgaagggatatgccctgtggtagactgatttttatcaaaatgactgtgactcagctcagtcagtggttggattacgttaagcagtgcccctctacttaggagaggaaatggtaaggcaagatagcactttctagggcctctacataatcttattttatatgttcacagtgtctcatctgatataaaatactattaggcataccaagagataggaccatattactggaaaacctagggaaacagacaatagaagcagacccccatgtgatacactattggagaatgttagaaaaccaagtcagtattcttaacattggtaaataaaggaaaagaatcatctatttgccttgcattttctgtttgaactctatctcagagaaactaaatagatgatgagggaaagttctttgttagaagggaaatacagttgacagatacaaaaaggatgatagaattgcattaccactttgtagtctcataataaaataatttatctatactctgataattaatggctgctaagaccaccagaggaaagactgatgggatgttttacaaagtattcatcaggataacaacatctgatatctttgaaaattgccataataaaaagttaattttaaaaatgtctaaaaaccaagcagaatgtctaaaaacctcatacactagtgtaaattgtgcaagaactttgcaaagcaatttggtaatatataagaaagatgaatgtgcatgctcaacaatgtaccaattctagttctaagtaaatatcatgggaaaaaaatctcccattaacaatgtttattgcagtattgataaaatagcaaaatgtaggaaaaaaactaaatggtcatcagtagaagaatggattattttttaaagtgtggtatttgttcaatttagtttaagtgaatgaactagagttatactctagctatacataatactagttatacataataccgtgcaaaaagggaaattgttgaatggaaatgtaatgtcaagtatataaaatataatatgctaaacactatcatgtattatttactaacacatatgaatatacatattcaacataaaatatgccaagtgacaatacataccaatttgtctctttaaaaggagcagattcatatttagaataatatacagagggcttcaaacatatccttaatattttcaaaagaaagaagattttaatagggcaaaatgttaatatttgtcaaatctatggtggtaactaaactgaatgtgattaaaccattctctgtagtctcttactagcttatgaatcttaataattaacaattttgaaatgaagcaatattttacacctatatggaaagactgcattgtgcatatatataaagagttttaatatacatgcatgcgttaaaaggaagggtggaaaaaatttccatttacagagagcctacacacatacccagagctccattctccattcctataaacaaatgctgaaaaacaaacattaaaattcaaaaaacaggcaaaaatgcatttggctttggaaagcaatcagaggcacaaattatgtatttatctataaaaacaacataaaatagactgtaccctgctaaaatggtcttgagtggtggctgtcattctttatgattactttggacagctgctgcattattatttccatggtgagctttctatatttttaagactgaccatctggaattgtatagaacattttatctctgctaaaaagtagattaacctccaaacctccgaaaacatgcaacttcatagacagctaacctgactgtgtgcctcacctgttcctgacaaatccattcaaagtcactgttacccaaataaaaaagtctggaagagagagaaaataaagtttaatttattttctactggaagttattgacattcttgagtaaggaaagtggctgaagtcaacaagtaaagtgaagggaagtttgagatcctatgaaataagtctaagctaaatacacactgatattttaaatgtctgagtcttttgtctgtgtctttatttttccatccttcaaaataagggtattaatagcaatggcttatggattaggctggaatagcattttgctatttgaaagcattttcacacatactttttcaacaatccttctttatggatgaaaaaattgagtctgaaagaagtgatcatacaattggaaagtgccaggcctcctgattcaatgtccagagatctcattgctaacatcatactgagtaaaatttatttgtaacaaattctaacttcatttaaaaaataaatctttacatagaaagtgaagaatgggtgacctgatgtaaataaaatattaaagcaaagtcatactgagttaagtatctctcaaagagagataggctgttatatcaaggaagactatttggacaatggaaatatatgggtaaagttacgcagaatccatcagtgtatgacaagcagtgactttacaaaaggaagaaaggaaaggaaaaaggaatgggaagaggaggagaggagagggaaatggaggagagggaaagggagaggagggagggagggaaagaaaggaaggaaggagggaaagaagaaggaaggagagaagggaaaagaagagagagagacctttgcactttaagaagaaattgaagaggaccctttctaactaaactacttctggggtttctttaaatccacaacttctgccaaaagattcaagcacagatttgggacttatatttgacaagcccccatatgctacattttccctccaagcttttactctggcttgctgaatctgtggttggttgaatatgtggttttacaattgctaaaaataccctgaagtcaacctctttctctcagtttttatgcagttgataaaatggccactctggcctcagattttacatggcttgtcctgtaacctttaataaaacactcctttcataaaagcaaggtctgtatgcagggtcatttatgtttcacttcaatgcaaagtgaaagtcggagaccaaacaaaagggatcataaaggagatgctctattttttttttttttcaaatctctccatcagtagttaattagggtgtctttgggattactgagttactgtgtgaagcttggctgtcaatatgccggaaggcctcaaaggaaccgcagaactgtcccctaactgcaggagtaggttttaagagggaatgcaagtcacagaggccacagagcttcctgtccaatttccgggagacacagaagtacagatgctgcctgggtgcaccacactgtgggactctgctaaggtcagtacaccgagttgctaagttgtcaaggcatccccccgccccttgtttttatcattagacatccccagcaggcaggaccagctgcattgtttgcagggcccagtgcaaaatgaaaacacggagctcctgattcaaaaagcagaggtaaagtgttaaaggtactacattataaagccacagcttctcttgatctgtcatggtgttttgtatttttcatttagtgctgtgttcccttgtgtggggcaaatgaagtcccaccagacacggccatccccattttgtgactgcacgtgctcagcccacaggctgccaggttcctctccagccagtcactgggcagaggtcatagggaagttgaaccggttacctctctttctcatgtcctctttgcctcagcccatattagacaggtgactcccaagggtattgcaataacagtgcagagacacctaaggtatctggataaaggatgtgcaagaggcttgccactgcgtgttgcctaccaaaagtgcagtggcacttccggtccagggaggagacagccactgccattcattgccttgagatagtacagggcacatatatcagaccctgatcttgtcgggacttatgcccaaccccttgtcaatggtggaaagtggtagtgatttctagacaggggcaggtagtgggaggctggacagggctgggacccaggggacaagagtccgaaaatcccaaagcctgtccagaaaggcagggaggctgcaagatgtgggccatgtgtaaactgaggctccaatctcccagcgcatgctctatttccccattgaccatcacttgcaaaacacaaattaaaagataacatttttatgaatttcaagaggatgattacagagcactaaacatcaagtgcagggctcttcggaggtagagattgtgtttgtctgtctgtctgttctggttccaggcccgtgaagctggtcctgccagggccccagttcccagtgccaattgaacaggccacatacagacattcctcaaaagtagagttaattagaggctcaagaacatgcaaacaaggcaaagcctaatgctttgagtgtattttctatcttctttcatgagaaataaagttgcttgaatatcattttacatattacttcccactacatttacatattcagacatacctttattcctgatcatctccttgctaacatttacattgttttaatgatcttttgatttcgagtaggcatcttgaatgtcaggggcatattaccttgataagtttgatagcaaacagtgtctgtttttctaattttattaaatgaatggattattgcagtaataatgaagttacaccaaggtgtctcaaattcttatcttttgatgaggatttcaaattactctcggtaaatcatgcacctttaaatgatttcatgaatggtccaaacttgatggaattgtacatatggattaactttgttttttctctgttacattcaatgtgctatggaaaatcttttcctgccttatacattcagttcaaatcccttgctttcaggtagtgaacatctgttccagagtattcttgtttaaaatttaaaactcacagctcttcttcccagcacctgtcaggcctcagcctgagagacttggaatgggaaggggcatggtctcctcctgcaatacctcttcctcctctttcttctgagttttcactcgtctgtctactttgatgggaaaaagagatagaagagaaggaaaaggtctttgatttgccaggagccattttggtcctcttccaggttaccctggacagttgtcaccaggatcttctgggtagagggtcagatgttgactcatagagaacattgatgagtttgaggagccctgtagagaactgcatcatggccagagtcccctgacatgagagatttctccccagttgaaccagcttcacccataccacctgtagcatgtgctgatagttcaccctaagcatcttgtacctgaaattcttttctatgacaggcagcccgcttatgtggcatgacagccagacagctttatcccatcaccttctgcagtgctagctgactcatgggaaatgcacttatccttattccaacaaatgatggaaaggccgactacccctggctgcccatcagccttgtcatgtctagctagttctcttctccatctgccaaaggggcacagaagccagactatcctaggtgctgtataaggagacatccagctagggaatgagatgatattcttcctgtgtgcagattcttccaatctcaacaggtgggtctgttgctgctccctctctctctaccactggacactttctgtcttgtgaatgccaagagataaatatatgaagtgacagcaatgcattcattatgccataatatgcaggaaaattaacagtgcaattaaaagtcacagtgtcagacataaactcatgcacttcctttaggagtagagggtgggaagaatcagcctacatcagtgtaagtagagatgaagtccactgccacaagggataaagaagtgtgtcaacagtggagggaaagagcaaacctggggtagacacacacacacacacacagcaaaaaaagcatctgccacttggaaagagatgcaccccactgacagggttttaagaaatagcctggcaatgagaaacagccaggcagagcaaggaccatagagcaaacggaggtggaggcaatacagagcaaggctcagggccaggcactgcctgagtggtggacttgccatatctgtacacatgtataaccccctcgctcactgggtgtctttttcttttcaatcttcaggaagaggcagccagaattctcgcccaccagccaatgtccgtcggcacatgtgcagctttgaaaacccccacactgcagtgaatgtgtaagagaagctgcatggaaaatctagtgttttgccccttgctttctctctcctgggtttttccactttctaacatggaaacagatgtggtgcatgccatcagaatgaagaattcatttacgtgccatggtttgcacgactgccttaaattgattgtccatcgttcttaaaaggacactgtcaagttgttcatttaggctttttgcttttttatgttttgatgcactattttttttttctgattctggagactcacttttgtttgtgactcccactcacaagcccgaaagtgaattttcccccttcagaaatttgtcagcttctccttggcaaacagagctctttcttttcttttctttttttgcctttttgcggttgcacaaatgtttgaaatgatgctgtctgcactaaagtaaaagccatagcttgaatttatggaagagttctatcatgtcagtttgcgggggtgggtgccaacatgagcctctgctgggtgcctcccacaccctggggagcacaaaacaaaagttttgtgagtcccacaaaaagtacactttacaaaaaggaaaagtagtcattttcctaacattatgagtgatttttatcagatttcctcgtctgataaaaatgatgcatgtttggtcccatttttgacctttagctcttgacagtgtctttttaagttaacaaaagaacatagaccatgttcagttcgttgtgcacggagtctgtggtcattttcagctgttcctttacagcccttcaaactccttggagagtcaaaggtacacattcctgcagcaggagggagcccactgatgaggtgtctgtggcttgaatagctcttcagatgagaagagcccaatttgttcaaatgtctgctactgaacctggccatggaggctgatgaatagggccataacatctcttcccttcactcagtggagtgcaatgggaagtctgttgtctgcctttctgctattcctcatacaaacccaaatagaaagagtgtggtctccaccaaatcatattgattcttagaagaacaaatatggtagtcctgctggtgttccaggtagtaactgagaggtgtctgcgcatctaggtcagagccactctactgtggctggatgaattctctgtaattctcccaagctcagaaggcactgagtgtttcttgtatcatggggtgagtctaaccaaggacacagcaaggagattctaattgtgagagctgctggctgcctgtcaaaaaggattgatgggaatgggtagatgtgcttgtcttgtcctgacagcagggccagagagagaggagagttgactgacattttgtaactaaaaggtgagtgcctaaaagcaaaagtaaaagctgaatgtggtacatccctggtgggtgacaaaaaataaagtaacagtcagcaaagctaacagattggccgttaagaactttcagaataggatctattcaaactttccttcttcagaccataaaggattaggaagagataagtaggtttaaatctgtgcaccatacactaaactaagactggatatttttagccatggttgttcctgttaaatttttttttaaagatatgttcttctgtgaccttcagttcccactgtttttgtgaataggcaaggcaaagagattagtgatgacggaaataaagctgcctactggaccattatggtctgtctagatctatcctactcctgagaaataatcccaacagagcaatgcaactgtaatttttattgcaattagaaaattggtgaattttccagttgcaggaaatatggcagttgcatttctttgttgggaaattggcaaattagaaaatttaccagttttcccatttctcagggtgaattatgagaactccaggtagagctgaggagcataaaaatctcttactattaagagattgtttctggtagcacaaagtatagaagaaataataatgtttgacctgaagttcctttaaagggagcgtaatttaagttcatctatacttcctgaagaaatataatcatatttgttatacctctgctaaagcaacgccatggtaccaacatgttgtcttaaatagactttggtaggagaatttcttagatcagccagtaatcatgattaggttgaactaaagaccattcaaactgtacttggaaaaattttagtatccatcagaattctattctttaatatgaaataaattgggtaatgttctcaggagagtggagcctctacccagacaaactttatggtgccttctatactttactgaatttgattaggtaattttatttctgaatgtctttttctttattgatcagatgaagaaagcacaggtcttaataagggcaaactgattttctttgtattgtcttttatctagtgtcatataacttgaggatgtaggatgtaattgatctaaagatcctaaaagaagaactgcatacttagactttgtgatattctctaattttagcaagccaatgactctctgactagcttatgatgaaggtagaattaaaggggaaaaggctaagattcacaatgccatttaagatgtcatatcaacagaaactaccaagttctcatataattagaaagcatttgtcttaaaaaacacctcagaaattctttaccttacagctagtggtgagtcaaaaaggcgagaaattgtaattatgttcagataggcccccaagtttgagaatacattctaaatatgcagatttttctggaaggctttcaagaagtggagctggagtcagtgggagtcctttgtattgatgacaaactcgaggttgcctgggaaaacagaagtctgatacaactggtgtcaaatagttcctaggcctgagattctacaagacctacttctcaagctgcactagggtaccagagggctgacgaatgtgaagttgaaatatctggacagctgtatttccagcattcctttgggaaagtcttggtggggtcagaacctccccttccttgacaggcctcatgttctagctgtagctgcgggagccagagcagaactgtcccgaagtctgtgcctttttatcttttttcttggtgagccaattccctccttgctgggactcaatggtgttttccgtttccattttcactttcagagaaaacaaatgctaccctcctcaggttcccaggagtgagcctctctttcttacgcgaaggtcttgcattatctgtgggctttctggatactgtccttgtatctgttgtgaagctattaagcctagaggcaaagacttgatttggacataagagagacaggtgttgtgtaagcttccccttcaggcagtttgtgcaggaggcttccctcctgatgatctcaaacacccacccactgttattcccattttaaacctctctggatcagagaacagtgtactctgcagatgtaactagtacttactgaaacaaataaaacagacaggatcactgaatgccaaagatacactaatctatttacaccacccactctcaactattctctaaagtgccgtaaatattgggttttctgtttgggggattgcgatagctaactaatgaaagaaaaaccaaagcaagatcccgaacctgttgttgctggaactgcaacctcaggcctgcctagctgtccacacagtaactatacattatcctatacatcctgtaggcctaacagtgttttcctccaattgagccacctgagatatttactctaaatgcctctgcatttgatcttcaaatataagattgatttaggcctcaggtctgtcttttgaagtcggagcaaaaggttcaggtgctttgtaacaattatgtggtgttttctaaaccagattgcttttcctaagattaggaagccaaataaaattaaacaatagaaggaagaagctggtggcagaagcagaaacgattaaagttatctgggattaaataaatgtcatattgcaggataatattgcatttttataatgtatttattctttcttgatataaatggatttgattttacatatttttctcttcttaatatcacagtagtgggttccctgccttctcaaataagatactctcttttctcaccaaaacagttcttaagccttcacctgaatctattattactaaatatacctctcttcacggccatttgaatacagaacaaaacaaaagcttcccagaatttagttacacatgtattgaataacactctttatcataacagcatctacatacatttaaaaacagcagtgcattgtctacaaatacataatatttattcagtttaaaaacaatgcttaatgcaggtatagatgcatggacctttcagattatctatggaccacaggtaagaaatgactcatcttgaagaactaaagtttgtactcagtgctgcaatgtctgtgagatgatacattccttctactatgtttgatttttaaaaagcagtttattttatccttgaaaaaagattacactaattttcttaatctgataaatgccctgaggtgtgagatctgtttcctaattaaaagtactttacagcaaatctagagcaagactgaggggaacgaaagttaccagttttgaaggccatagtgaaaatgtcccatctcaacaataaaaattggatttaattaaaacagaactaaattctgattatatctgtctgcaacatgattaataatactgttaacttatgggtgcttttgatttaaaaagaggcccacatagaacctgtggacaatgaggaaaacagcccatgtgaatgagtgggtgaagtggatcacattagggctttcaggaaacaaggtacctttttgctattatgtgtagaaactaaggcaatgtgtcattggaacagctaagcctgctggttgaattagaggcagattatttctcaagggacctgtttgttgttgttgttgttgttgttttaacacacacacacacacaactaaatagatacaggataacattttgtttaagcattttcctggtgaacattaaaaaggcatttcctaatgcctatgaagaagtgggaagatggggaaggaaacatttttttcattgcaatttaaaatgatgcaaattattgagttggatgctatatatagtaaggcatacttaaggagggtaagaggcaaataagttttatatttgcctttctagaagaggcatattgaatgcataaaaaaaacaaagtgtgtatagtggtagatgatggggcagttgaaaaagattaagtggaagatgagtttacctacagttttaagctcagaagagcaactgtggattctggtggtgattctggctagctggttgactacctgttcttgccagggacaccactgacctgttctttagtttgtttacctcagaaaagagtcagctattccaacaagatagtgtggaagtcaataagacaatttttaaaaactttacaagcacttccacagtctcagataatgtgtaaggcatatatttgaaagaaatattaactttgacataacagagatgagctttgtcttagacaattaaaaatgcagtgtagggtatcagatatatggaggaactacctatttctcaaataatcaggtcaaaactttaactgttttatctattttagagcctttatatccagaattttctataatcaatatcagacatttacactcatctgtacttatctggctcactttacttttcaagattataaaatatgaaatgtcaaaatattaccttcatcataaatgatgctcacatataatttttgaagtattcgttcttgtattctcaagatgatgaaataaaccattatttaaactactgatcatttcctacattttttccaaacaaaaactagaatatggattagtctatttcacacctccacttaaagaaaaaaatgtccatttttatattccttttaatgtcataaatgtgttactattatgctactttctctgtcattttactgagtacagagaaaaagcaaacttctaaaaaaagaaaagaaacaattatttcctgatttaaggattccaccgttgttattagtagaaggctatggtaaggtaccaacatctgcttaaagttatacagaaaagaagctgagtccagaagtgagatcagagttattacaatagacagaacagaatttggggtgtaggccacagtacatcttcttattttcttattcagggagaaattccatatggctgcttttctgtgggtgccatgaagatgggagttgataaggctgggatgctcctggcaccctaagactcttcttcaccaaggctcaatgagtagaggttttcgtctcagtaactgctgctttgtctcaatcataattttctcttatttgcatcaaactatcctaaagcaggatgtgggcatttgtatttttcctggcttcctcattctattgcttttcaaatacagctatttcaatgttcctagagtgaaaatcccaaaccagcttctgtgagtcagggcctttgtgtgaattgtgatccactgtatgtgtgagaaataatgcattgaaatgttttaaaaaaatcaaaagctatgaagctcataaattgaccatgagtctgagtttttctgtcatctgcttttttatgttccttataggtaccctgtgtgatcacgccaccctggtcatgggaaatacttgcatatgagaatgggcaactgagaggatctattttataatcccacaacacaacgagagtagctttgtatgtgggtcctaatttgtcccaaggacaatagccattattttggttgtccatgtgtaactaagattttttttttaaagttttcctccatcagttgggagtttttcaaaagtgtgtgtgtgtgtgtgtgtgtgtgtgtgtgtgtcagagagagacagagggagagggagagagtgcaacggagaaaaaagagaggtttgtgaaatcttagacctaaatgaaaatagctatttctacaacagactggcttttctcctcaacaacttttctcagggtcaatatttccttcagcttttggtgttctttttgtaagaggaggtatggggtgctggagcaaaggcctacagcagagacagcagttaaatcacactgagctaggtttgcatatgttttctatgtattttatcctgtgtgcatgatctatctgcaaataaatccatctctattttattcatagttctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctattt

SEQ ID NO: 274 - DNA, 409950 bp, Homo sapiens; identical to SEQ ID NO: 273

SEQ ID NO: 275 - DNA, 331715 bp, Homo sapiens
taatgcatatcctctttatttggctttttaaaatcactgtttattccatttggtagagggttttatttttttccatacaaatatttgaacaattttgaattccccaaaaccatacatagacgataaataccatgctattaaagtattaaatttgtacaaaaatactttacagtttaatacttgtttgttacaaataaaaatacatatttaagtgactcatgatctttttttcttttttcttaacatgatcctgctttatactttcttgccctggcggttctgaaatgtgattgaaataatattttttttgcacaaaaagaaaggtgattttttttttatatttccttaaacaaaggacacagtgttcgaatactttgcctaagtggtagtttgaattattgaccaaaatgaaaatgtttggaaaataatcatttcaatatggagagtctaccatcaatatacagatctatttatttttttatgttcaccaaataataacagttattagtgtagctattcaaaatatctgaacaaatgaaaacagttgctgacaaacatttaaagcaactgtcacaatttattgctttgagggatggtaataattggcaatgcatttgtgaaaaatgtatttacaatttcggtaagtggcatggctcagagcaaaagatagtccagtgtcatttttaagtacatgtgctgtacaccctcaatattaccagttttcaaaacatgtcaagcagtatgagtttggtttgcctatcattaagatgaacctcattttaatagactcttcattctctgaagttcttagtcttgaattttaaaaataagataatataactaattctcatgtttactacacactctaattcattatcagagattttcagctattaaaaatgtgtccttaaaaaaaaaacaggtcacaagacatatcctgtttgataatttgttgcatagggaatagcatacatcttagttaaaatcattcctatacgtgggcaaaacatttaccaccacctattatggtctcctacgtgcatcattgctgaaacattttaagataacttaattttatacctgtacccctcccattgtggtagtcccagcagtttaccaaacactagttcccctagtagagccagcctatgagaagaaaagctttgttggccaagttcttacattaatgacttcatagtaagaaactgatttcaaagtgaattaaggaaatcatcacagagaatattttcaaacagatgtttctctttttaaaaagtgatagtaagatgaacttgtaaaaaatttcctctgatgttaattgtagagttgtgggggacggcctatttttctctaccgttgggactggcagggcattgcccaccatataccatagtggtcaccaaaaaagaaacctcttcaacttgaaaagggaagtgaacatgagccatgagagagatttaaaagacccctgtgcttgcagttaatgccacgttgattgattatctgtgcttcaaaggtcacagaaatcttaaaggatttttagcaccatgtagatattgtcttttgtcctgctttataaaaagcgttgctataatgtattagtgggttctcgtgtctccaaattaccaccgtggctaggctgctggaaaaaagcactgttctgttcactccaatctcctggtagactctgttggtctatagacttctgtgaagccagtgggtttctactaataaccaggtccagcttattcccggattctgctatgaggggcacaacaaggcagcagtcaaagtctctggttcggacatgattcacctgaaaggtcaagaacagccattttgaattatcgttgtaaccataattcccaaaacccggagtaacatttcaggtgcaacaagttgtttgaagtcatgaaggtgctaaaatgagcgccatgaggtctatccttgtgactatgctgtgacatggctactggctcaattgccattgtctgctagtaaattgtaagactctcgagggcaaggaagacatacacatcctacctatcctcatgccaaggaggtggctccacccacagtgggggtgctgcaagtgctgaatattatccctaatttacagatgagaaaagcaagccacaaagaggttaagagctttgccttagatcagtagttggtaagggtcataggatgtaatcccaggccaactggctgatctcaaagcctgtgctctgaatcacgatgctgaactacctctcccacaagcgagctccaccaggtgcagtggctcacacctgtcattgtggcacttgaggagaacaagatgggaggatcgcttgatgccaggagtttgagaccagcctgggcaacatagtgagaccctgtctctactaagaaaatttttttaaaaaaatgagcttatcccctcttcagcttatacatgcacccatcttcttccatttctccttcttcaccaacacaagtttttaaaatcacccacatgccggttctactccttgatcttccattctctcctcagttttttcaggtcctccctgacacattgcactgctggaaaatgaccctacttgtcaaatccaggaatgttctggagtttgcatcctccttggcgtttagcatttgccgctcgtgacacctcctcacccttaaaactctccttccttagttctacaaccccacttcgttttgatccttttaccattttaactgctcgctttcagtcctttcctgcctttatttcttcctgtcctttacatttggttattgtggccaggtgcagtggctcacacctgttatcgcagtactttgggaggctgaggtgggtggatcccctgaggtcaggagttcgagaccagcctgcccaaaatggtgaaactccatctctactagaaatacaaaattagccgggcatggtggtgggcgcctgtaatcccagctacttgggagctggctgaggcaggagaatcgcttgaacctgggaggcataggttgcagtgagccaagatcacgccactgcactccagcctggatgacaagagagaaactctgtctgaaataaataaatacatagatacattttgttactgttagaatccatccttggttctgttctcttctttgttataaggccaccaagggcaacttgtcctaaaccccacccttcagtatcctaaatctttaactctggctctaatatctctcctcaccaacagatccaaaccaccaaatgcttcccagactgctctatcacaatgtgctgaaaatattaaagactcattagttctgaaagagctgtcttatcttacctacccctacctggactccttgcctgtgatcttctcctccccaacccaccttcgataaacccataataatattgtattgcctttctatgttaccaattatatcattatcctgcttaagaaactaatatgcctccagcataaagttcaagagctttaccatcacattcaaggccctttataatctgaatgtagtctacttttacagcctcaactgcgatgagagtagagctagctctatttatggattaggaagacactcatagaaggtaagtaacttgtccatagttattcattcagcaaatattagcatgtctgcggaaaactaagtgtccccaaactcctaggataagactaattgttctattgccatagtaaaaatcatcaccagaattgattccaaaactatcaaattgatcagtgacaacttgcttcagcgaacacatccctgaaagccaaccaatgagtggcagcctcctgctttgaaagtcagctgtttggtgacaaactgtttccaggtgagtacactgctaagactgacttcaacccactccattttcctgcaaaatgctcttcccaaaaactgtacataagatcagaaatctgctttcctaaataaaactatacctgacctcaatgttactatatttaaagtaagcaaggttcagctttttggtttcagatattgtgagagatactgagatatcaaataccacataatgggaaatgagagaataaggtactatccctgctctcaaaaagtttacaatctgctggggagtatatgcagggaaacaggaaggtggtttttttttttttttttttggaaactcactctgcacccaggctggagtacagtggcatgatctcggctcactgcaacctctgaacaggcagttttaataatgtaaattctaccaaaagcaaaagctgctgttcgatataggaggggcccctagtccagacttgaggtaaaggaggttgggtggtgtctggtgaagttaggctttgaaggggagtcctctaaactagtggttttcaatttggctgctcactggaatcactgggggaggtgtaaaaacacaccgatgccgtatctgtctcctagagtcgctggtttaattggtctggcatttgattgaacattgggatacattctctaggtgattccattttttcaatcaaggttgagaatcgctgatctatgtgagaccaaaaagttgagtcggaatgaggcaggtaaggcctagggattagaagagcattcagagaaaggaaagagtatataaggctcagagccaatgcgcttctattctgctgtgcagtactgagcacttttatgtgacagcattgttcttggaactgagaatagagtggagaataaaatcgctgccctcatggagttacattctagtgggcaacacagaataagcaaataactagcatcatctgtggttgtactgcgaaccaagaaagaagggtgaagaatggagaggcaggaaaggcccttttagacggagtggtttaagtcgcagcatgtgagcagggacctgaagtagaggaaggagcagggaaagagcctgtgcatgtttagcagagaagcgccacaagctcagggcacagcaggtgcaaaggccaggaggtggcagcatacaccattcctgaaacaaatccagctgaagctagagagtatacgaagaggttgcgcacagtggctcacacctataatcccagcactttgggaggccgaggtgggtggatcacttgaggtcaggagtatgagaccagcctggccaacctggtgaaacacggtctctactaaaaatacaaaaattagccacgcatggtggtgtgcacctgtaatcccagctactcgggaggctgaggcaggagaatcacttgaatgcaggaggcagaggttgcagtgagttaagatcgtgccactgcactccagcctgagactctgtctcaaaaaaaaaaaaaaaaggaaaaaagattctaactaactttccatcaacttcaaaaggtccgtcatcaaccctccaattagttagcaaattgcattctggctgggtgtggtggaaggcacctgtaatcccagctacttgggaggccgaggcaggagaatctcttgaacctgcaaggtggcggttgcagtgaaccaagatcacgccactccactccagtgacagagcgagactctgtctcaaaaatgaatgaatgaatgaatgaagaggcaagacaagatgctggcaaggtaaggagaggccaaatccctggggccttgtaggtcatgtagaagacaagtggtaggaaggactagactggtggtgcctggagtcggataactacgtcatatttatgggactactgtgcgatggtgggagatgaccgtggttgggtgaaatctgtgagattgggaaagatggctctgagctcagtgccgaaaaaaactggtaagaaaccacagaactttggggtctgggttagaatttactagagctgaaaattctttattcagctgtttgcttctactgattccataatcttgatgacaaaggctgaaagggaaaagagcaaagggccccaaatatgcaggaggatgtggaggaagctcccagtgagaaattacttgcaaggaattaaaattccacctgaggtcttacctgtaagagcctgtcatagggctttaagccaccaagatctcctggcccagctgggcgaatatttttgacatacactcctttctccagtaagccatctgctacactgaacccaaagtcctccatgtcagagtccttgtacaaggtcacctgaagagagaaaatgggatgtgaatatttagctggggtggagacttttccttctgcaacttcttgatgaacaatcttttcacacgaatttagtcacatcatgatttgtaatatcagcatcagtcagctccctgcaccaatcctgcagcctttttttcccactccaagaatatctttggactttatgaattcccaaccaaagctgaaaaaggaggagaactggaacgtctgggtcctccctccctccttttcagtcgtcatcagggggatataggagagaacttcctcaaggcaagttgacttctactattttcctggggcaacctctggtcagaggagctgcccgcagcagccctttacaactgctgagatgttggggaataagccaaaggcctttccttcctccccactcctgcctggtgctctgctaagcacagtgctcggcgtatcctctctttgggcaagtaccatgaagttcatccttttatttgctctggaacccccaatgagcaccatcacagaacactatgtaaaagacctgaatgtgtctctatgacaacaccttgctctgcacctcggcttaactcgctccctcagcatttgtctagggtttgatttggtaactgaaggcatctaccctgagtgctgcggcctgccccccaccccgggtctctctgcatctaaggccaaccacagctggctaaagcctcactcctccaccagccctcactccttcacctgaccacctgcgagtgttcatctgaggctaaaataatcatttgtatattcatcaaatatttattgagttcctaccatattgtaagcacagcatggggtgctagaaacagcagtgaacaagaggaagaaaagcctgccttccagaggcacacacatgaatatgtagcagtccccaagctctcaccgcactgggcactgcgcccagcagcacactcagcgcttgatgctcagttaacgtttgagggggccacgggttttaccaagttgtgccagatgccctccacaaagacttcaagcaatggtcaggcttaattttctactgtaattatatatatatatttgtttttacacaactaatgcatgaatacattcttgtaaaatagtcaaaacaaaaacaaaaacaaaatcagagctatgcagggcaaaatgtgaaggttaaaactcttatagcaagtatctttgtttatatccagtgattttacttcagagggctatggcattctgaaggcaatatgaaagtggtcagtgtgtgggtttttattttactggacagacagctaaaatatcaagctgactgggtcaacactattcaccaaccagtcccagtggttattgccatattagaggtgaggaaattcaatttcactggggttatgtacccgctcaaggccacaaaggtaagaatggtggggacgtgtctgtgagactccagacaccaagtgcctaatggttctattctcctgccactaaacatgcacctctcggcctcaccactttcagtgtcctcctggacaggagccaccctcaggagccggtgaaaatgcagtctcagacccaccccagaccgactgagaatctgcagaactaatgttccctgagacgaccctcttcacacgctcattccatcattgtgtgtgcatgtgtgtgtgtgtgtgcacacacactggacactactatgcgtcagggactgttttagggactgaggatatttttcacaggatagagtgataaaaaaagtagagcagtgagcaaaacacaacctttatgaggacagcccagtgaagaaatctgatttaatccttataacgattccgtaagatgggtaagagtcttcattttaagaggtgacagatataaagttttctcagtctgccctcacttatacagggatagagtagtaagccccactttactacataaagggtgtgtggggttatgtgtgtgtgtagcctagtgacaccagcacccccacaccggccccaccacccaccgcccatctaacatgctcactggtgatgcttagggagaagtggttaggttcacactgtgtggttgagagcacccctaccttccaaagcaatactcaccagggggagaggggaagactttgctggtggcctgggcttaggtttgtggcagatccccactccccagctccttgaggggagtaggggtcctttttgctcatggatatatctcaagcccctaaggcagcacctgtcacatagtggggttagtattttgacggacagaaagggcttgtcctgcaccttatgaggctgaggatcaaccatgatgtcctgtgcctttatgaatcattgcagagaaagagagtgtgaactaagagagatttaattctggagttccagccatccccctcacccctcacccaaggccatgctgggaatcaggaaggctgtcccatgacaaagtggccaggcaagacaaagctccaaggtcgacactgtgtggacacgagagggagggcacttctggtaccagggccaggccggcctatctgtgggctgaggagacccagattcccggacagtgaggaaggtagggggagggtcctccaatgggggatgctagacttcttgctagtaaggcctgtggatgttgagtgagcagtttagaaagcaaagagatattactgtctctaccagcttgtggagcagatcatatacagacagggaaatgaaagctcaaagagaaatagcaacttgcccaggatcaaactgatggcaacagagaatcggctcaaatcaaggcttctgactgcaaagcttagatcttgccatagcacactctctccttgcctagcacacagttgtttaataaatactcattgcagagaggaatatttaggctgttccacaattatgtttttgccttaggccagataggagatttctgctcctctttcctaaggaaaggaagagtaagtcactggaagaaaatattcttggtgaaaatttcatacatattctagagtagagaggttggaacacccatctattcaccactcagatccaacaaccaccaagagcttgccatgtttccttcagctatccttctcttcttcgggggagtgttttcaagcaaacaccagtccgcatgtcatttcactcctacatacttcagtatacacctccaaaaaatatgatcactttctttcataaactccacatcattaattcactggcaacagcaactcttcttatgtgatagccaccacttcctagtccataatttccccaattgtctcaaaaatgattttttatttttattttatttttaattttttgagacaaggtcttgctctgtcacccaggcaggagtgcagtggcatgacctcggctcactgcaacttggctcactgcctcctgggttcaagcaattctcctatctcagccacctgagtatctgggattacaggcatgagccaccacatctagctaatttttctatttttaatagagacagggtttcgccatgttgaccaggctggtcttgaactcctgagctcaagtgatccgccagccttggcctcccaaagtgctgggattacaggtgtgagccactgtgcccggcctcaaaaacatttttttaagttggcttgcttaagtcagaatcccaacaaagtccacacactacctctgtgttaagtctgttaaatctcctcttacctgtggtgggttctcgtccttccccctgtgctgctgatctattgctgaaactgtgtcatttgctctgtagtatattcctctgtctcccacatttctctaaatggaagttaaatctagatgcttgatttcagtcgaggttagctttgaggtggggactgggggcaggaacagttcataggtggcacagtgcttcctatcacatcatgtctagctgtcctactttgggtgggttcaggtgatgacagcctcattcctctattgtaagggttctcatcaatctttaatctaaaggttttatttattgatcactgtctgaatcaaaatttcattaggggttgcaaagcgataatctttttctaatcctattaacatcttctgtatttattagcctaaatgattttgtaaaggagaattctcttttatcaattagtgctgctttgttactctgaaatacagcttttacaagaagggcagaatgaatgaatgctaattctttcctttcaatttcaaaacagggaatttgttcactaaatacttcgaatggtggcccaatgagaatttgtgtgtggggaaggtgggggatgggatcaatatgaacctataaattttgatatattcaatgcattttttgtttgtgttttgagattgagtctcactctgtgggccaggctggagtgcagtggcacaatctcggctcattgaaacctccacctcctgggttcaagcaattctcgtgcctcggcctcctgagttgctgagattacaggcacctgcccctacgcccggctaatgtttatatttttagtagagatagggttttgccacattggccaggctggtcttgaactcctgatctcaagtgatctgcacaccttggccttccaaaagtgctgggattacaggcgtaagccaccacgcccagcctattcaacgcatttcaatcagttgcattattattcttttggatgctcaaatgttctcatctttggccacaggaagtctttcctgtggactcctgtgtccttttgataggatccattggttttggtcgcttctttactttccggcacaaaatatgactcaccatgaatagttcttatccccgatctggaatcagctattcctccaaggagccttcactggagaaaatattgttgatttatattctattctagtcctttttctttcttttttgagacagggtctcactctgtcaccccgactggaatgcagtggcgcgatctcggctcactgcaacctccacctcccaggctcaggcgatttctcctgcctcagcctcccaaatagctgggattacaggcgcatgccactcctgcatggctaatttttgtagttttagcagagacagggtttcgccatgttggccaggatggtcttgaactcctaacctaaaatgagctcctgacctcctgccatggcctcctaaattgctgagattacaggcatgagccaccacacctggcctattctagtccttttccttctatctccatgctgctttctcaaagggatgaagaggagaaatagtgagagaagggaaaaaatgagaaggaggctagtagttattagaattggtaatagattgacattcttcagaccctgtttactagtgggtgaaatctctctgcccgaggttcctgcttatgtcccactctggctttatctgtgggatctcttgcctttttgccccttttctgtctttgttcttagccacgttttctccacatggcaagcaacacacctggggcagggaccgtcgccaccattcctagagggtggggcatcctccttgctatctccattccacttgcaactaggtacagaggtgcagtcctgcagactctgtgcctacggctagttgggaaagtgcatcagcttctgctctgcaggcctagccatatccttgaggtgcacccacatgtgagggtgctaaatcttaagctttcaatgggagctaggaaactcactttggtcttagatctgaggcatgttttccaacatagtaaaccagaatccttgcatttgaggaaacatttggtgtgggcctggaataatagtgaagttcttcatgactctattggcctgtgattcttgggtgtctgcaccacaggccagaacccaggaggggcacaaggaagagtggcacctaaaactaacaacaccacccaatggtagtacaccaaccaaagcattagagatgagtgccaaccacagtgggttagcagagtagctcattaacttcaaggtcacagttattggcaaagagccttggtttttctgagcctcagagttgaagagttgatggaaaactcttcaggatgagaggctaataaatagtttaaatctaaaagtaatctatttctccagagatatctcccaaggttaaaggatactgaatttcaatagccagctatatggttctcctggaagtagcctagtaatggcaaattaacaaaaataaaattattttaaaactacataaaagataagagtctagaaatcaataattaacaaaaatggggagcacagggggctgttctcaaaccagtagcaatgaattgtgccatatacccctgtttacctggatattggtagtggttaccttggatttacttcctgtgcaaaaataattctaaggattctgaggtttaagttcatacttccccctacccctggaaatgaatcttttatccagttactttcttacatatgattgcttttgatcttacaacacctctgggcagcaaaatcattgcctttccaagaatgaggatactgaaccttgaaaaagttgatggactgacttgtccagttagaatgcagaagcaccaggattcaagactagaatatctgacctcgtttgctgtgttctttccaccaaatcatgatttttttttttttcgacatgtaatctcctagctggtcaggcagcctttattcatttccaactgcccaaccaactaaagatgaataattaatcatgcccactgggtttcttctcatcagagccctttgtggctttccaagaacatctgcataaagtcctgctccatgctcctatggctcaccaacctgtcagttggctttgcattctaccctagcctgtgtaaagcaaaatttttcttgtagggtctgtcttttgtgctgactagaggatgcccccggagaacctggaccatgaacacagttgcaaggtttttctgttctaaaagagccagtgagcttctcggaacataacactcagggctaggatacagttctacaaagctcagttcaattttaactatttgtcagcatgtgctacaattgcttctaaccctcctgagaacagaagctttcacaggaggcagggtgggttcaccatgattcacattcaaccttgttttatatttctaagcaagtctaccgacatgtttgaagaacatcctcaaggccaagatcagaaacccgatgcttatgttttcagttttgacacatgtgaaaggctttaactgcagagccaactctccccacttggattttaagggcaattgcatctgctgtcttgagcaagtcatggcaattgacagccatcccagaagcagtcctcaagctctgacagctccctatggctcactcccttgtcccaatggccttgagaaccaaactgacacctacttctcagaaacagttttcccataaatcaccaggcattttggtttactcatgacagataccactggggtagccccattcctttaactctgacaatttaagtaatgccagttttgaggacaatcctatactacctatggtgctggaagaaaacgaaatagaatacagtcttctaaactggaagcctacagcccaagaagaagcaatctcagtttatactactagaaactcaggggttttgagaggaattgggtcagaaggcagctgctgccttcctgtctggggagtcttcttggctgaggagagaaaggaagagctgctccaaatgccacctcctgcttcattctggcaacagtgtggcaccaagagctggaaaaaatgagggctcaacaatgagagaatcagtagctgggattttggctgtaagtataagcaagccaggggctaccctggcccttggggagctgagtcccaaccaaaaaagttacacagtttttaagatctgtggcagacttaggtgctgcctttctcattcatcccagagcaccttcacacatctactggttcacatagtaacaaaaacgaaagagctagatcattctccaaattctccaagagatcaaaccaagctgcaagcaagcagctagtcccctagttattgccagctccattgctggtcttttgcacttgccccagccaccaccaagctggctggctgtggcggagtccctgttgcgggtgtctttgctcaggcctgcctgctgcctgctcacagcacccctcctgactcagcctctgctttctagctcccagcttggctctggcctggcccttctccagcttttacccttttcccaattccctctgcaacagattgacctccgttcctctcaggaccatgtgggcctccttgactcaggaacatcctgcagctctgggtgggtggcacaccctccacccaccctcggggcctgtgggactgaaggccaggcacactgtcattcagaaaggatgacaagttgcaactaaccaaactcccactgcactcagggctaactgtcttgattttatttccccactgtagaaattgccgatgcctgatattacgaagaggctgggacaaggaaagagctctctgtaccccatctgagagagaggaagagacatgccctgggctagagtgttaccaatttaatctttttttttttttttttttttttttaatgagacagagtttcactcttgttgcccaaactggagtgcagtggtgtgatctcggctcaccacaatgtccgcctcctgggttcaagtgattctcctgcctctgcttcctgagtagctgggattacgggcctgcaccaccatgcctggctaattttgtatttttagtagagatggggtttctccatgttggtcaggctggtctccaactcctaacctcaaatgatccacccgccttggcctcccaaaatgctgggattacaggcgcaagtcaccgcgcccagccttcaatttaatctttactatagccttgcctgacaagtcatatggcagaacaacagtggaggaggaggacgataggactgttctccaagaatctggacatgagggaaatggagtgaccttcagaaagtacaccatttgtaagtgaacattctacagataatacacaaacttacatgctagaaatacgtacatttgatcacaacagagatgcataaggatatcagggagggatgaatggtcccagaccagaatcaaacttaagggaagctattaacatttctgaagagaggtggtggtgggtccaggacagaagcgataagatgtatgatcaagccctgagaaataaggcacactagacactagcgagcctgccgcagaggcgtctgagtctaggggatggcaattctcactgcttctctcgctcagagctcagactctgcaaacgtggatggcaacttgtagaaaagtgataagatacaaattgaattctgtctggtagagatgcaaatcatttctcccctcagaaaagataacctcaaaggctttgattttatttcccgacaagttattgggcagctttgattccaacttagaaaacttattccaacatttcttttccccactggctgatatatcacatatcatatatatatcctactaactttatatatatatacacacacacatatacacacacatatatacatatatatacacacacatatatgtatatatgtgtgtgtgtgtccatatatatatatatatatatatatatataaagtttctgtatctcttttttttttcctttttgagacagggtcttgctctgtcacccaggctggggtacagtggtgaggttgtggctcactgcaggcttgacctctcaggctcaagtgatcttcccacctcagcctccttagctgggaccacaggtgcgtgccaccacatctggctttttttttttttttaaattattttttgtagacactgggtctcactatgttgcccatgctggtgtttaacttgtgggctcaagtgatcctcctgccttggcctcctaaagtattgagattacaggtgtgagccactgcacctggccctccttatgcctctttaaacaagttttgccatcctgttatcattccttgctaatgagttaaataaacattttttgacatgagccagtcatttacataagaattgtgtttttcaggaaattctgtcatttgtgacgatgtggatgaacctagaggacattatgttaaatgaaataagccaggcacagaaagagaaatactgtatgatcttgcttatgtgtggaatctgaaaaagttgaactcgtagaagcaaaaagtagaatggtggttactagaggctggggtaaagaggagacattggtcaatgggtacaaagttggttagctggcaggaataagttccggtgatccactaaactgaaagttgactacagttaataataatgtatatttcaaaatcgctaaaagagaaaattttaaatgtggtgggcatggtggctcatgcctataatcccagcactttgggaggccaaggaaggtggatcatgaggtcaggaattcaagaccagccagtctgagaccagcttggccaacatgatgaaacctcatctccaataaaaatacaaaaattagccaggcatggtggcatgcatctgtaatcccagctgcttgggaggctgaggcaggagaatcgcttgaacccaggaggtggaggttgctgtgagccaagattgcaccactgcactccagcctgggtgacacagcaagactccatctcaaaaaaaaaaaaaaaaaaaaaaaaagaaagaaagaaagaaagaaagaaatgataagtggttgaggtgtgaaaggaaaataaaattaaaatctcaggacctcaaactcagtaagccaaaggaaacagtgaagatgggcactgggtcctgcaaacctccttcccatttcgttcctacataggtagctgtatacctttctcatattttgcccacaaggaaattcctggcgggccctgagatctttaaagcagttcagttgaatttcaccccaacaaagtaaattaacagtttatcttcacaaatatgggacaaaggacagaactcaaagtcatccttctgctcacctgagaaaaatgcatatctgactcctccctacctatactctataattattttatcttatgtaaaaatgcagattcactgagctccagataaatatataatggatcactcctttcacatgaaaaatgaaatgaggatggtcagggctggatgccattatttattcagtgaagctaatcaaaaggctcaaaagaacgcaacagcttccgtcttttatccaccctctccctctctttttttctttactctttttcctttaaatattgaagcccacagaccctctctggaaaaagcacagatcacagatttttcctgtggtatgtgtccctttttccccagggcgtgtccataaccttggcaaagtaaaaatgactgagacttgtctcagtcattttctctgacttacagaggtcatgaatatgctaattactcatgtatagattctacaatgtatacatgtatcaagatatccctttgtactccatagatgtatataattattatgtgactatttaaaataaaataaaactttaatgattatggttttggggtgggcatggtggctcatgcctgtaatcccagcactttgggaggccaaggaaggcagatcatctgaggttgggagttcgaggccagcctggccaacatggtgaaaccctgtccctactaaaaatacaaaaaattacccgggcatggtggtgtgtacctgtaatcccagctactcaggaggctgaggcaggagaattgcttgaacctgggaggcggaggttgcagtgagccaagatcgtgccactgcactccagcctgggcaacaaagccagacttcatccctcacctccctcccaaaaaatattatgtttttacatttaaaatttgtgtcttaacagaatcatagagaagggaagctaatggaaatgatacattttgaggatggtcagggctggatgccattatttatttaaagcatacaagccaaactccaatccttgttccacagttctatgttcccctgataatgttctgtttgctgtccctggttctacagggagagaatttgctggtcaaactgataagtgactggtcactagacacacatccacttctctttgtgaatggattctcattctggtatacaaccttatgtctagggtggctttatggcagccatctggatcttgttgaagtctgggatgctgaagaagtctcactgtgtgagtttctgaccctgtaaggttgaggcaagatggaatgatggtgactttaccagaaaaaaatgctatcttgtgaagtctccctcttctgataacaagtgaccctgctccctctttggtaagtgaggaaactgtggctcatggaagtggcatggctaatgcatggcaagcgaggtctgcctgactaggaagcctatgttctctctagtttatcactccttgcctgaagaaagagaagcagatctagcaaagggtggtagacaaaaacaaaaagttcatatattcaatgtgttgtttttagcttccagtgatttccacagtacacaattctacactaggtatttggagaaagttgaagcctggcatgaggattcatttgatcttgagagctgactccaaatatttgtgaagaaagaagcatgtgcaagaataagatacatatttccatttcatacttcctccgagggctgagcctgttcctgactcagagagatattgcaaaagaagctggtattatacacattgaaaatgacactccttctaaggagcaaaacaactttatcatatcaagcagagcaaagctcccctcttggaaaactcaaaaatgttcaaaatgcaaactgaacttggcagggggaaaaggcgatggtagcaaaagcagctgtgaaaaataaagaggttacttgtgagtgactgaaatgtccaagtgtcatgccaccagcagccacaaataaaagcagatgctgcaacattttttaaaagcatttctgtaagaagataaaaatggctgcatacaattaagaagtataattttattgaaaagcatgaatgacaaagcaaaaggaaatgtcaatatgatttttgtttttgtttttgttttttaaagagagggagtcttgctctgtcacccaggcttgagtgcactggctcaatcacagttcactgaagccttgaccttccaggcttaagtgatcctctcgcctcagcctcttcagtagtttagactacaggtgcaagccaccacgcccggctaattttttcattttttgtagagatagggtcttgctacattgcccaggctggcctctaacttgtgggctcaagcgatcctcttgcactggcctcccaaagtactgggattataggtgtgagccactgtgcccagcctcaatatgaattttataaaagtccaaatgctctgcatgtggagaactttccatctacaaaaaatcgttctgccttaaggtgtgcaaagaagtgaggccagaactcatttcagaaacagattaagtggacaccaaaggatatttaagcttcagaagggaaagaagggttatcaatgaacggtagctgagatcacaggccccttatctgcaaagagagagaatctgtgataagctgtagtacaaaccagaattcatttgaaagataagatgcataagatgcagaagctccagggccttacttagatgcagcctcatttcctttgtaccctgccacccagctgttgcctatgatttcactgaaacagttatcacctccacttagcaaaacctaagggagtgattctcaatttctattctgcaaaagaatccactgaaaaggttgctaaaatgtagattctcggcccatgctccctgaaagtgctgacacagtaagtctgggctgggcttaggaacccttattttaacaagcactccatggaaaaggtcatcaggggttcacactccaaactactgtctaaggctttaatcctcagactattggttgagacctactagtaagtcttgaagtcagcttagtgagattagcatttgaaaagaaacagaagaaaaatcagaaaaatgtcagtgtatactgtgcagtcaatttttagtttcattcacatatatgagtgggggtatacacgtgtagtgaattgtgaggtacaatatatttcagactgtgcatcccagctgagaaagttggagaaacagtggcctaaagggacatgaagatcacttccctgtgacccatttatcattttctccatccccacactgagttccaaatcactccagctccacttccctcccatgtctacaaagaggatataagactgtgtttctttgttctccagtgtcaggcatgacaactggcttttcagcttcaggaatgaatatggacaacttgaaggaaggcttgccaagatcccagtggagcctcagatgcagcagatgatgagaagtgagtgaaaaccctttagattctgacctggggaccttccaaaggtctggaggaagagaagtggtaggaaggaatgggcagaaaatgaggggcaaactctggagagtaggttgagacctcagaagatggaaggtgagccaatgcattattctttttgtatggagatgatgttagtaacccacctgcaggagctggagtgtttttagctatttttcctcccagcaatggcacagatccttgtccattcgttcatattatcttgatccaacttatagtgaaaataataaggtttaacaggtgctggtctagatatgaacaggcgcaccacttgttctcctgcatacagcctaaccatgtgagaaagagccaccagaaagatagcaccaggaaaataacgccaagcatgtttagcccggtgtgctattcatctctcccagcttccccactctggtcttttcagccccttgggaattcctccactaggtccatttggaaaagagtaccaaggaggctcaggggactgaaaaccagctgtgcactgtggcttgggttatcttcaacttaaggaaggtgtttttctcattccctagctcccttatccatgccaccaccgcaaaacagtacctttccctaatgttcacaaaggtttaatacaggctagtagtaccccaggggaagagagctccattcctttaacaagtcacttgtcttttcatgacattaggtagtctttcagtgttcaaaagacacccacattcaacacacacacaattaccactctttgctctaagcagcttttgtaatgaccatatctcctccccagcacttcaaaattggagggtgtgcctactaacaaacatcctggatggtctatcagagtaagtgaattccttaaaaaagaacagacacccaagatgcgagcataaatcactccaataattccatagtatctggccacaggcatctcagctatatcttcacttaactaggtcattttagggggcttacaatgtctaggacaccacttattttttagagccttattttgttggggatcaattcagaaaaaaaagtgaagcttcatgggacatgtatgtattgtcaccatttagagaaaatgacagaagtgaaggaaaaaagaagcatcctacttataaggtcaatttggctcatgcgtgtctgtgatctcaggatcttacagttcacacactgccacacagatgttccaaccagtccatccacagccattcattatgccagtaagtggatgatactttttttttctttttaacaagatctttttttttttttttttttttttttagcagagccattttaaacctcagctataacaacacttgcacgtccaattcattgtcattatctttgctaaatgctttcagtgaaggagggatgagaaaacaggtcttttgtattcctgggctatcaataatcttcttccttggaggtaactgtttcactccagagggaaaaaatgactctgttttatacttgctatttgtctatcctgtataagtgagggctgagaatgtaaagtacatagcacttgctaggcactcattatgtgttgatatggattctctttggggtgaaggaaggtgggttatcaagcaggctcctgtttctctggggaacagaactgcacagaagaggggaaggcagtgttcacaggtacccgagggaacccgcaggtgccagccgtcttcttggtacagcagacttaggactgaatatgtggtttccgcaatttaatcaccattggacttcttacagcctaatggtgtatgtcaattagtatattaggatatgtgacttacccatcagacacatctatttagggtaactggataaacaagctaacctgtggctggggcctaaacctgggtcatcatcctaacatgtcagaaatgtctttgctttttctcttagtctgtaattcctcctagcacacaagcttccaattctagactctggtcatgttagaatatttgcatcccctccctcagtgcaccacaatctttgacatccctttgcacctgcttttctctgtgcttggaatgcccacccatcctctaccttcctctgcatagtcaacatctacttctaggaagtcttttctgtcccctgatagtgggttagggcccaccctcaaggctgcccaggcttgcctctgtcattggactgatgccattatcttcccactgtttcccaggcagtctcctcattagactccgtactccctggggagttgtaatacgttctttgagtgaattaatgcacagtatgggtattaaatgaatggaggagtgagtggtgaaagaatgaacccaggattggaacacaaagttcagaacccaacttcccatactatcctttctctcacagtatccttgtcagttgcaaaacaaatagctaggtttaataaggtggctagggaaattgaggtctttagaggaaaaaagcgagtagctagcctattgcctcctctgaatctgacatttatttgctcttctgggtaaggtaacgaatgtctagctaatagattattaaccacaaaaaatgtcttggttctcaagaaagatggcatgagattgttaccattttatacatccttttatattaacaaaaaataaagcactcaccctagaaaaggaaactagacctccattgctctccttggcccagggttccacaaacactgttacttacatatgccttggctaaccctgccagcaaatcttgaattcagctttgtgtgcaagagtgggttttgttccatgtagcaaagtgaggcaactatgacaattagagacagaacatagccagggcttgccttatcctggcccaagacatctaacacatcttggagagaactccatgtctcctgaacaacataatcatctactgcaagtctgtaatgaaagattaagcctccctgcattgaacctgaacccctttttctgtgaagctatgagtgtatgacatttagaaaatcctttccccttccaatgagattggaataataaactaattatgcaagctccgtgtgacattggagcctcaaatttttgtaagaagattatggccataaataattttttttttttttttttgggacagagtgttgctctgtcaccgaggctgcagtgcagtggcacaatcttggctcactgcaacctctgtctcctgggttcaagtgattctcctgcctcaacctcccaagtagctgggattacaggtgtctgccatcaagcctggctaatttttgtatttttagtagagacagggtttcaccatgttggccaggctggtgttgaactcctgacctcaagtgatccacccgcctcggcctcccaaagtgctgggattataggcatgtgccaccacacccagccaccataaatacatttttgataaatacattgcttgaaagctagttttccctgcttttcaggataacctcccagagattgtattttgagaacaaagtctctgaagatctgtttttaagcttctttgcttggctgagcccataggaggataccattgccatgcttacatctcggcgtacatgctatgcagaatggctgccaaatttgaccctagggaaagaagagaaagcttactgaccttgtgcagctccacaggagttggagacatgatctcctttatttcttgtttcatttttctcagggttactgacttcctacccacatctgaaggcagggtgttgctccgagttgtttggctgtagtgcggccgcgagctgctgcgctcctggaagctggcctgtcgccccagctgactgcgaggtgttggagcctcatgattcaaactcatcgtgctccccgacatgattgttgcctgtggcattgacaatttttagaaacaattaagccatggactaaggaaaggatttggtgctcaacagtaagcacatttctccttctgcgaggtaaaaatacagtctcttcagggcaaaaccaaaggctggaaaatggatgtactaattgaactatgaaagtctggaaaatgctttgcaagtgacatttataatgcacatctcaaatccaatttaagtacttaagccattgagtttatttaatcaaataccacccctggcagttttgaggcaaattgaaatgctctaacatttgcttactgtaaactacattttaagcattcactttccactcagtgggctctaacagatgggattcatgaggccaccttgaatatatcttacagaaacgaattaagaacttctcaatggacaccaggctgcctgtacttgcaatgctgcctctatctccaactgcagttaacaatgggctggaaagggatgactgatataaaggcaaggggttcttcccaagcttcgtctagactgtatattgtctttcctttggccaagtggcctgtccccagagtttgtagaccagctaagtctccatattatttgatacagattaagtgtttcttagaaatactctttgtataagatcctcagagaaagtaaaaataatcatttattatgttattatattcaactttttgctcacaagcagtaggacttgaattggatgttaccagtgaattgggaagtttgttcggtttcaaatatgttcttccctgaatacttcacaagcaatgacaagattagataccaaagatgaataaggctcagaactggaaaaaaaaaaaaaggatttgaaaccaatatcaagtagtggatattcatttctcatggttggagaatgctaaaattctgaaaatatgcctgtagccagttctgtactcctgggtataatagtataaaggtaaactagcattggtaaatcttcctgataccatggggacagaaaacaagttccatttgccatgtgatttagttgtttatattaatactgatgctaaaagtaaccgcagcttaacttgttgagtcttttgaatgtagtcactcatttaagcctcacaacaactctatggggtaggcactgttacttctctcaatttatttatttatttatttattttcttttttgagatagactctcactctgtcacccaggctggggtgcagtggtgtgatcctggatcactgcaacctctgccttctttgttcaagcaattctcgtgccacagcctcccaagtagctgggactacaggcatgcgccaccatgcttggctaatttttgtatttttagtagagatggatttcaccatgttggccaggctggtctggaactcctgacctcaagtgacccaccccacttagcctcccaaagtgctgggattacaggtgtaagtcaccacgcctggccattcctcccaacttataggtgaggaactgaggcacgaagaggctgactcacccaaggtcacattggtagtaaatgagccgagggcactttataaaactattgatcatgagggaatactgcaaagtgagtagagttttcatctgtcacgtctctaagatttcatagttcccaaattcacctggtgttcagctatacacacactactaacaagatctttgaacaacagccaagtgttggcacacatgtgcatatatctaacaactttgttgaaaaagaaatgaaacaagtagactatatcttgactagatcagttatctcactgataattttgaaaaagaaaattataactgtaaaaagacttgctgatcactgaacattaacatgtgctaagtcccatacagattgcatgtagaatatcatttaatacataagtaaccctatacaatagatattaaaattaccatacatcctcatttcagtaaaggaaagagatgcgtggacaagttaagcaacttgcccaagagcctgggcatggagctctagtactctgactccagaactctttttcttgactgcttggtgcttctcagtcaaatgttaggttgaatcatataaaacttcctttttagtaggtagaaagatgcctagcatttaaaaacaagtgtgggctatttatacaacagtttatttcagataaataccctttttaagttgattgaaacctttctttactggcttcattggtgtcatgggatattctttattttatggcacttactcatgtatataatttctatgttttttattttattttttttgaaatggagtttcactctgttgccaggctgaagtgtagtgatgtgatcttggctcactgcaacctccacctcccgggttcaagcgattctcttgcctcagcctcccaagtagctgggatgacaggtacccgtcaccacgcctggctaatttttgtatttttagtagatatgaggtttctccacattggccaggctggtctcaaactcctgacctcaggtgatccacctgcctcagcctcccaaagtgctgggattacaggcctgaggcaccgcacctgccccatttctatgtttaatctagtgtatctgacagcactcattggttgttttcttgccatgctgaccatccatttattatttttacctacttagactagttgtttgctttgttaacatccattttttaatattcatttttcatgagaatgacaggacacatgttggaagtaaaacaatcactacaactgagagaccacagttttgctttgatgagtcttagctgccatagaagaaattacagattgatttagaaaaggttctgatggaagaaataagatactatcactaattctttggttcgcattttcaggtaagtatgtgaatctgtacagtaatcaaagtttgattgctttgtttaaaatgaactttaggtagcatctaagaaggaacataaaaggtaaaacaaatataaaaactaaaataaaaagctaaaaaataattatttttaattacctaggatttgctttggtctcaagagtatgtattacctgttttcatttgccataattcatgattgtatattattcctaaggcagcctagagttctctatctgacatttagttaaaccttcttcttatattatgctaaacaaaaaatagttaaagcagtgatcattaatcaagaaagggcaaaaatactaatagttaatttttattgaatacttaagtgccacataattattagctcattataattcccatttttatagaagaaatatctgataagagaggttaaaaacttgtccaaagactcattcaaatttctctcctttgttaaaactatacatttttcggtgctaaagttgaacctaaattattgctagcaataggggaaatgattagtaaattaattttcatttccatttcaattgtaatcatctttcatcttagctaaccttctacatttattagtattatagtgtgctttaacttttaatgctggatgtaaatttaatatgcaagaatctagctctaatattttttgtataatagcatttccaatcaagggaatggggttcatttaaaccaataaataaatattctttgtgataaaagtgtaaatataactaatttatgaatttgccaatcattcatcctagttgaggatttaatttctctttggcttataaattcaactcatttgctttctgcattaataatgtcaagggccacatctgtctggagctatgttacagcaaattcataggctgtggcaacataacatctactcttactgatggatgttgttttcatcagataactcaatttctgggtgaaaacagaacctgattgtatcactttttacatcattttctttttgcctaatgtaaaataagctgttagaaaaacaactttttttcttcaaaagggaaatatcaaaatgcacaatgaaaaagcaggatgagccaaaacatgctttcaaaagcagggctatgttcaagaattgtgaattgtgctcgttactcagtttgggctacttttcttcatcattctacatgcagaaggtggtacaggtttaaataagccagctgatacttcagcattctgctctttttgaaagttgtataaaaatgaatcattgctaacatcttacttcatttagattttataggattatccatgtccaggacctttaactgtgctctgaagctgcaattcatgccagataatactatgatgtttacaagttcaaactaatagttttctttataattctctttgcagattcacaaacattagaatcacataaaataaccacacatgcaattgagaagcaaaataatataaagatgagtaatcattttagaattgcaagagtttcaccccattatgccattcacattccttatggtgacttggggacctcataagacatcaaaataaaaatgagacttttgccactttattttttacagctcagaaaatttaaaagaacataaaaggaaacagtccaggacttcctagactaaagtgtgaataccatcagcaaattcatggctttgattaaagaactcaccaggagttcagctattacattccatctcgttcttccttgaattcacactaagttaatacagatggaatcaggatttacaattaacagcaatgtactgtgtaatatttttgctgcttatcaaatagactggcctttttcaccagctgcattgtcatctactttaaggacaaaacaaagtaaaataaaatttcctcttatgttcctcttaacgatcacattaatttctattccaggtacaaatgaaaacatgccaaagaaacctttctaaagcaactaagagaatgggatgcgccgctgctgggagacttagctcgctttttagcgatttggtaggaaacagatacaatcagggttagcagggagcaatggcagaagccacaagtcagtaagcttgaggggtggagatggggatatacttttgactgcattgtataaaatcaaattgctgtccagaaggcaagggggtagggaaggcagcttcacaagcaaaaatataaacataaagggtagctaccaagagagtcatgtttctcaaagacacacgcctgtcagctttctcctgtggaaagggttaaagcttttaaatgaactggtgtgagaaatgcaaacttaaaaggaccaaaaaaaatgaatgtagaaacaataaaagtaagtagcaggaccaaggctacctccagttctctcagaattcctgactgtccgcaggtttccaaatcctccagcgcttgagaccagaagttctcctcttgttctgtctctgcactatcggcagcccctgcaaaactgttgtcaagaaacacaggctgggttaggaacttgccagacatttttttttttttttttgagacggagtctctctctgtcgcccaggctggagtgcagtggcgcaatctcggctcactgcaagctccgcctcccgggttcacaccattctcctgcctcagcctcccgagtagctgggactacaggcgcctgccaccacgcctggctaattttttttttttttttttgtatttttagtcgagacagggtttcaccgttttagccaggatggtctcgatctcctgacttcgtgatccgcccgcctcggcctcccaaagtgctaggattgtaggcgtgagccaccgcacccggccttttttttttttttttttggattcagaatatctctccttcatctcacacgaaatatagaaagagagtcattttggatctggctttcttccacctgtgccctccaagagtatgagcttcagcagagggacgctttaggaaatgcagtgttgtgaagatggaaaggatggtccatggtcttactaccggatttcagactatttgtggctgctgctaaatgggctgcagccacatggccctgttggaatgggatggaacgtcggaaatgtatttcagctgctatatctacaaggaacgagaaatcaaatttttctctaagagagaaacatgtgtttttctcacttatttaaagatcattataagtaaaccaaatgctatcagtttttataaatttccttaaaatgttttggtaaggaacaaaatggtaaaatatactttgctgaaaagatggatccatgaggtatcttttaaaaaaaaaaaaaagtaacttaatgtgaaactaacttttaaaagaaaggagaggggcccagtgcagtggctcacgcctgtaatcccagcactttgggaggcctaggtgggcagatcacttgaggtcaggagtttgagaccagcgtggccaacatggtgaaaccctgtctctactaaaaataactaaaaacacaaaaattagctgggcgtgttggcaggtgcctgcagtcccagctaatcgggggtctaaggcaggagaattgcttgaacctgggaggtggaggttgcagtgagctgagatcataccactgcactccagcctgggtgacagagtgagaccttgtctcaaaaataaaaaataggctgggcacggtggctcacacctgtaatcccagcactttgggaagctgaggcaggcggatcatgagggtcaggagttcgagaccggcctggtcaacatgacaaaaccccatctctagtaaaaatacaaaaattagccaggcgtggtggtgcatgcctgtaatcccagctactcgggaggctgagacgagaatcactcaaacccaggaggcagaggttgcagtgagctgagatggcaccactgcactccagcctaggcaatagagcgatactccatctcaaaaaataaaataaaaaataaaagtaatacaatataaaattaaaaaacaaaaattaggcacatgtggtggcacaggcctataatcccagctactcaggaggctgacgcatgtgaatcgctagaacctgggagatggaggttgcagtgagccgagatcttgccattgcattccagcttgggcagcagagtgagactctgtctcaaaaaataaaaaaataaataaataaaataaaataaaggagggggacctacttgtcataaggaagggagtgcaaagtttatagaagcagcttctccccaggtgctactactgttttcgttaggggaaacccagctcttgccctgttgtgtggtgcccaggttgccactggtcaggcagcttttagaatcctgccatgtggccagcatggatgattatggtggctttaagaagcccatactaacaatatgtgctactggaagtacagaagttcaaatcttgcccacatgaccatgcagtcatcttggatgaggcagcattggttgaaaaccttacccactggctgtggaccggtcccagtcttcataactcagccccacatctgggtaagtctggcttcgaggcttagtgactggggacaagctgcctctctgttttggactcctccagtcataggtgttgaaattgtatcctgaggcctgaaaactagtgcctaaaatataaacaaggtgttagcattgggcccaaggattacttaatccattgagaaatgacattgttaaccagtagaggagtcaaattataacggcaatgacaataacaatagtgaacacatagtgtgtgcttattgtgcaccaaagacttcaccaagtacttcattttgagccatctttcttctttagagccatctttggaggtagatactcctattatttgcattttacagatgaggacacggacggcttagaacagtggtttcaagtacctaaggctatttgcaaactttcttgggagttcaagtcataatttttggagaatcggttttcagatcctcaagttctagatgcacttcttccccaaactggcttagctgagatctgccagttagtgctcccttctcatttcctctttcacaactgtactcctgccactttacaaacaaaagacatatttctcatccatttcaaatcttttttcttgagatggagtcttgctctgtcatccaggatggagtacagtggtacgatctcgccccaccacaacctcctcctcccgggttcaaacaattctcctgcctcaacctcccaagtagctaggattacaggagtgcaccaccacacccagctaatttttttttttatttttagtagagacagggttttaccatgttggccaggatggtcttgaacttctgacctcaggtgatccacccacctcggcctcccagagtgctgtgattacaggtgtgagccatcgtgccggccccatttcaagtatttgaaagtgcttgggccctgggatataaactcctagttgccaattcaagggataatttgggaaagacttgttcctgtgatgaggtctgttgggagcaaggccttatttcaaccaggcacaaactcacagcaaggctttcacccctctctcttgtccatctctcatgctgcctcagagaactcagaagggcaacggatgtcagggataagaagcctgctgcgtttattgtttatttgaattgcaaaatgctgacttttttccaccagggagttacatctgattagcctgatgggtgagacagtgaggaatggctttggcaattatgttacataatggacactttccacaaaagtatttccaagctgtagttccaagattttgatagaaatgtttttaaagcatttttacaacaaactggaaattatagtctttgcaagtatttacattttgtgagaaaaacatttagacaacaacttttagtaggtgatggggtatgtggttctttaaaattattatgggggttcaagtggggctcgattgtaggtctgattccatagcttgtgctgtaatcatcacatacgccttcatccactacctcaggttgtgacttgtgtgtgtgcatgtgtatttacatggatgcgctggcttggaatatggtatgtgtttcttactgtacttaaatcatttaatacagcaaacagacctgtacccgcattttcaggtacagttaaatggcctgattgcgtaagatgattctgtctccatgatatccctgcttcctcttccccattcactttctctccacctgttgtcgaagcctctaatgccatttttgctactagtttaaagcccaagcagagcaggatatctgaaggataatactctctgatcaaaaggatttgatcttaagaacccagggcaatgcctaccaccacatgatggaaatactctaagaaccttctattttaggacaccaaggattagaagaccttggagcagaggaaatatttacagttcaatgtctcattctctttttcctagataactgcaaaagtgtggttagccatctgggaagaagtcttatgaatgcagttttctgtcaaaagtgttgacttaaggaaacacagatgtgtcttctcttgaaggggaactaagtagctgtgaatttcatcctggctccctctgatggactaaccattttccccttctgaaccaatcaaaccaaccccaaatacatgaagtctcagcttttataatacaaagagtttggggaagcctgtacctcacttaaactggtttcaaccctcaacctttcaaagagccaatgctaattggtggtgtcttcctggagtatccttttctgataaacattaaccccgatgaccactgaattccctggtgaaatttcaacattttagactgattttctttccaactgttgtatgtataataagtagttcttggagacttaggcaagagtgcaagaatgggcttgagcagatgtgcaccaccatcagtaggaaactgctaaccttgaaaggcatgtgtatctctaataaggatgccttgtcttaataagcactattaaatgattattgcattacaacaaagcagagaaagaaaaggggataagattcaaatctctgggtgaaatgtaaagtcagaaaacctgatcccagctcttctctagtccgtgctacgctgacccagagattaaagtaagaaaagttgaccaggtgcggtggctcacgcctagcactttgggaagccaagacaggcagatcgcttgagcttaggagtttgagaccagcctgggcaataatccgtctctacaaagaaaaaaaagacaaatcccaaacccctcaaaattagctgggcatggtggcgcatgccagctacttggggggctgaggcaagaagattgcttaagtctggttgttgaggctgcagtgagccaagtttgcaccactgcactccagtctgggtgacaaagtgagatcctatctccaaaaaataaaagtaactgggcatggttatgcatatctgtaataccagctacttgagaggctaagaggatcccttgagcccaggagttcgagaccagtctgagcaacataaaaagaccctgtctcaaaaataaataaataaacaaataaataaaacttaataaaagtaagaaaagaccaaggttcaaatcctagcttagccacttcctcacttcacagcctggccaattaacctcagtgtaaaatggggataacaataggtagtttaccaggttgataagaaaatgaagaagaatgaatgcacaccttatgaaagtgcctagaacacaaggaggttttaatgaacacagatgcccattgttactatatactaagcccttcaacctctcaagatctcagtttccttatctttaaagtagggagacaaggaaaagaggtaagtctcagcatcattaatgcagtaaacacttgggtgtctcttaagtatcagatactatatatcaggaactaaaatgcaaagggaaataaaactgattcctgtcctcaaaaactgcattgtttggtatatgtataggagaaggagaagaaagaggcatagaaagtgagttctagtagcatgtgaaagtgtcatccttttagtcttaatgcactaatatggaaggacagagacaggtttggggattagaaggtgggtcatgaagggtgccaaaggaaaaatgacatataagcttgcagttagatagcaggtcagcatttactagttggaactgttgggtaagacagtacatggtgggcacagtggctcatgcctgtaatcccagcactttgggagcctgaggcaggtggaccacctgaggccaggagttcgagaccagcctggccaacatagcgaaagcccatcactactaaaaatacaaaaattagctgggtattgtgatgcatgcctgttgtttcagctactctggaggctgaggcaggagaatctcttgaacccgagaggtggaggttgcagcgagctgaaggcatgccactgcactccagcctgggcgacagagcgacactctgtctcaaaaacaacaacaacaacaacaacaacaacaacaacaacaacaacaacagacagtgttggccaagtagaagagagcctggtaaaggtgcagtcagggtaaacaggtcctcgattctatcagtgggtctctgttctactcctaagaagggaaaagtattccaggaatattctgggccctcttaccatgtgtacttattcctccccataggaggaatgtgatttacccaactggtgagttttggaaaagaacattgggcatgtcactcagcccattcctggctttctctggacgctttctctcccactgctgctgtgctgtgcggtaagcaagcctgggtcacaatcttggggctctctgagcttgatggaggcaagaaaaggcatgactaggcagttggataaccatggcagactacctgttgctcatcagaacattcattctcttcttcgtccttagtaccagaataccagtttcggggtgagcaaattattgctcagactaaaactatacttcttagcttctctcaaagctaagtgcaacttagtgaaatgttctggtcaatgacgtagctaaggggacttctgagaaggctccttacatctttgctactgctgtctggaatgcaaatgaaattgctggagccccagtaactgtcttggactatgaggtgaccccaaggatgaaagtcaagtgctaagcaaaacagagccgaaatatttagaagcatgggcctctgatgacactgtggagttacataccagctcgaagtgcctgtttctttataatgtaagtcaatgtattattagagttttcagttctcttcagctgaacctaatctcattgattggtaaccagttcagttatggtttgctgtgtagatctgacttgcgtcttatttaaatttaaatgtctagacttgggttgagggtaggaaaataattatcctgattctggctgcaggaccaatccagctttttctagcaaaaaaataaaatgaaatgctgatattttaatccatagctgactctcatttctatttctcaatggatttgaaaccgattaagaggttaattaacatatcaaaatacctagtgttatcaagataccaaaatgcaaagcttgcttagagaattgtgagatattccgggtatgtgtactaaaaggtactgcaaggaagtgtcagcagatggactgacaaagtatttggggactagattacaaagaaccctgtgttttaaactgaagacctttgactttatcctataacaatagataaccatcaaaagagggtttttttggtttaagggagtggcatgactagatttggttttgctaaagattatagatagaaatgtgggaaaagatgctcaaagtaagaagataagtgaggaaggagttaccatatttcatcaggcctgaaacaaaggcagtggcaatggagggacatcagagatgctaagtgagtagagggagtgagatacctgggtcctgatgacaccatgggaaaaataaatcctgatgttgcttaaatgccatcacttaaattttgtttcgtatgtagaagaaaatcttcaaatcagctaaacttgacctttaactgatacagctggctggtgataccatgatttaaaagagggaatatctgaggaaaattatgtttaggtaaaaggcaaacctgttgccattactgataaaaagttaacaggctctgaggaatattcctttacaccaggagtcaagcttaaaagccagggaataaatgaggcagcccaggcgtaagaaaaaatcaactgccagatagataatgaaattttttttgttgttgaatgatggtgtaagcacatgaaatacacatataatattggaaactacattttaaattaaaaattgataaaataaataagttgaaaaaagaaataatgttttttaaatgtactggccaggcacggtggctcaggcagggcacggtagctcatgcctgcaatcccagcactttgggaggctgaggcgggcagatcacctgaggttaggagttcaagaccagcctggacaacatggcgaaacaccatctctactaaaaacataaaaattagctgggcgtggtggtgggcacctgtagtcccagctacttgggaggctgagataggagagtcacttgaacctgggaggcagaggttgcagtgagccaagatcgcaacattgtactccagcctgggtgataaaagcaaaactcggtctcaaaaaataaaataataaaaaataaataaaatgtatggtcctaagtcatttctcctttggattatttatttatttatttatttatttatttagacacagaatctcactctatcgcccaggctggagtgcagcagcatgaccttggctcactgtaacctccacttcccaggttcaagcaattctcctgcctcagcttcctgagtagctgggattacagacacacaccaccacacccagctaatttttgaatttttagtagagacagggtttcaccatgttggccaggctgatttcgaactcctgacttcaagtgattgcctgccttggcctcccaaagtgctgggattacagatgtgggcctgcatgcctggcctcctttggtttagaattggcaactttttcttctttccttctttattttacatctgggtttccatatctgatcttatactttgtatcctaataggaggtataaaatttagtccagattcctttcactgatattaatgtttagttttatttatttgcataatggaaaacaggtcttcataaaaaataggtctttatttgcacaagtggaaaacagcaaagtaggtatttctgaaagtagatggaatcttgataggatgatttttatttttagggtaactatgccttagatatttgtaaaattctaacattccaaccttgtaatatttggttttctgtactaatacagattaatatttgtagcttttaattcatacccagcattaatttagaaaagtgaactaatcagtgtgggttcatattcataaagtttagaattcaattttcggccgggcgctgtggctcacgcctgtaatcccagcactttgggaggccgaggcaggtggatcgcgaggtcaggaagatcaacaccatcctggctaacacagtgaaaccccatctctactaaaaatacaaaaaattagctggtcgtggtggtgggcgcctgtagtcccagctactcgggaggctgaggcaggagaatggcatgaacccgggaggcggagcttacagtgagctgagatcgcaccactgcactccagcctgggtgacagagcgagcctccgtctcaaaaaacaaaaaaagaaaaaaaaatagaattcaattttcatctcaacaattttgggactgtagctcttgccattactttcattcttggaaaccaattttagtacaggaaagagagccagttaattcgctgccaaatttgttttctaaagacccagttttgtgaaggatgagaaaatcaaatcatatgtttgtgtaactatttgtaattgatcttgccaagaaatattcaaagtattcagatgaggctgtgatctaaatgtcaatgcaaagacagttctctcttctctcagaaatcacctcaagacaaaaagtaatgataaataacagaatgcaacctccatcttaatcacaactagagtgttcatgtaatctcagaccataatacataagaaaatacataatacataaatccagtggaagtcaaatgggaagggggtggtggtggtaagaagtggagagaagacacctatggccaggactaccaaactactctttggtagacaactcagtctaccaaagcaggggcggtggcatgaggcaaaactccaatgctttgtttggaacaccagtatgcactgcatggctggtggcagaaagtacatgtgatcccatctggcatcaaggtaaagtcagggaaagagaacacatgtcacagactgaagggagcaattgctcaatgaggcaggatagcagagaggaattctgttttgtgagcagcctgctgttgctgctctctggtagctggggaagaatttactcacacataccatgctggaactggggtgtgtttggtaccttggaaacagagcctctagcagcttccagttcaggaagaactcatctcattcagtggtgagcagtaattgaaaaggaattggcataacatgtataccaagtaaatatcagacaaatgagagcaaaggcatagaaaaacaaagcgatagcagatgaagaatactcatgagaaaaagcctggttcagagcaaatgataaacatgaccaatcagaaataatcacaaaatttaaaaaatacacagcaaagccatcacctctataaaacaagagatcaaagcagaaatataagaactctagagaaattgggcaaggcaagatgatgatgaaacatgagcttgtagagatcagaagagaaacgaaagagaaaaataaaatcctgctaatgagtagaggaggataccattgggtttctactctgtgctatcctctgtatgatttgtattctttaatgacattaaataaagttggactctgactgcacatgttggtgtcctttcagttatcatccttatgaaaacacaaagaaggaatatatccttataaagcaatgaaaataaataaatcatgcatccaacttaagtcataaaaggaataaaatttaaaaggaactgaatgaaagagtaaaattaaaagtaaaattgtacgtaaaaaaaaaaactagagtaaaactaataaataaatgcaagagtcagttctctgggaaaaaataaaaaccaaacaaagaaatcaaataaactgttactaatcgaatcatggggaaaataataaaaccacaaatataccaattaaggaacaatattatggatataattatagaaactgagaaaataaaaaattaaaaaagagattaattatataaaatacatttgacatctggatgaaataatttcattttctgagagaaaacaaatgatcaaaatgacctcaaaagggagaaaaataagatagaaatatagctatctgagttgagagtccaaagttacagagagcacaagagctattcagcccgcgagcatggcagtctatgtaccaccaccaatttgccagtctcctcttgtattgacctttgctaaatccaagtaaagcagtcatagggttttctcagagttagaaggaagaattaataagatgcaaggaggccaaatgcctaagattttgataaggcagaagggcatgaggcatctaatgggcaagacaatggggagtgaaagaagctgacctggaggccaactggaagaagtcagccacacagtggaactgagaatcagccccttgtgggacttccttaaacatatcccttctttccccacaaggtttcgtcattccattctatttcccttttcactaacgaagtgatagggccactgtttgtttatttgttaactgactgtcccttcagctgggtaacctcttccatgggagcagagaccatgtctcctttgtccaagagtgtatccacatggtctatgggcctgatattgagccagtcattacatactggttgaaggaatgaatggagcaagcttgatattttagagaagaaggagagaacagtaaggaatgttgctgcaaagacatcgatttccagccccaggaggaagatgtgcattatggagtctcctgggaacaaggcaactattacagccttaaagggaacagagagaatgtgcaggggcttcctggaacaaggcagagagcctgctgagaggctggagggacaggttggagagataagctgtatctcacaacataatattgaataggaaaaataaaagtgtggttctatgccttgcttttatttttgttttaattttttttgagacgtagtcttgttctattgcccaggctggagtgcagtggcatgatcttggctcactgcaatctccgcctcctggttcaagcgattctcctgcctcagcctcccgagtagctgggattacaggtgtgtgccaccacgcctggctagtttttgtatttttagtagagatggggtttcgccacgttgctcaggctggtcttgaactcctgacctcaggtgatttgcccacctcagcctcccaaagtgctgggaatataggcctgagccactgcacccagctgtgccttgcttttaaaaagtcaacctcacaagcacaatctggagagatgcagtttaactgaatatcacgggtaaagaaaaaaaaacacattcacaagactttgagatctcggtaaactgtaagcgcaaaatgagtgacagatgtgccatgaccactaaaattcttatgttgaggtaggtgtcattgatcagttctcctgtcttcaatgatgccagtgaccagcttgctttgctccgggctgtcgggctgttgtgtgattttcctttctgaatgttacactttaacgggtacacaggtaaactgaagcacattcgtaagggaggtccacaggacgatacagatactcgtcagtaaattatagaagacacagttaaaggaactggggctattttgcttggagaaggaaagcctcaacagagacccaatagctgtcttcgagtatctaaggggctgtcaggagaagaggctttagtctagtgcagaatgaccttgagggtatagccgggactattaggcatactgcagctcaatacaagtgagagctttagagtcatcagagctacgtggagatggggggctgcctcagcacaaggaacaacctgtcaccttgggcattcaagtccatgcagcgtgtcttggcgtgcagtgaggcaggacctggcaccaagggctgcactggacatcagactagctgactcctaaaccctttccaaacctgaaatcctgccttcagctcccatgttcgtcacaagaattaatggggattagttatgtgaaagtgctttgtaaactctagagtgttctatatatataaagggttattactattttttcattaccttggagtacttcgattctatcctgattgccattgtctctacttatccctcagttcccttcaacctcataaaaatgtctaaattataaatgcaaaatgtaatattatgactatgattcaaaatttcaaaatgcttcacaaatagtaaatggtttttcatcttttactagtgaggggcaggtcctatattcagtttgcttctcatggtcctgtgtctgtggtttcaagggatggagtagctaaggtcttacagatcaccttacagggaagaactaattaatatcaatagcaccctcacaaaaatctctggtaacaaaaatatctctacattaataagcaatacacaaaaaatacacaaataaataaccaatacacaataaattgataaataaacctgagtctactctgatagaatgtgacttctgtcctttactcagtgtcttctggtggcccatcaattctcaggcaatcagaaggtctgttatttggtggcataggtgaacttgtcacaaggtattatgacttggaaaaattaattgccagataaagccccaattctacttaggtgttcaaagtattttccccacctaactccagtatcatctctaatgaaagtaacaacttgacaactttgaaatatcatctcctttcatttttttttccagttttttctcccttccatttttgttttttgttcaccagaggacttaacagagagtgacacaacataggcaggctgagagaaggaaactaggaaaaccaggagagagcaaactggatacagacactcctaaaaagtacagttaactcagtgacaaagcagccctcacaccaatgtgttctctaaactgtttatgtgttttattatttgactgactgaaacccagagcaaacaagggattcagaggctggaatttacatagaacatgagagaaggtaaggctcagatgaggagaaataccaagaagttttgacatacttctcttgttgatgctacggatcactgggaagaaaatattttttaaaagaagctattagtttatgctctgtattcagtctgacaccttttatgtgtttatattccatgagtgaggctttttaatgtagatagtatttcttcacatgacgatgacacctatgaagaaaaatctactctatactttcctatattgtgattatagtgctctaattataaacattcagggaaagggcatggtggctcatgcctattatcctagcactttgggaggccaagatgggaggattgctggaggccagaagtttgataccagcctggagaacatgacaagaccccgtatctacaaaaatttaaaaatcagctgggtgtggtggtgtgtgcacatagtctcagctactgaggagactgaggcagcaagatcccttgagtccaggagtttgagactataatgaactatgatggtgccagggtattctagctggggtgacagagtgagacccagtctctaaaagaaaaaaaaaagtcaggagtgtgcaggaataaatagagtcacaaatcattggctaatctcttatgcacctcttccaaactccccaatccatctttgtggaaagcttgctgaaaaataaggcaatggggcctgtattgaacgagccactttattgtatggtttgcctcacattaatctaagcttgaaggacaagccctggatgggatacttggccatcagtagacctaatggaggcctgttagtgtttggtaaaggttcatgccttataagcactagaagaaaatgcatggccagcagagtgtaagtattcaatgtgttcaatatgattatggctgcaccaaagcagacacaagttaaagaaagatattctcctcatggagcagaggatgaatcttggagaagcatgggcttcaacaatgacaagtcctctgggggacaaagtaaagacataccttgagttccatagctggtgtctattgcagacccatcccatgaatccacagcactgtccacactgggcaccgtggaggggtacatgtcggagagcttgcctggcttctgtgctggtgaggagtcctcctccacatcccccaggtcactcaaatggctagaaatagggaacttcttggggctcgatgctgactgggctttatagacaggaaaggagtttaagtatcagagtaaatttaaataaaaatataccaagatactccgtggctagagatttgtttccctagaattacacacagacactagcacattctttcaaggaagaaaatgcactggaaatccttaattgtggctttcaattcactactcaccatctgtctgtttcttaattttcaaggtgacagtctctcctgccatctgtaacaaatggatggcttcactcagaggcttccctttcaagctgctgctattgatggctaggattcggtctcctatgtggattgcgccagttctgaaaagccaaatagtaataggagaggtagaaataatccctgtatggtactgaatataaattccctgacataccttatacattcatcataataaagacttggtaaggatctccagaagtcccttcttgctttctcctgggcaatgttataagataactgcatctgttgtggattactttttagtttccaataaaattttaaaaattgttttaattagttattaaaatgaactgtgttttttaattccaagaaagctgagtcattggttaagcaccctaaaaatcccaagaaaatgaacaatgttgaatgacaaatgtagtggatagcatggagcatcctttctttctacagatttttttttttttttttttttttttttgagacagagcctcactgtgtcacccaggctggagtccagtggcacgatcttggctcactgcaacctccgcatcccgggttcaagcaattctccagcctcagcctcccaagtagctgggattacaggcaagcaccaccatccccagctaatttttctatttttagtagagatgaggtttccccattggccaggctggtcttgaactgacctcgtgatccatctacctcggcctcccaaagttctgggattacaggtgtgagccaccgcacctggcctgtatgagctaatttctaaggtacactgcagctccaacattttgcaatgctgtgtctctattttgctagccactgttttcaactgttagcaggaacaatgcatttgtgtattcctgagctaggttactggagggcagatttgcttatagggtttgttatatgtccaacaacacatctcagaaagaaatgcagtttagcggagggtggggagtgggtgtgtgtgtacatcattgccaaaggaaaaaatggacattccagcttttaagacattattaaaatgggttatacactttgtttcccataatccttgaagatgatgtctgtatcatccttttctgaaaacacagcagctaagtgtggcacctgtcaggtaacagaggctcagcaagtgtttgctgaatgaaattggacaagctgttcaacctccctgaactttagtttcctcctctcaaaatggacacaatacaaatccgccttcagtcaattgtggtcagcttatacatttcagagagtagtatcaatgctaagcccaagacgtcttttactgcctgtaagatgcccctcagagtcaagtcggaactctgcctgagagttctcaggctctaagatcaatcctttgtgcagatttttaaaagccaacagataaccacagagagaggagcatgtttttatgtggttgtgaggaaggaagcccgtctcagacacaggtaattataacagttacttcaaattttacctttcagctaatccccctttagtgaggcttgaaatgattataggatcaaacggctcttcagttcctgaaattgtgatgccaaggggccccccgtagcgtttaagctccacggtgtaaataattgctccggaactttcttgctcatctgtaataaatgccaaggaatcataattgatttctttggaaaaagcaaaagagtaagatgcatagattcatacataaaagaattcaaaacatcctcgtcaaagtatcatgtcacagaaaataattattttgggaagtagcatttccttagtaggatcttacattcaaatacagggatataatcattgtcagtgccaggggagaggaacactgcctaatgacttatgttttaaatgtgtgagatccgcccagctggggctgcaggacctttcaactgtgtccatgtctaggacagtgcttacctagcatttagtaagtatgcagtaaatatctgtgaaataaacatatggctgaggaggcattataatatgagaggagagagtcactcagtaacaaagaagacagacattgggtcacgctgtttccgttttaagctttacatgcatgctaacttttgatatagaaaagtggattttgcgaagggttggaacaaataacatatatatggttaagtggaacttagataagtaaacttgaagacaacagcaagaaatctagaatctcttagatatcattccactgactgtcttctaatgtgagtcctatcagtgaattacggatattaaagtggaggtttgaatgatcatctctcctctttcaatggagtaacagctgttgtaagctatgtttcaacagcatagaccagcctgccacactgtcataaactaattttggctattcaacattattatagttgaagacacttgtgaatgtgctctgcctaaagcactggccagaaagatatcatgggccgccttcaacgtgatgggtattgtgatggtgtcagagttgcaaataagaagtctcagaattcaaaggttttatttgcttctgacatgcttaaagttcttgggcacttcttgttttattccttgggcctgggagctgtgaatggttaaggaactgtttcatttctgcaactaaggataaaatgaaatggttcagtggctactttagcaaaatagtcagcttttacagtcagactacatcctagtgaagcattaacatggccacatttttgcagtgagcagctgttcgtttacgatatgaaatcctaaaataaggaggaaaaccaaagcttgagttaacaattcaattatttgtgtttgcagtgaagaattatgatgaatataaaatgaaaggtctatcaagtcatttgggaagcaatgtgtcctctctcgccagcacttacttcacttctggccatagattgggagttttgaatgcagccattacctccactttctgagtgctctactcaacgtatttactccacacattcagaactaaagaccatccaccacacactgcaatgcttaagtcaacattttagggcacaaaatcttcaacattgggctcaaatttacattagcagctgagaagctcccatatcaagcctaaaacagctctgtttgctggttcacaagtttcttctgggctgatgctgaagttgtggccaataggctggtgatgatctgctaagggctccagagagaaacatcaagatagagggtaaccaaataatcagcagaggtcaaaagtctaaattttcctacagtacgatattttgtcacctttcagagctggctttgacctaaatgaacagagtactattggatagattacatgtactttgcagccctcatcatcaacaatatcctggatgaaattctgaatgagtcatttgattagtagtccctggcacagttgaacattagttactgctggacactctgtgtgggccattcagtggaggtgtgtatgccataggaaagaccttgaccccttattgctctctgcataaggcaagcatgagcacaaacttgtcaatgggtgccaagcattttgggttggagcatctgctctttatgggttttggggagaaggacagttgcccaggacctggagacccaagaaccagtgggaagtgtccattgaaactgcagtcaagatgaaaacaaacactggactatggaaggggagttgggggtagtcccattcattgggagaaggggggcacctggttctactcagctcattctgcagagtgagtattccatgttattttttgacaatgtaacttgagacgcaaagatgacaaaataataccagagatgaagtgaatggctttaggatagtctgtttcaggctgccttatttggagacatttttttattggcatctgagtcctcactgactagaaggcaattgttaggtcacccaatgagtttagatagtgatggagatgcaaatctgggaaatggtacctcttaactaagaaggacacattcctgtgattacattggggtggaaacaggatgacatgatattctatttaaattatgacagaaatggaagctgatttctgttttctttaacaaataaattgccagaaacacaaaagagaaaggagatttggccaggtgcagtggctcacacctgtaatcccagcgctttgggaggccaaggtgggtggaccacctgaggtcaggagttcaagaccagcctggccaacgtgatgaatccccgtcttaactaaaaatacaaaaattagccaggcatggtgcctcgtgcctgtagtcccagctatttagaaggctgaagcaggagaatcacttgaacccaggaagtggaagttgcagtgagctgagatcatgtcactgctctccagcctgggcgatggagcgagactctgtctcaaaaaaaaaaaaaaaaaaaaaaaagagaaaagggagatttaagagacattacaatcaaaagcaatgagtagatcatttgggattctaataaaaccaactgttataaaaaggtatctattggccaggcgcagtggctcacggctgtaatcccagcactttgggaggccaaagtaggcggatcaccttaggtcaggagtttgagatcacactggccaacatgtccaaaaccccgtctctactaaaaatacaaaaattagccaagtgtggtggcacgtgcctgtagtcccacctactcaggaggctgaggcaggagaatcgcttaaacctgggaggtggaggttgcagtgagccaagactgtgccactgcactccagggtgagtgacacagcaagacaccctctaaaaaaaaaaaaaaagctatgtgtttttctatcagatagattgctttaaaaaaacagttggttttaattaggattttatatatatcagggaaatgtgaacattgagtgaatattttataagattaaaaatattgctaatgatgatatttagttatgtgttttgaaagagtattttttaggcatacgttagtaaaaagatgggatgatgcctggaatttcttcataactccaccggtgaggtggagaaaccagactgagagtggagatgaagcaaggttggttgtaagcaaatcactgttaacactggatgatgcatggtgattcattatgctatttttatttttgtatatattttgaatttaataacaagcctttgaaaaagaaaataatatcaattcccttagaaagccctatgtggatgccttgtgtaaacagatatttaattagtctggctttcctttcatagacggtggtgatggctgcccgcacacagtcttttccagaccatatggcccgtctgcccacaagacaagctctccagggcatcccactgccacttgctcttgagaagggccccactgtggctctgcccagtttttcatagcaatggcttcctcctaaacagttttcctgcttgggatccagcctttgcccctcctccccacttctattttcaccaatgctgccaacatataatttcttctctttccttcccagaatatctttaaaacataaatctgaatatgttactctcttacttaaagcttttcattggttcctcagttctttaagaataaaatacaacccctgtgcaagagctgagctggcccccagagggtcacgccattctcccccatcccaatccaatctgctaaattctctcttcatagaaccactgcaattccttaaatagcacttttctaacatctttagcccttgcacctgttactccctatgcacaaacacctttctcccatttgttatcctgtagaatttctacttttactttaaagcttggctcagagtctcatccttcagaaaggcttcctggtggcttagctggaggggctagaggccttcctatgagacccacagcttctgtgcattcttctgatgtttctaaacttttattttcattcttgctctcaaacaaggagaagagtgaaattatttttaaattctccttaatgagagaagttaaatattaaggactagaattccatcaggtatgattgagatttggagggccacaaactattataatataatatccaagctatcacaagaaccaacttttaagaaccaatttttgccccccttgagaatgcatgttctagcatatgcctttcactctatgttttaaggatctcgctacttggttcttcattagaataagaataccttgaaaacagagatttttaactcatatccccataacctagaactatgtctggtaccaaagcaaactcagtaaatgcttgaacaagtgagcagaaggatgaatgaatattagcatgtagtcattggttcccaggctgagatctccagaagagtattgcgagtcagcttccctgctatgccaaggtctagtttccttttctaagacatgtgatgcaaacccaatctcattcaaagtttgagaatacaacctcagctgccattgtggggacaagcaaacctagaacttcctccctccaccgtgccaggagcgttgagtcagctttagggtcaactgccaattccacctgccttctcgggctttaactcaactggtgaggccctgcagcttaggaggagggtaataattgccatttaagaaggaatactcagactattttggagattgaagcactcctagatacactctccttgaggctgctccagtgtagaagtcttagaaaggagcaactagggtgtttaactagaagagaaacttctgagaaagaaaaacgtagaatcactagtaagtttcaaagtgagcctaagcagatgttaatgatattataaacaacttttatatcccaacagaaggtttacaacgattagtgaaagacaggaaagggggcaagcctacttgtttgttctgctcagctctagttaacaaaattaatggaagcacggaacagatgcaaaattgctgcattacttatctgcaatgttattttcaggcttcttgagtgctgcctgtttaacaaaatgaatgctatctggcttgaatccataatggtagctgcttctgtggccaaataggaggcttggatttgggagagagcctttggaaggcgtacatgtgcaggtcagtcaaagttcacttcaactaaaagtgatggaattaattttagagtacggctaaatttcttggagtcggacaggcctgagaaagtaaaccatttgaacaacactctctacagctcccttactgctgcacggtcattttacatagatatgtcacaatgatataccaagagatgtccaagcaagtgttgagtgtttcagagtagaattcaaatttctttgtgtaagtgataattttaagtctcaaaactaggtttgtttgtgacagcatttctcaaagtgtagttctaggactagcagttttggcatcatctgcaaacttgttaaaaatgcaaattctcaagtttgcatttgactgagaatccctaccccacagaccaacaggaatgggaactctgggagaggggcctagtcatctgtgttttaatgtcttctgggtgattccgatgtacactcaagcttgagagccgtccctttatgagatcaagcatgcaaaaaagagaaaagtactttttatcataggtccttcttgcagccagcttcttgccaacacacctctttccactgctcctaggacagccaagatcattcttgggagcttggaatggggcatctctgctacaccaatactccaatctgggtttaggggaaaaagctactgcaaattacttagcttggcttaacactggtaaactataaatatttgaagcccaaaatatgaatctgtcttcaaaggactaatttaatcagtaataaggctgtataaaggttatttgttttgaataggacaagctgcagcctgaaaatggttttttttaaacacagattacagcccatgaaggtaaagtattgatttatggtctccaaaaatatgctatatattagagtaatattccccaaaccaagcgagaaatcattaatagctgtatatttgattgacaaaaaggtggtaatacaaagccgacttttgaaaactatatgtgatagatttgcaaacctctatctcttcctacaaatccccaaaagtctctactgctttgcttcagggtttcctctcaggccctagccaggtcttccaactctcttcatttactttggactcagaaaccatcaaggcaaaacaatagatttttttcaagaggattatttgcattgctgattgggtattggggattgggtagcagcctcaggaatcccagagccttggacccacacaagaaccactggacactacctgagttacattccttcagtaatggaagacgacaaatgcagaagctcctgaaggcaggagggtggctgaattcagagtgagggaggaaaacgcctacaaccccaagtgttccaaaagatttggccattgttaaataaagctgaaattcacttttaaaatatccaaatacagtaatgaccactgatagtcaacattcattgggcctcactaggtgcaaacttattggtgagttattaaatatattacctcctttaggccaggtgcgatggctcacacctgtaaatcccagcactttgggaggccaaggcaggcagctcacctgaggtcaggagttcgagactagcctgcccaacatggcaaaactccatctctactaaaaatacaaaaaattagctgggcatggtggtggacacctgtaatcccagctacttgggaggctgaggcaggagaatcagttgaacctggaaggcggaggttgcagtgagccgagattgtgccattgcactccagcctgggcgacaagagcaaaattccgtctcaaaaaaaaaaatatgtgtgtatatatatatacacacacacacacacacacacacacacacacacacacacacacacatatatctcctcctttaatccttaaaacagccatgtaaagtaagcattaaatggacatttacagatgaggaaactgatgctcagagaagttaatttgcctaaatttcccagattgtcagttgtgaagccagtctggcattcttagtctttcattctactgtttcccccagcttgggctagaaacagagttaattcagactctcttgaatggctcattcagcgctttcatcaagtgattaaaattaatggtcactaaccaagtccagtgggcctcattcctgttttaagtcctctaatggccccccattggtttctgggataaaattcaaatttcttaacatgatttacaaggcccataatgacttggctccagtatacctttctagcttacctactaccaagtccttgcacacgttatgcttgagccatatctgcctactagagtgtgccatgctctccctaactttctgcaccacttcacaaatcccttcgagaccaaggttgttagaatcttttccttgaggtcctcaggctgaaatggatgccttcacattctcttaccattgtggaatattttgtgcatatccttatgacattcatcatattgttaattattgattttcttgtttctcctatttggtggtaactgatttaagggcaggattgtgtcccttttatctaagaactggtagtccatggcacattgcctgatacttcatagacaataaacgaatgctgatggcatgactgaaaatcgagggctttagcagcatttgggaatagttctaccatctccttgggtaaggtacacagcagggtagcgagacttgggaagctggaagaaatgcttacattttgaagtagtatctgttaaaccccaattgcagtacaagctagcttaggaaaccaagttccatcaagtatagttataaacttcctgtgaccagagagagaatcatcactgaaggatggagagcagccagcagttaaaggactggaaaactcctgcagtgcagagggcccacattagtatgagcaatatttctgggggtggagaatatacgctgaatattaccattcaaaaatattgagacgaagcatgacaactatttaatgtgatagttctaatcaccagcataatttcagattaagcattatatcaaactttcaaaatcagtgactgtccaaagggtaaatgcttattttccactcagtcatatcttgatcaaggatcagaacgaatgcagagaaagggatttcaggaggtaattagaatacagatagtccccacttattgagtggagcatggactgtgccagtatttccttcagtaagctacaagagctccctgagatgggtactattatgtagacattactgaaaatgggaccaaatctcagacaagtttaccaagttgcccaaactctcacagctcaaatgtggtagagctgaactttaaactgaggtctgatttttttttttaatttatttcaatagctttaagggtacaagtgatttttcattacctggatgaattgtgtagtggtgaagcctgagatttttgtgcacccatcacccaagtggtgtacacggtacccaatatgtagttgttgttgtccctcatcccccgtctaccctctcttcttctgagttcttatatcatgtctggttttaaaacatttgctctttgtgaagatttagtttgcctttaaataatctgtggtcaggctttacattttgaataatgtttttttttcctcccttactttgctctgaataaaaatgaattcagatactcaaattatatttatgatgttatgagggaagaggatactaggatcatataaattcttccaaatcaataactgaataattttcaaagagtgatcttttataaaaccatgtctgaatgagtatatatttctgtatatcaatatgagaaaatctggtttgggtaagcatatctctcatgccaatatttatagtcttattttgggtggttgtatgtttttcaatggaaggtttaggattttaaaaacagagcctcttaaaattaaaacatatttaataagcacaataaccatcataatagtatacatagagattgtaggggaagggtataaagggggaaaatgaggcaaaggaaatcagtaactgaaaataagatctagctctccaagtgctcagttgtttcagaaactcctgccaactggtagacacagcctggctttgaaactgggtgcattgccagctgtgcacactatacatattcatctctggcttggctttttcactttgcaaggaaggtagctgacatctgctgagcagggcaaatcatgcaaaacaggtttctccacagggctttgcctcttcactaggacagaacccaggctgatgctaaaggcttcctctctattttgaaatcaatccccaaaagaaagtgcaactgaagcaggcttgtaaggagagaaatgcaaatgttggcacagaaaatcagttgcttaagaaataatgagtgcaaacctgtgcatatttttaaacattggttataaaatatatttggatataatcattattatcaattgtactgatggatgcaactatagatttttttttacttggaaaaggaatcataaacacatagcctgacataaccgtgaactctagatctagatgacctgattaacaaaatcccagaacattgccacaacttcattattggttgcaatgaaattatatacagtagacgttctcttaaccaatctccacttaaccaatttactgaattaattgtggctgttcgtcttccaccataaaatgtacagaccaatgccatggcatgctccagagcaataggtttctttatgttgcccctctgggcttctgctcctgctcctgcttgagttgtaaacttcaaaatctagaggcaattatatttattcctaaacccgtttatgccagctgtacttgttattttaactatgtaatttaattaatcttatataacctatgaaatatgaatgtagttgttctatgaaaacaaaatccaatggtttggaaagattcaataagggttcgttaggcaaaaatctatggccaggcgcagtggctcacacctgtaatcccagcactttgggaggccgaggtgggcagatcacttgaggtcaggagtttgagaccagcctggccaacatggcaaaactccatctctactaaaaatacaacaattagccaggaaaggtgacacacaccagtagttccagctactcaggaggctgaggcacaagaattgcttgaacctgggaggtggaggttgcagtgagcagagttggcgccactgcactccatggcacactccagcctgggtgtgccacacaaaacaagaaacaaacaaacaaaacatctactgttaattacctaatggaaaaactctacaacattggggaaaaccaaaatctaggtggaggaagaattcagattgctataaattctttaaagtctcactgcattaaaaaccaaaccaaaccaaaataaaactggaaatcataaaatatatattgtggatacggtttaggcaaacaaacaaaaagacttgtaagtataatcagcagaaccatattaataggaaaggccttgactttacccacgagattggcaaaattgtaaattaaacgtttactttatggatccatatcacattctgtaattccccacattagctgactcttttggtgaatggacacttttcaattggctctatattcttatcataatcagataagatgtctcttatttcagggctacccaaagtgtgctccttgcaccacagctgtggcagcatctgggtgtttattaggaatccagaatctcaggtcccacctggggtggtgccaggatctgtgttttaacaagctcttcagatatgattctatgccctcctaagtttgattggagggcctaaaaaatgtgtatagcccttttgaaaagcaacatggggcatgactgactcatcaggaatcatagacatttcctttgtattcttactcagccatcctgcttctaggaatattttcttatttcaaaagaaaaaaaaagctggataaagatatctatgcataaagatgtctataagagtactatttacaataatgaaacaattggaagcaatatagtgatttaagaagagaagaaaggtaaatcacaggcagtcaataaaaatgatagatattaagagtttataaaacgatcaaatgtttacaatgtaaaattaggtaaaaaaatgcaacattcacttggttatagttatgccatatgaataccaataaaaactagaaaactaccagtttcactgtattagatgatgatttagatttcatctttaaaaattattttcatgcaattataatatgttttctataatgaaaatatcttaatgatatcatttacaagcaccattatttaaaatttgtactacactctcagcacaaaatttaaagactcttttagctgtgaaacactgctgccacatcactagccagctgttgtatgtaaaacatcaagatctaatatctttggtgacagatgggcagttcgaaaaatcagttttaactaaggatgctctcaatacctgaattatcttcatctttgcggattttgagcttcaccaggtcttcacattgctggaggatctgaactgcatcttccatggaacagttgtccagccggatattatctattgcgagcaatttatccccaagttccagggtcccagttctgttagtgaatgcaaagtaacacatgactaatgatgagcacttaactaggccatttaaagaggcattaagcataatgcagcattatggtagtctttagaggaaaagaggttcaactgtttttaaattgtacttcattgacaactccctcccttcttctagtcttatttgggttgcctgccatgatattaaattgcagagtattaaaaacattttttcttatacttttttcaattaaacaagaacatatgtgtcactcaggaagcatacaattcctaggaagggaggtaatgggcgagggtctgcatagacccaggtatccttgtctttctccatattgttgtattacttttgatccttggtagtccagatactaggagagcattaagagaatgacagaaggcaaggtgtaatagagttagtggaagcctaaggcttgcacctctgctacttccacttgcatctggaaactcactatggccagagtagcatgaaaatttatagatgaatccatagcttcttatttggaaagtggccactgagactctaaaactggctgtggaccagggtaggtctgttgaaaaaaattttaaggtccataatgaaacaacaaaaaaaataatgtgaatgtagtatgtatatgtttctatgtgtgtatatgtatatatacacagatttgtaagaacagccttttatgcattatatctgtgccagagactgctaattgtctcccagcatccattctcccttcccttcttttaagttaccctctaaaaatgcatgccccagactctctggggaccctccccacctcctgcctgtagctagaaaatggtaacaggagggaggcggagcaaggtggctgaataaaagcctccactgatcatcctccttgcaggaacaccaaatttaacaactatccatacagaaaagcacctttataagaaccaaaaatcagatgagcaatcacagtacctggttttaacttcatatcattgaaagaggcactgaagagggtaggaaagaaagtcttgaactgatgatgccggcccctcccccattccttctgcagcagccacatggcatggagagaaaaactgtgcacttgtgggagggagaacacagtgagggagagactgcattgaaactcagtgctaccctgtcacagcggaaagcaacactgggcagaagtcagctgatatccacggagggaacatttagatcagccctaggcagaggggaatcacccattccggtggtcagaacttgagttccaacacgcctcactgctgcacgctaaagtgttcttgggtactaaataaactcaagacagtttaaagccacaaagacagcaattcctggacaagccctgatgctgtgctgagctcagagccagtagacttggggggcatgtgacctagtgagaaaccagctggggtggctaagtgagtgcttgcaacacccctcccctagccctacacagcacagctcacaactcccagagagagtccttcactctaactgagtagagaagaggggagagtaaagaagactttgtcttgcaacttggatatcagctcagccatagtacgacagggcaccgggcagagtcctaaggccccttttctaggtctttgccccgggataacatttctagacacacccagggctgcaagggaacctgctgccttgaagggaaggacccagtcctggcagcatttttcacctgctgactaaatatccctcgggccctgaataatcagcagcatggctgggcgcggtggctcatgcctgtaatcccagcactttgggaggccgaggtgggtggatcacttgagaccaggagttcaagaccatcctggccagcatggtgaaactcggtctgtactaaaaatacaaaagttagccaggcgtggtggtgcacgcctgtaatcccagctattcgggaggctgaggcaggagaatcacttgaacctgggaggtgcaggttgcagtgagccgattgcaccactgcactccagcctgggcaacagaatgagactctgtctcaaaaaataaataaaattaaatataataaaaaaataaaatcagcagcagtagtcaggtagtacttgctgtgggccttaggtgagactctgagttgtgctggcttcaggtgtgacccagcacattcccagctgtggtggctatggggagaggctgtttctgcttgagaaaagcagaggaatagtaaaaaggactttatcttgaagcttaggtaccagctctgcaacagtagggtagagtaccaagtgggctcttgggttccctgattctaggccttagctcttggacgtttgtggacctgctctgggacagaggggagcccatcgccttgaaagaagagtcccggccctggcagcattcgccacaagctgactgaagagcctttgggtcttgagtgaacatcagcaatagccaggcagtacttgccatgggcctggagcagtggtggccagggggagagacttctctccttgaggaaaggatgggaaggactttgtcttgtgtcttgggtgccagctcagctatagtagaatagagcaccaggtagattcctaaggtttttgactctaggaccaggctcctagatggcatctttagacctgcaaggggccagggggagctcactgccctgaaaagaaggatactaccctggctggctttgccacctgctgattgtagagcctttggtccttgagtgaacatggcctagtggtagccagtaagggtttactggcagccatagttgagacctagtaccacgttggcttcaggtctgaaccagcatagtctcagtggtggtgaccaaggggtgcttgtgtcaccccaccacccctcagcttcaggcagctcagcactgagagagagactatatctgtttggaagaaaaggaagagaacaagagtctctgcctagtaatccagatgattcttctggatcttacccaagaccaccaaggcagtatttttgagtctgcaagagccatagtgttactggacttggggtgccccctaatggagatacaggtgaagtgaccaaaaacttagatcacaacacccaagccccttcgaatacttagaaagccttcccaagaaggacaggtacaaacaagcccagactgcaaagactataataaatacttaacaattcaattctcagacaccaatgaacatccatgagcatcaagaccatctgagaaaacacgacctcaccaagtgaactaaataaggcacgaaagaccaatcacagagaaatagagatgtatggcctttcatacagagaattctaaattactgttttgagtaaacaataaagttttgagtgtgtgataatacagatcataaattcagaatcctatcagataaattcaacaaagagattaaaataattttaaaaaatccagcagaaattctggagttgaaaaatgcaattgacacactaaaaaaatgcatcagagtctcttaacaacagaattgatgaagcagaagagataattagtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactcccgcctgggcgacagagcgagactccgtctcaaaaaaaaaaaaaaaaaaaaaagaagagataattagtaagcttggagacaggacatttgaaaatacacagccagagaagatgaaagaaaaaaaaaagctgggccaggcatggtggctcacgcctataatcccagcactttgggaggccgaggtgggcagatcacctgaggtcaggagttcgagacaagcctggccaacatggtgaaagcccgtctctactaaaaatacaaaaaaaaaaaaaaaaatagctgggcatggtggtgtgcagctgtaatcccagccacttgggaggctgaggcaggagaatcgcttgaacccaggaggcagaggttacagtgggccgagattgcaccacatcactcagcctgggcatcagagtgagactctgtctcaaaacaaacaaacaaacaaacaaacaaacagacaaacaatgaagcacacctacaagatctaaaaaatagcctcaaaaggccaaatctaagagttatcggccttaaagacgaggtagagagagggatggggtagaaattttattcaaagggataataacagagaacttcccaaacatagagaaagatatcaatattcaagtacaagaaccttatagaccacctgcaggaatttcagcaactacaaatgcaaaataactgaaatcataacagtctctcaagaccacagcacaatcaaattaaacccaagattaagaaattcactctaagccagggttttatgaatagaactctgatcttcttgggatggagccccttgcaggaggggaagccatggtctctcttgttcagttgacttagcctttcctgcctgctggctctggagggtctgggtggtctggatgagggtggttccccaaatcacagtgcacctgctctgtcaagcggcagccagactgcttttttaagcgggtccctgataccgttcctcctgactgggtgtgacctcccaacaggggtctccaggtctccagatcggcatcaggtcagtgcccctctgggacagagctcccagaggaaggagaaggctcccatctttgctgttttgtagcctttgctgtcacaggagggatccaggcttggggtctggagtagacccccagcaaaccacaacggcactacagaagggggcctgactgttaaaagaaaaacaaataagcagaaagcaacaacggtaacatcattaacgaaaagaccccacaaaaactccattcacagatcagcaacctcaaagattgagggtagataagttcacaaagatgagaaagaatcaacttaaaactgctgaaaactcaaaaagccagagtgcttcttctcttccaaataactgcgacacttcttcagcaagggcacagaactgggctgaagctgagatgactgaattggcagaagtaggcttcaaaaggtgggtaataatgaacttcactgaactaaaggagcatgttctaacccaattcaaataagctaagaatcataataaaacattacaggagctgatgaccagaatagccagtttagtgacaaacataaatgaccttatggagctgaaaaacacaacatgataacttcacaacgcaatcacaagtgtccatagccaaatagactaagtggaacaaagaatctcagagttgaagactatctttctaaaataagacaggcagacaagaatagagaaaagagaataaaaaggaataaacaaaacctccaaaaatatgggattatgtaaaaagaccaaatctatgactgattggggtacctgaaggagaaggggagaacagaactaagttggaaaatgtacttcaggatataatccaggagaacttccctagcctagcaagacaggccaacattcaaatttaggaaatccagagaacctcaataagatactacaggagaagatcaaccccaagacacataatcgttggattctccaaggtcgaaatgaaagaaaaaaatgttaagcatagccagaaagaaaagccaggacgcctacaaagggaagtccatcagaccaacagcagacctctcagcagaaactctacaagccagaagagtttgggggccaatattcaacattcttaaagaaaataatttccaacccagaatttcatatctggccaaactaaacttcataagcaaaggagaaataagatccttttcggacatataaatgctgagggaattcatcactatcaggcctaccttgcaagagctcttaaaagaagagctaaatatggaaaggaaaaaccattaccagctgctacaaaaacacactgaaatgcacagaccagtgacactatgaagcaaccacataaacaagtttgcaaaataaccaactagcatcatgatgacatgatcaaattaacacatatcaacactaaacttaaatgtaaacaggataaatgccccagttaaaagacacagaatggcaaactggataaagagagagccaagacctattggtatgctgtcttcaagagacctatctcacatgcagtgacacacataggctcaaaataaagtgatggagtaaaatttaccaagcaatgaaaaactgacaaaagcagagcctgcactcctaatttctgacaaaagatactttaaaccaacaaagatagaaaaaaaatgttaaattcaacaagaagagctaagtatcctaaatatatatgcccctaatacaggagcacccagattcataaagcaagttcttagagacctatgaagaaacttatactcccacacagtgacagtgggatattgtaacaccccgctgacaatattagacagatcatcgagacagaaaataaacaaagatattcaggactcgaactcagctctggatcaagtggacctgacagatatctacagaactctccaccccaaaacgacagaatatacattcttctcattgccacatgacacttactctaaaattgatcacataattggaagtaaaacattcctcagcaaatgcaaaataactgaaatcataacagtctctcagaccacagcacaatcaaattaaactcaagattaagaaattcactctaaaccacactactacttggaaattgaacagcctgcccctgagtgaaccttgggtgaataataaaattaaggcagaaatcaagaagttctttgaaactaatgagaacaaagagaccaacaaccagttctgaaattgagacagtaataaataggctaccaaccaaaaaaatcccaggaccacatggatttacagctgaattctaacagaggtacaaagatgagctggtactatttcttctgaaactattccaaacaattgaaaaggtgggacttctccctaactcattttatgaggctagtatcatcctgataccaaaacctgggagagatatacaacagcaagtaaaaacttcaggctcatattcttgataaacatggatgcaaaaatcctcaataaaatactggcaaactgaatccagcagcactttaaaaagtttatccaccacgatcaagttggcttcatccctgggatgcaaggttggttcaacatacacaaaacaataaatgtgattcattatataaacagaactaaagacaaaaaccacataattacctcaatagatgcagaaatggccttcaataatattcaccatcccttcatttaaaaactctcaataatctcggtattgaaggaacataactcaaaatagtgaaagccacataggacaaacccatagccaatatcataccgaatgggcaaaagctggaagcattcaccttgaaaactagcacaagacaaggatgccctctcatcactcctatttaacatagtatattggaagttctgaccagggcaatcaggcaagagaaaaaaataaagggtattcaaatcagaagagaagaagtcaaattgtctttgcagatgacatgatcctatatctagaaaaccgcatcatctcagcccaaaagcttcttaagctaataagcaacttcagcaaagtctccacatacaaaatcactgtgcagaaatcactaacattcttatacaccaacaataggcaagcagagagccaaataatcaaagaactcccattcacaattgctacaaagagaataaaatacctaggaatatagctaataaaggaagtgaaggacctcttcatggagaactacaaaccactgctcaaacaaatcagagaggacacaaacaaatggaaacacattccatgctcatggatagaaaaaatcaatatcatgaaaatgaccatactgcccaaagtaatttatagattcaataccatgcccattaaactaccattgacattctttgcagaattagaaaaaaactactttaaaattcatatggaataaaaaaagagcctgtatagccaaaccaatcctaagctaaaagaacaaagctggaggtatcatgctacccaacttcaaactatactacaaggctacagtaaccaaaacagcacggtactggtacaaaagcagacatatagaccaaaggaacagattagagaactcagaaataagaccacacacccataaccatctgatcatcaagaaacctgacaaaaacaagcaatgggaaaaggattcccaatttaatacatggcactgggagaactggctaatcgtatgcagaaaattaaaactggaccccttccttacaccttatataaaataaaataaaataaaataaaataaaataaaataaaataaaataaaataaaatggattaaagacttaaatgtaaatcccaaaattataaaaaccctagaagaaaatctagacaataccattcaggacataggcacaggcaaagatttcatgacgaaaatgccaaaggaaaatggcaacaaaagaaactttgataaatgggatataattaaactaaagagcttatgcacagcaaaagaaactatcatcagagtgaacagacaacatacagaatggcaggaaattttcacaatctatccatctgataaaggtctgatatccaaagtctacaaagaacttcacttctcaaaaaaagatattcatgcagccagcaaacatgagaaaaagctcgtcatcactgatcattagagaaatacaaattgaaatcataatgagatatcatctgatgccagtcaggatggcaattacgaaaaagtcaagcaacaacagatgccggtgaggttgcagagaaaaaggaatgcttttacatggttggtgggaatgtaaattagttcaaccattatgaaagacagtgtggcgattcctcaaagatatagaagcagaaataccatttgacccagcaatcccattactggatatatacccaaaggaatgtaaattattctattataaagatatatgcacgcttatgtccactgcagcactattcacaatagcaaatacatgggatcaacccaaatgcccattaatgatagactggataaagaaaatgtgatatatatacacacagaatactatgcagccataaaaaggaatgagatcatgtcctttgcaggtacatggatagacctggaaggctttatcctcagcaaactaacacagaaacagaaaaccaaacactgcatgttgtcacttataagtgggagctgaacgatgaggacacatggacacattggaaacaacaacatacactggggcctgtcatgggtgaggtgatgggagggagaccatcaggaagaatagctaatggagactgggcttaatacctagatgataggttgatctgtgcagcaaaccatggcacacatttacctatgtaacaaacctgcacatcctgcacatgtaccctggaacttaaaataaaatttgaagaaaaaaaaaacacgacgaattttgtaaactatgcagacacatggaaatgaaacaacctgcttctgagtgacctgtgggccaatgaagaaattaataagaaaattaaaaaatttcgtgaaacaaatgataatggaaacacaacacactaaagccaatgagatacagcaaaagcagcactaagcaggaaatttttagctataagtgcctacatcaaaaaagaacaaagacttcaaataaataacctaacaatgcatcttaaagaatcagaaaagcaagagcaaactgaacccaagattagtggtagaaaataaataataaagatcagagcaaaaacaaatgaatttgaaatgaagaaaacaatgcaaagatcaatgaaacaaaatgtttttaaaaaggtgagcaaaatggacaaagctttagcaagactaataacaaaaataaaaaaaggagaagacccaactaaataaagtcagagatgaaaaaggagacattataactgatatcacagaaattcaaaggatcattagtggctcctatgagcaactatatgccaataaattagaaaagctagaggaaatgggtaaattcctagactcatacaatgtactaacattgaactatgatgaaattcaaaacctgaacagaccaataataagtaacatgattgaagtcataataaaaagtctccaagtaaggcaaaacctgggacccaaaggcttcactgctgaattctaccaaacatttaaagaactaatataaatcctgctaaaactattctgaaaaatagaggaggagggaatgattccaaactcattctatgaggccagtattaccatgataacaaaaccagacaaagacacacacacacacacaaagaaaagaaaagaaaaagaaaaagaaaaagaaaactatgggccaaaaacctctaacgaacattgatgcaaaaatccttaataaaatactagcaaagtgaagtcaaaaatatattaaaaagatgattcatcacaaccaagttggatcacaacccagggattaaaagatggtgcaagctatgcaaatctgtgagtgaaacacatcatgtcagtagaataaaggacaaaaaccatatgatcatttctattgatgctgaaaaagcatttgaaaaaatttaacatcccttcatgataaaaatcctcaaaaaactagggtatagaagaaatatacctcaacataataaaagccatatacaacagagctgctgctagtatcatactgaatgaggaaaaactaaaagccattcctctaagatctggtacacaacaaggatgctcactgtcaccactgttatgcaacacagtactggaagtcctagctagagcaatcccacaagggaaagataaaagcgtatccaaattggaaaggaagaagtcaaattatccttgcttgcagaagacatgatcttatatttggaaaaacctgaagactccacaaaaaacaattagagctgattaaaaaaattcagtaaagttgcaggcttcaaaataaataatacaaaatcagtagcatttctatatgccaacagtgaacaatctgaaagagaaattaaagaagtaatcccttttacaagagccacaaataaaatcaaatacttagaaattaatgaaagaagtaaaagatctctacaatgaaaactgtaaaacactgatgaaagaaattgaagaggacacaaacaaatagaaaataaactacatgtttataaactagaaggatcaatattgttaaaatatccatactacccagagcaatctacatattcaatgctatctgtatcaaaataccaatgacagtcttcacagaaatagagaaaagtatcctaaaatttatactgaaccacaaaagacctagaatacccaattctatcctgagcaaaaagaacaaaactggaagaatcccattatctgacttcaaattatactacagagctaaagtaacccaaacaccatggcactgacaaaaaaacacacatatagaccaatggaacagaatagagaacccagaaacaaatccacatgcctacagtgaactcatttttgacaaaggtgcctagaaacatacattggggaaaagacagtctcttcaacaaatggtgctgggaaaactgaatatcaacatgcagaagaaaaaaactagacagctatttcttgccatatacaaaagtcaaatcaaaatggattaacaacttaaatctaagacttcaaactatgacactaccacaagaaaacattggggaaactctccaggacattgctctgggcaaatatgtctcgagtaatatcccacaagcacaggcaacctaagcaaaatggacaaatgggatcacaacaagtgaaaaatctttttcatagcaaagaaaaaaaatcaacaaagtgaagagacaactcacataataggataaaatatttgcaaactatccatctgacaagggattaatcaccagaatatacatggagctcaaacaagtctataggaaaaaacaatctagtaatcctattaaaaaatggccaaaatatttgaatagtcatttctcaaaagaagacatacaaatgtctaacaggcataagaaaagatgctcaacatcagtggtcatcagagaaatgcaaatcaaaactacaatgagatatcatctgacccgagttaaaatggtttttatccaaaagacaggcaataacaaatgctggagagaatgtggaggaaagggaaccctggtacactgttgatgggaatgtaaattagtacaagcaccataaaaacagctggaggtttctcaaaaaactaaaaatagagctactatatgatccagcaatcccactgcttgggtatatacccaaaagaaaggaaatctgtatattgaagagatatctgcactcctatgtttgctgcagcactgttcacaatagccaagatttgcaagcaacataagtgtccactgagagataaatggataaaaggaatgtggtacatatatacaatggagttccattcagccataaaaaagaacgagatcctgtcatttgcaatgcattagatggaactggaggtcattatgttcaatgaaataaaccaggcacagaaatacaaacatcacatgttctcacttatttgtggtatttaaaaatcaaaataactgaactcatggagagagagagagtagaaggatggttaccagaggctaggaagggtagtgggggggtcagcgtggggaaagtagggatggttaatgggtacaaaaaaatagaatgactaagacctagtatttgatggcacaacagggtgactatggtcagtagtaatttaattgtacacttaaaaataactaaaaaagtataattggattgtttgtaacacaaaggataaaagcttgaggggatgggtaccctattttccatgatgtaattactgtgcattgcatgccttatcaaaatatctcttgtatcccataagtatatataccaactatatacccacaaaaattaaaaataaaaaaatggtaataactgacaagctgctgggatggctcccatagccctggattgcctgcctatctcccaactgttatgagagagaaacttctgtcttgcttgatccactgtctttggatgtctctttgtcatagcagtggagcctgcacatatatcacctaaactcacacaatgtccttcctactttttgaatgttaaagtatttcttgggctgggtgtggcggttcacacctataatcccagcactctgggaggctgaggtgggtggatcacctgaggtcaggagtttgagaccagcctagccaacatggcaaaaccccgcctctagtaaaaaatacaaaacttagccgggcatggcggtgtgcacctgtaatcccagctacttgggaggctggggcaggagaatcgcttgaacccaggagacagaggtttcagtgagccgagattgtgccactgcactccagcgtgggtgatacaggtgacactcggtctcaaaaataaaacaaagtatttatttaataaaataattgtgataataggttgaaatttttttaagtcctgaattggaaaataaaaagaaagttaatggtcttatatcagtatcctcaatcatttaaaaatatttttatttatgaaatgaaaaatttgagacctcctgattttgatggtatatgggccaaataggtgacatgaacattttaaaactcaagaatcttgcttgcccagaggggatattctggtaacagcaaaattcttgcacaacttatcacctctgtttgggtacctctaataagtgctgctactttcagggttttttttttttttttttggtcagaaaatgaatggaagctgaccagtgaaggagagcctatgctagattcatgaaagaccctaagaaatgttttcagctgtgcagaaataaattgataagcaggaagagatctatggagccactggaactagggatgtcaaatatgatcaattaatagtggctgcttggaagtttttgaaaatacagtgacccattagaaaggtttgctttgggtgtggaaggtgtcatgtttacttaaattaagagaggccttaaaatgaatcagaaaatccattttccttacctgtgtgccacactccctttcttgatatctgaaatgacgagggggtctcctggttttctactggatggtgctgtaataatggagatagaataatcacatctttatatccattattcaccccttactgtacatttcccctgttttataataacttaatgcaagtaatgtttgtatgcaaaacaaagatggtcagcaaatgaattaggaagtatgcacattatgtctttacaaatgtttgtgctaaaatatttacaaacataaaaactaaagcaatgccactttaaatttgtaattagagaaagcaattggataagtacccatttaatttaaatctattttaataagcaattctcaagagaggacctgaagggtgggtatctcagttggagagtattaaaatcaattgggggctccccttagttaccccttcttttattcctttccagtgaggagacaccactgttgatgggaatatgccatatatcacttcagtgtagagtgggaaagtggataagaattactgatttaaagttcttttttttggccaggcacagtggctcatgcctgtaatcctagcactttgagaggctgaggtgggaggatcacctggggtcagaagttcgacatcagcttgaccaacatggtgaaaccccacctctacgaaaaacacaaaaattagaaaggcatggtggcacatgcctgtagttccagctacttgggagactgaggcaggagaattgcttttacccaggaggcagaggttgcagtgatccaaggatcacaccactgcactctagcctgggcaacagagcaaaactccgtcttgatcaatcaatcaataaagttcttttttttttcctcacaaggaaatcttttgctagatggactctaaatctttaaattctgctcacaaattcatacttagaaagctcttggaatgtgacttttttttttttttagtaaatattttgttgctagttaactaaatttttatatatgctcatattctaaacatgtacatgtaattttattgagtttttagataaaactattatactgcacagtggtcagttttgggtttttatcaattttctcaggaatatttccatttatgagagtaaaaaacaattataaatgagcctacttagaattaaccctagaaactaattatagtccatataaatacaaaaaaaaatcttggattagaggtttgcacttaatttaggaattggatccttaaaattagccataccaacatttgtgaaaaacaatttgcctccaagaggagatattttgccaacctgaaggctggagtggtttccttttagagatcattaacaggcccctaaagtaagattttattataaacagtctgatcaccccataataatcatagagccatatcatatcccataatcccatctgaatcccaggaaaatgtttatgcacaagaacagatggcttaatatcttaacacaacatttaaagaaaaagaaaacgcatataccgataccttacccactgtctaaattagtccatagtaaatgctaatgggacttcatttaatcattattcttagcttccagcaaagaatgcaaaacattctcttcactacaattaattcataatttaaaacttcattcaatgatttgatagaatgcctctagaggcatataagcatccaggatttctagttacatcatatttcaaaactgcaaattgttctgggcatagggcacaaaaacaaaaactttgttattaccagcaagtacagcttttctagcatctgccaatgaattgacacaatatttttgccaagctgtagtaaccatcacatagcactcaatgtttcctttggcttttttaaaaaaaatccatgttccactgaaatggtctgtaaaaccaaacaatagtagaggcaacaaaatatatcagacctatctctgtcatccttgaaagagagaaatatagcactataaggtcttggtcaaacctacacagctttgcagaggagtttgaaactactcatggtctacagacatgtatggtggccattttcacatttactagattcttctctttctcctttaatggactcgatagggtggatgcccattgggatgatggggtcgaacccagaagtgtgtcatccagatctgtatgagatcctgcccatcaccaccatgcatgttaaatgtggctatgcatggtccgggggcccagtcatggtttgtgtatcctagccccatgttttaattttctactacctaagaataaatcacaaaccaagcatgctttgcttggctggtagtgctttaaaaatatttagttgccaacacttacaaattagtagattttatatagatacatggcttcttttaaaaaaatagatgggcaatatggtgtcatgattgagagacaggacttggcagccagaatggttgggtccaaaatcctggctctaccacttattagctatatgtgcttgagcacaaagtactcaggtgccttagtttcctcatctgcaaaatggtgttcatgaataacagtgcttaccatacagtttttgttgggaggattatgtgagctattacatgtaaagagattggatgagtgcacacataaggaattacataaatgtttattgttgctattattgtttaacaacagtggactgtttcccactacctcctttagatggagcctttgatttcccatttgcctctatcctcattgggctgatctcactcactgagttgcctcacccatgaaagcttctgagtttgtgaccctttgaatgagaatacactagcattcactgagtgcttggaatttgattggagttctccacagaaccattcgtttatttagtacatagtttttgaacaccaactatgagacaagcgcctctgctctgggcactggctatgaacctccagggaagttgaataaaaaggagagacagggctggttaaatctcctgaagttattaggcatgaaatagttttctctcttctgtcaagtgattccaagtgggaaatccatacaaacacatcatatggggatggggaaggatactgaatacttccaagagtgtggttaagaagaaaagggcaataaaagcttattaagttctgaaacagaaagaaaaaacaatacaactctttgaaatttcaaactccttgaaatttcagctgaactggtcgaacacacaactgaaagcctgacaaaaaagagcaatgatgctaaatcctgtgttatatgatatatattagtactgcctctttcccattcatattttatgaaatgattttaattcaaactcgtcacttgtatctccaatgcaagtgtttttgttgttactagatttgcattatttgagtcatttacaagcttgttcagaattcatcgtcgtcatgtgtgtctacagctcttctgcaatccagcaaggcgatgtcattggaaattttatcccggatcacaagaatccattttaataacactgcaatattaagatttttcatgctgcctatagatatacattcttggtactcacaaggaaacaacttactatattactttttaaaatgtattttctttgtaccaaaaatatacatgcatacaatttaaagagtcaagaattctgaaagagccgtcctcaatttcttgcttccccagatgctttcaattcttttggctgtttccatattgctaaataatatatgactattactaccaaattattttctggtgttagtcattttctatttactttctattatgaaagatgaagagttagtttctcccacctctagaccactaacatactcatatacccttcttgtccccccattttcccaataccattttgtcataatttttggtatttattgatcaacatttggaatttattttagcatgactatgtcaacagcatccagaggtaagtcatatagcattccatgatttctttccttttctgcagaatatgtatttcctttagttatctgatgtcttgatgtttttgtttgctttgttttcttgtgtttattattaattcaactcctcatatttcccaggatatataaatcttctctcaatgtgtcaaatcttatcaggaattctatcagagtttgctaatctgtctggactggttgctttctaggtttgctacacagatcttggggacttccttcccacaaaccctgggaaacccagaggttctcttctcttctctcttgcatccttagatcccttgtatcctgaacccaactctccctgtttctggctttactttctctcactcttggtggtgcacattctccagtagcttctgaggaagagtgcaagggagaagagtttattgagaccttgtagagctgaaaatgtcattttctaccttcatatttgattgactactttgctgagtaaagaattctaggctggcaatccttcttttagaaatttgaaggcacttttccattgctttctagcttccagagttgttgttgaaaagcctgatgctgagaaatgcaaatcaaaaccacaatgagataccatctcacaccagttagaatggcgatcattaaaaagtcaggaaacaacaggtgctggagaggatgtggagaaataggaacacttttacactgttggtgggactgtaaagtagttcaaccattgtagaagatagtgtggcaattcctcagggatctagaactagaaataccatttgacccagccatcccattactgggtatatacccaaaggattataaatcatgctgctataaagacacatgcacacgtatgtttattgggcactattcaggatagcaaagacttagaaccaacccaaatgtccaacaaagatagactggattaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccgcatattctcactcataggtgggaaccgaacaatgagaacacatggacacaggaaggggaacatcacacaccggggacagttgtggggtgggggaaggggggagggatagcattaggagatatacctaatgctaaatgacgagtgaatgggtgcagcacaccaacatggcacatgtatacatatgtaacaaacctgcacattgtgcacgtgtaccctaaaacttaaagtataataataataaaataaaaaaagaaaagcctgatgctattctgattatttgattattgtttgtattattctaacacattgtatgacaccccatcatgccctgctgctccagcaccacaaccctgtaagattactgcttcgtccagtgttctcagatctcttgatgacaagcttttctgtgggtatttccatccacaggtatggacccaccattttggaaataaatcccttaattctaagacatttatacaattatttctttaatgtgtttctttcctctttctttctgtaacacctattacttggatgttgtgtcatttgtactcaacctgtataattttctcatctattctagattcttcacttatttgttgttctaatttctgaacattttccttaactttattttccaatatttgtatagaagtttagttttttcatttctcttaattttcaaggcccacttttttccccctctgaatgtcattttgtaatagcgtccactccctgctcacctcatgaatgcaatgtatttgttgctaatgatgtcaatgataggtttctctttgtttggtttgttttcttcttcctgaatgtgctaattctctgatttccccctttgtttctggtgacagcctcgcatattagattcttcctcaagtgtccatttttctcttagctgtctgtttatattaaagagtgtggtcctaaagagctgttcaaaagcttggtgtacccaagtagggcttgtggactgtgggtcttaagtgtaagttgaggccaggctgtttatttgggtcagatggtcctgaattttcctaccacttgaaggctattaaacttggctatctggcttctttaagcttcctgggggaagaaggctctcagtctcaacattcagtatgcaaaccttcacctaatttccatttttaaagcagtactgctgcattcagctgtgtgctctcagtccaaagaactctctattgcatgctttccagagaataaaactccaggcttctgccagggtaggggaagggtacttcggagtcggagaaggcatctaaagactaaggtcattcttagcagtctttaaaccaatcctcctgccttaggattttccatcaaatgtacttcccgaagtttctggtccctgaacctgtactccaaagggagtacaggatagaaattaggctcactatcagcttcccctctgcttctttacttaaattcatctttctttatcttctttgccaaatttggttgctgttgtctattttccttttctttttgtccttatgagtttttgccctttgaaaaatcttatattgtcatttaaagtggagtgtagggtgggagaagaagtaaaggcttgtgttcaagctactgtcttttagaaacagagcagggacccctcttaggagcctgctgagcaccaccccccaaacatagaagtataaaaaaaatagtattttcaagggaaattccaggcacctaggtaggcttgaaaagtcaattaacaaccctataagcaagaagatacaatactgagaacttaaacaatagtttcccaagcaagtcagcatcacaaagcattttggttccccatagaaactaaaagataatatattaacatatgttcttatgttgtttttcagaaacctggacccacaccagatggaaaatgctgaccaccattacatagacctcagagatctcatggagataaggaagaagtgagaactgaactctaccattttttgttctaaatttcttcctgagagacctggagagagtcacgcctaaaggccacaccttaacattccttttttgcggatcctaagtttttagacaaagccctgcttctttaaccaactgcaaatcaaaaaaaattctctgaatccacctatgacctgtaagcccccactttaagatacctgccttttggggccaaaccaatgtaaagtctccatgtattgatttatgactttgcctataacctctgccttctacctttaaaaaccatctaggccatcagggagttcaagtcttaagcattagttgcccaattctccttgcttggcaccctgcaacaaatgcttcactttctctcgctgaaaatcctagtgtcactgtttggcattttctgtatgctgggcaagtggacccaagtttggtttggtaacattttgacctcagaaatttaaaaaccactcatcatcacacacacacatacaaactcttaatcattcagctttactttaattgcaaccatatacatcatacatggtaagtaaaacaagttaattgatttgaaatggagcagtgagtagagctttttactgcaaagttggcaaaataacaggaaccaatctcttctaaatatactttaaaacttaggggaaaaatgacagatttgttgtgcttgtcatcacaaaggctgcttcatgattttataagaaaataaagcaagcctttgttcctgcaaacaattcagtcagaactaaaaaggaaagacagtgaattcactgtactcacaaaatactgtcttttgcttttctgatataggatatagggagtttcatcaatcagatggtgacagggatgagtggtgtggtgaaaataaagccagtgctaagtcagagacaatgggtttggatccctgcttcactttttattagcccctggtctttgggcaggttacccagctgagttgttctttcctctttgtaaaatggagatagatgtcacagagctactttcaggattaagtaagaaaacatataaaactgcatagtgccatgcctggtacaaagtagacacaaacccctgtaataaaacctcaagggaaaacacccatgtaaaaaggactttactgataatgggatgtgacagagacaatcaggattcgctgactcgaaagagaggtgggctgtgaggaaggtgtgagctctgggatttctgactggttaaggtgtggaggcatcaggatgtgacttccagtcctgaactgcatccttctgctaggctgttccactttatttgctacaataaatcactctatattacagcaataacatcaataaaagcaatgcctggtgctaatatgctgcaaatgtgtcatcggaacttaagaaaattagtctgaaactgctcactgtgtctaaaatcagacagactcatttctcagtcaattaggtatgaagagtgagccgtaaaggctctgctggtatgcttccagagatgaggggctgtttcttaatacttagagcttgcacaaggtgaagacgacagaaagaggacttggtatagagataatgagaagaatcaagtccttgcagcacctcggtttcactaacagtatccgtgtgtgtctgagaagagggttcccagatttccttcttatgttggcactagattttgtgggctggagctgtgcttaaaatattttagcaggcatggtggctcacacctgtaatcccaacactttaagaggctgaggcaggaaaatcgcttgagtttagaagttcaagaccagcctgggcaacacagtgagactttatctctacaaaaatttaaaaattagccaggcatggtggctcatgcctgtagtcccagacacttgggaggttaaagtgggaggatcgcttgagcctaggaggttgaggccgcagtgagccctaatagtgccgctgcactccagcctgggtgacagagtgagatcctgtctcaaaaaataaaacataaataaataatataatatttcaaaaggctctgtgtgtaaagtaaataatgacgaagatcatcatcattaatgtttgttagggttcacaatgtgtttaaggcattttacatatagtaattcatttaatcttgtcaacaatactatgaagaaggtaatatgtacaccattttctagatgaagaaacggcacagagaggttgagggaatcagggcatgagacagtctaggctctgagtccttgctcttaatcattttctaagtcagtctttcttctgtctatgcatcagcctttgcacaaacatttatattcatttatcatctcccttggaagctcatttcttggagtacatagtgcttagtaaaacatttgcaggtaaagcttcttattcattcactcagcaaatggaggcattatataagcacattgtatgtcaggaactgtgctaggcctcaggattttactaactcataacaatgaaaatggattctggcctttttgtttttctttttttaaagagcaaagtctgctttgtcatctggcaaaatatgagtatttcccatgaggagacacaaaagtcagcgtggtggtgacgactagttgtgcaaatggagctgtagctctagaagaactgacaagcatgtttgacaagctcatgtatcatttctctgtccgggaatagcataacactttcagcttccatgaatgcgtttgcttgtggctggctaaaatgcaagccatctttatgggggtttttagattgttgccattattgctactaaaacccattttagaagtaaaacactcatgcaaaacaaaacaccatcataaagcataatattaaatgattcttcatgtggataaaacaaatattttgtagtttgtgtacaagactacatctcaaacaaattagcatataaatgtctactttttaataagaaatacaccatagggtatttttagatggatactttctgactaaattatattttttatttatatcaatctgtaactaagaatacatctattgtataaaacaaaattaaagacaatattcctacttaaaatttgagagtaaaataactgtgtggcagtggtgataaagcttctgaggaatagatgacttcacaataccaaccagcaggaagcatctagaaggacagggtgtatattcttaaaatttagcctagggcttagagcatggtggacactcagaatgcatttgttgagggaaggcagaagaatgaaagaatggaagtgggggcagggtttctgtgtacagaggcaggttatatagtgcacaactccaagacgcaccactcccacagctagttctgacagaataaatgaatggattggaataaacaaaagagaataaccttaaagttgcatgagtgtttgcatgcagaagccatcttgagccctaaatatgtttggaacagtaaattctgatacgctttcttaattttagtagccctagttgttgacactatagtgacataccatctttgctgcatagtgaaaaaactgagaggctaagtgacccaattaaaggaataaatgactttaggagcacttaggatagtgctggagtctctaaaatcccattccatctttctacttttctcccactaggtcacattagggtttggggggatctaggctctctcccatacatgtggcttcttgctcttaatatttattttgaattgcagtaccgttctttttagtgttgcagtagatatgtgtgggttattggttataaataaaatttcatttttcagtattaaatttgtatcgtccatgttgaatcagacagcaccatttcatactgcccaattgagaacttttatttattttttgcctgaaccactgacagaaatgctatccaacagagtgcagtgaggcacttttatgtggcctcatcactctttcttgaagaaaccagctcttggtcacagtcattacctctacgtctcctttggtctttaggcatttaacatttgcttcattttcttgggacatttatggatgcatttagtctatggatattaaaagccccccaaaaccctcaatttccattctatgaaagtccactggagctaacactttcaaagttgtttttaccaaagcagttataaaactaaagcccgaggaaaggagggaattgagtacatttatatgctccacttttctttctggttcagttttccagacactgtgcactatggaggaattcaaggatttacttaaagtaagagacattgttttagtcttgtgaaaaggattatagatgcttagtggacagatgggaagatagtcttaaaagtaaataaaggtaatttttgttaaatagattataaaaacttaattcacaatacactgtgaattaatatacaatatgctaataatatatattatacgatatactaataattcacaatataaaatgtagagaatctatatgcatctatctctcatctaattatttatctagttgtgtgagatacatgtttatctcaccaggactcatcacttgccaagcactgtactaggtatataaatatggattttattcaataattaaaacaatcctatattttctagctatccttattttcattttacagatgaagaaatataagattggagagagtttgagtaacttgtctcattcatacagccagtaagtgctggaggtgtgactgactccacatttttgtatcatgatataaaaacttcgcaaagacatataaaacatttgttacacctgcaaaccatttgacaacacagttttctaatgcctttaaaaattatttaaaagaaataacttctacttacaacttatggttattccaagttccacattgtgcttcttaggcagctttacatgaaatgttccactacttgggatgacagactctaatatcaaaacaaaaaagaatgtgttaatagaacactgaggactggagcacccatcaataaaaatgcattaggaatacttgtatcataatcatatgtagctaaaactgtaggaactgaagtaagatgaaggcctttaaaatcctagtaaattaagctcctggtgatgaatacacttcctatccacaggcaactgtgcataattcacaccaacagttgagttcagtatttctcaagtgtgatgcatgcaccatctacatcaaatttacctggaatgggagttacaaataatgattcctgaataattccaatctatgaatcagaatctctaaagatgaggcctagagatctctaggtgaatctcaggcatagtaaagtttaagaaccttaggtcctattatattctttccacccccaaccatattttccaagagtgtgctattcagtaattcttccccccacctccactcctatttattgtttgaaggtacctgggaaaacagatttcaggagagatgtcagtttggtgtgatggttgctgattgggcagtgagagtgggtggagaggtgccttaatttgtaatgtgaaaagtacaattaaagaggtagaatcaggagtgacattcaaaatatttcacaaccaaaacagtactggttatcaatcaaaaagactaaaacaaccaatcaaactagatgctgaccacagagttggaacacagggacccagcagattccaactacattaaatgatcctttagtttctgtataatgaggagcttttagagattccagagaggatcacagggcactggaagggagtgaaagtgggctcagatactggccagtcagtatagaagtaagctaatatcaaggcaacagagagagaaccagtgtacactggctgaatctcaacgcaggacagagctaagctgattttatccagacctaattaatgtctgagaaaggaagaaattgctacagattcttaaatatactcttcttaaaattccttaacagtcagaaagacctttaattaatgataaggttaaaatggaaatatccattgaagagatagcatctattcatgctaagttgctaatgactataatcctttctgatggttttggaaagaagtggggagaggcttcaggaacagtggaaactttagcataagcagaggattgtgggatgggtgagctatccacttggccggcttggtcagcttgactcaaggcaggtgcctatccagcacacagacaattaaccacagcagaaccattaggcactcaggcccttagcttaatttactaaccacatagttaacacatttgagtctgtgcaaagtggaggtgatggttaggactggattcatggaaagagagagaggactcccttctttgtttggccttgaattgctcttcttgacctctcatcctttctgaggaaaaattcaggtattaaatgtctcacaagaccagaatctgatttttcaactcagaagttttgccatacagtgttaaactggagagcacaatagaaatttgatttccctgggcccgcctagcttttagaaagccacctataaaaaaggatccccagactggccctctcagcatcagtggtgctatggggtcttccttctctgggctccctccttcgctctggtttttatttacttcagaggggagtgaggcaatcagctgcctttcccatttcctccctcgaccaagtgagtgtcacggactgagttaacacctttgacttcggggttgtcttcagctaacactctcatgggccaggaagtgaatccacatatatttatttgtttatttattcactaagaatttgtatcctttcaatttctcagtaggacttgagatagagcaaattatttcccacaggagatttgaaaaagactggctaatctgaaaaagagaaatgaagtaggtaaaaaaccacttaggtgtgctttacttcctgacttcaggagctgcaaatgtcataaatatttccttacaaaatattttccaatctatgcctttcctgagtcctccccatactgcgctttaacaacaaaaggctaattgccaccttccttctaccttcaaagtgacagtttaagaatttggaattagcatgcacactgggggcagagagggcctttggaagtggccaggttttgcccatatgcaccagcagccagtcagcagagagaaggaagaaagaagcaagtgtgtatgaggagagagcctgtgcctggccttgacagccattgaagtcaggttctagcccttcctggctgtgaaacacagattgcgcttccagtgaatgcctcttctctgattaaaccaggtggagtgcatgtttcttgctggcaactgaaagatccctgatgaacacattgattcggtagaggaaatgggatgagggcatgcagaaagcctccacacaagtgtttacgggcatagcagaaaaaaatgatttgattacttggataaagcacacaaatggcccataagtaaatgtgcatgaagcatcactatttgtagaactcatttcacaaacgtgtgaccattttttttttttttttggagactggttctcactctgtcacccaggctggagtacagtggcacaatcacagttcactgcagccttgacctctgcaggctcaggtgatcctcttgcctcagtctcccaagtagctagaactacaagcacctgccatcacgcccagctaatttttgtattttctgtagagatggggtttccgccatgttgcctaggctggtctcaaactcccaggctcaagtgatccgtccacctcagcctcctaaaaggctgtgattacaggcggagccactgcacctgtcctacccatttaatattttctgttttaagaaacagttctctgtgaaaggggaggggagcatacacatatttgtacatatgtatctgtatatctgtatacgtatatagcatcttgcccatgatgctaagcttgtgtaagtgaggtctttgaaacacaagggccagaaaatgctgttctagaatagttactacagcaacattttgcttttataaatttttaatccagggaaacttgaccaagattaacattgttaatgacactgcaggagatattatcacttcctggaaaacagtaatgaatcacttctgactacatgagatttgaaatattcataatgatgaacaaatatcaactaataaatctctttgatcaagctgtggcttcattttaatctttaaatgccaacatgatttattttatatttgttattttttctttatataattatttggctgctaaagcaaaggcatatttaatttggggtttcttaaagaaacactagtaaagaggaaaaggtccaatatttggaaaaacagcaggtttagaggaagtacatagaatctaagaacaaatgatgtttattttgttagactcgcatgtaattattttgtacttccctgattttgctttatctttgttaatgctataattaaaaacacatttgggtaaacaaaggtctccttctttccaagtggtctgcttttctgcctgaagcattcattgttagcacagtaagataacaaccacaccgtaattcatcaatgcagacaccctttgtgaggaacgtgaacgtttaactcccaccaatgcagagaaaggcactgggggctccataatgatggcaaacattatttgataggattctcaccgagacttctttccagaacaaagatatatatttttttccaacaaaataacttcagacttaaagtagaaacttcaggtattattcatgatattagttggagatgggtgtttaaaaggcagtaacaaacaaggcaaaatataaattgtgcatatattatggttacagctttataaaattatatgtatggtaaggattttggtaagaaatataaaaaatttaaacatatttattagcatgatggggttataagcaccttttacttaaaacaatttcattaaagttactatgctgtttgtggagtatagtacctatatttaaagagacagatttggggccaggcgcagtggctcacacctgtaaccctagcactttgggaggctgaggcaggcggattgcctgagctcaggagtttgagaccagcctggccaacatggtgaaaccttgtctctactaaagatacaaaaatacttagccaggcttggtggcacatgcctataatcccagctacttgggaggctgaggcacaagaattggttgaacccaggagacggaggttgatagcaccactgcactctagcctgggtaacagagcaagactctgtctccaaaaaaaaaaaaaaaaaaaaaaggagaaaagggagagagatttgggcaaaaatgagtcaagcttttttaaccactccatgtcagcttaaaatatttataaaatagaggaatttgtctctgaggtccaaaggtttgggaattaatatctggttgtaaaacatttctgaggcagaattttggaaacggatggcttacatccagaaaattaggagtgaattcagaagtactgaacagtcttgaaacaactcacatccagtgattccccaccaatgtcccaagttcttgactggctagaaaggatttttctgaatccagtagtttccagttgatactagtaggttggtaatgactaactagagtgttttattgaggactatgatgctgtatctgggctcagcgggagaatatcggtgtcaactagtgatgtctgtcatgaggaaggaacaacaagatgggaacatagcttttcttgccctattctgtattattgccatctatttgaagtgggttactttctggaacaatcaagggcagtgggagatgaacttaacatttccttttcctgtcccttatcaagtaagctgggtactgaacaaagtgggtttaacagacacagttcctattttttaggagctcaaatttaagatattagagtatccaatcaacaaatattaaaatacacacatatatattcacaagtaaatacttagatactgcttatgaagaagactaaattgtgctggtaatttgacaactggaatgtagtgagtgggtgctgctgaatgttctacagtgcacacaatgttcaacaaatcacctccctgcaacaaagaatgtcagtagggcagaggtttagaactcctgctctaattgcttcatcctggtaacatctctttgaagagtcagtgcagtgtgatatggtgaagagagactccaagtcaaccgacctaggtctacgattcaccctgctgtatgaccttgggtttccccaattgagcctcagtttccccatttataatgaataaaggtattggattacaagagacatttcaccactaatgttctgttattgtagttaacaataattaaccattaatgttgtgttattgtagttattgtacattctggggttgctggacagccttctttgaaaaccatatcttcaccaccatctgatccatccttgaaaagtcctacttgattcttccgtggtcacagctgactagaagggtaggataccaaacctaagctgggccattagattctttctcctgggaatgagaaattagaactggctgggtactttagcaaagatgggacaattacatacaataaaaagtcagaggaaacttgtctatagggacaaatggagcagatatacagaaacaagcagcactgacagaccaggaaccccagagaaacagtagggatgatctcggctcctgatgcagtctgaagttcctgatcccagttcctcagtagagccaactgctctctacccattcgttcaccgagtattttttttttttttgagacggagttttttttttttgctctgttgcccaggccagagtgcagtggcatgttcttggctcactgcaacctccacctcccgggttcaagtgattctcctgcctcagcctccctggtagctaggatcacaggcacacaccaccatgctaggctaatttttatatttttagtagagacagggtttcaccatgttgggcaggctggtctggaattcctgacctcaagtaatccacccgccttggcctcccaaagtgctgggattacaggcatgagtcaccatgcctggcctcattcactgagtactgaccaaatgacagcttcttgtattccaagcaatacattgggtgctaggtgtacattcataaacaaaacccacaaagtccctgatttcataggtttttccactggaggagagtgaaaataaacaaataaacatacaatataaggtcagagtgtgagaatggctaagcagaaccataaatctgagcaagagaatagagagtgatagatggccagggaaggcttctctgagcatgtgacatttgagcaaagacctgaatgaagtgagccaaaccacccaaacatgacagaaagcatctactgcaaagcttcttctgtggaattgtgcttggcatgtgcaattcagctagttcttactcccctcctaattctaagtcctgccatccttctgtgagatttcactgcatggctggtccctccattacactgtgttcccaattctcagatctctcctggttgaggatctttacctccactccacttttacaaatcaccaccctaagtcttgctggaccttctctgaaatcctaaactctaatacagcacttgggcctcaatctcctagacatcagctccctcattcctttctctcactatccctttttcttcctgaagatctctagttccttaagtcttcccttttctctcagtctatcaggctgatctattattgattctcatctctcccactcagattctttcaaacacagtagtgtagtgtagtgtagtgctgcaggtgtggcctttgaagccagactgcctgggttaaaattccagcctaccatcaactatgtgtgcctcaattttctgaggacataatcatagtaatctcttccattgctgttataagaattaaacaatttgatgcacacaccacgtttagaaagtgacaggccacagagcaagcatttgataaatattaccataataattatgatgttactatcataatttttcatctgctctcccagaagcattttgaacctccctgactagttcttctgttgaaccttctctggaaacctcaatctctggctcaatctaatccttcattttctctgctctttttacttggcagctgaggtctcctgaaaataaaaaacaacaacaacttactccactgtgtaggctgatgctgctctaaacttgaagcttccagacactgcttgaatatccttttacagcttctggttggtttcctcatgcattcctctgatttgctattctaaatcttcattcttttcaaccctcgaagctgctgatcttttcacccttgcttgacagttcttacatgaaccatctaaaagccagctaaaaatgtatttatattctcacatccttttcttttcttttttaaaattattttaatttttgtgggtacacagtaggcatgtatatttatgggttacatgggatactttgatacaagtatgcaatgcacaataaccacatcagggcaaatggggtgtccatcctctccagtacccacactttgggtttcaaacaatccaattatactcttctggctatttttaaatgtatgattaaattattttttacttcagtcaccctgttgtgctagcaaacaccaggtcttattcattctttccaaattttttttggacccattaaccatccccactccccactatcatcactactcttccaagcctctggtaaccatctttctactctctgtctccaggagttcaattgttttaatttttagctcccacagttaagtgagaacatgtgatgtttgtctttctgtgtctcacaaccttttctacaaattcataagaggtcttctaccttctgtcctggacttctctttctcattcctttgtggatctgattccattattatctcttctctccctcattcatgtcaggccccaaacatgctcaatctctccaatcttaacaaaacaaagccgcaaaacaaaataacacccctctgaactttgagtctctcactatctgttgtctcttcttctttctctacagctaaatttcttgacctcaccaaatgtcccctggggcaaaattgaccccagttgagaactactgaataaaggatataatacaatataaaatagagcaacaagcacataagtaaatgcagaagttctcaaaagaggagcccacaatggtgtccagtctctttcatccattcagtgcatttttccggccaaactctcttccaaaatccagttcctaaagcagacagcaagcagagcatctctgtatttgtcactctccactcattcctcagctcactgcaatctgacttccgcccctacttttcagatcaattcatactatggcaatgtctttcttcttaatggccaaatccaagggacatttcctaccttatgttacttgaattctccatagtatatttaagctatcaatagtgacttttgtcttgaaattctttctttggcttccaaaatgccaccttcttttggttctccttccgtttctcaaggtacaccttcatcgcctttgctcacacttttttccctttaagtctcagtattcctcaggcagagtcccctccttggtccctttcttactgccactctttccttaggggtctccttttttcctgtgactttaaccatcactgccatgttggttattcctcggtcttgctatccagcccagaccctgaatcctaggctccagggtaatgcctgcactactctctcctgggcccttctttctgcattccagtggcaacacaaatttggcaagtctattcttaccattcagcagctctttctctcctatttagctttgagctctttgaggatatggatcctttctattttctctttcaatgatctgaaaatagtacagtgcttagcacctagtaacaggtgctcaataactgtcatttgaattaaggaagagacatgcttatcttttttctctagtattagcagtggatttgccaactcatctctaaaatagaattatttttcctatctccaaatttcccctcttccagtcttctcagctaaagacatcactgtctacctgactgctcaccctcacacctcaggagccattcatgctcttccttctccctcatcttccatatccaacccataaacaagtgctattagctctgcttcgagccatgtcctaaattccactatctgtctccaattccagcactaccactgtgtcaagccactatcatgccttacgtgtccaactgccacaatctcctaactggtttttctgcttctgctattttcccctcccatgtcagaaggctctttctaaaacattcctcagattagctcctctgcataaaatgctccatggcttcattacacttggaatgtgatctaaattccttaccagacactgcattagtcggtctctctaacccctctaactccatcaccaaatccaaaccaaatccaaacccaactcccttatattgttccaggaacagccctttttgttgtttctccagcaagctaattgttctggcttagggtctttacattgcctactccctttccctagcacgcctcttccgagagccttacaaggcttacccgtctcagctttcatatccctgcccaaatgtcactccttagagcatcagcctacaaaactagctcccctaaagtcattctctaaccctctatgctgctgtattttcctcagagcacttattctctaaatttatatttgttaattttaatgaattaatttttttgagacagggtctcactctgtcacccaggctggggttcagtggtacaatcactgctcactgcagccttgacttccagggctcaagtgatcctttcagcttagcctcttgagtagctgggactacaggcatgcaccaccatgccaggctaatttaaaaaaaattttttttttaagagatgaggtctccctgtttcccaggctggttttgaacttctgggctcaagtgatcctcccgccttggcctccaaagtgctggggttataggtgtaagccaccacactgggcaatatttgttaatttttaaattaactttctatatgctgctacaatacaagcttcatacaatataagctttttaaaaaatataagctttttttactttcttgtctactattacatctacattgtgtaggggcataactggcccatggtaaatagtaaatatttgttggaataatgtgatccctgagtccacaagcatatctttactaattggtaagggttattgggtctgtgaggtagtctttcattgtgtgaagacaattttcttaaatgggaactagcaccaatctctaaaatccacacacctgttagctactgatcaggactctgcctgtaaccaaactttagtttggctccctggagccctcttcttgattatgccttgtttttgggctgggagcccaattttagcaagaatcctgctgagtcagtttagggagaatcccctttgccccccacctttgatatttaatcgagttccttttagtaattttccattcaatgactccctcctcttcactttgtcctctggctataaattcccaactgctctggctatatttggagttgtgttcaatctccctcccctaccgcaatattttttttttcttttctctttcttttttttttttgaggtggagttttgctcttgttgcccagattgcccaggctggagtgcagtggtgtgatctcagctcactgcaacctccgcctcccgggttcaggcgattctctggcctcaacctcccaagtagctgggactataggtgcccgccaccatgcctggctaattttttgtatttttagtagagacaggatttcatcaagttggccaggctagtctcgaactcctgatctcaggtgatccacctacctcagcctcccaaaatgctgggattaaaggcatgaggtaccatgcctggcctactgcaatattcttgaccccctactgcagtagtttccaacaaaagtcttccttgtcatttttaacaagtatctgctgtcatttctctttaatattaaaaactaaatatttgccaactgggcttgtttaaatacacttagggaattttcattgctctcaaaagaagtttcatgtgttctttgcagtgtgaagggtcaaagagaggctttacttgtctctgtgactgaagaatatggtttctctagtatacagaagaaagaaagaatgaaggccacatgatttatttttatcgcctctatagttgtggctattatacaatttgtcacatttattttcagttgttcttgtggtgacattttaaggaataatccaaaacaatgttcaattcaaaacgacaccccaaacctcctaaacaaaagcaggttcagcatataaaatagtttcctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtccgcagtccagcctgggcgacagagcgagactccgtctcaaaaaaaaaaaaaaaaaaaaaatagtttcctctctgccacataaccaatataactcacatgcagtccactcctgagatgatatgattatacctgcaacatcaaactcgatttccagtgtgaccttgctcgtgattgaagagtctcggaggagctgactggcttcttcgaaggtgctgtcttctgttggaattccattgatggccatcactctgtctccaatctgtagcaccccacatctaatttagaaccacatgtgagaggttgtagatggagtaaataattaccaagctgagcttgccaaatctaccttgcttgatccttgcaaaatagcatcataatttggtcttgcttattcaatgctgtgggcatcatataggtcaaattcaacgtcgtgtgttgttgcagttcatggttataattgtgagcaggggaatcctgaagtatcccagagaagtaattaataattcataaccatggtattgttagaatctgatccaaaccaatatttagtaatgatgaatgtatattcccccatggcagaaactattgaagttgaacttcaggatatgtttattttatggatttttctcctttttaattaatatagcttctagtcccttgatggacaaaatctgctagttaaaggcatccatgctcattactcttttcaaacctgatcaagaacataaaattttattgtcagaagacagttcatcatatcttgcatttcctgcattgagcaatgtttcataatttactagccattcaaagatagcaggtaccagaaacgcagagcagaaaatgatgctgtgaaagaaagtgtctcacctctctgctgggctgtcagcttcgatataggaaatcagaggtggagaagagagagtttctgtggcaaacacactgccctgcagttggatcccaaatcctgtgacaggatctgccgtcagcacaacctctgtggtttctgtgtgaacaacctgcccagccaatcctactgtgctggaggctaaggacactagaggaacaaacagaaaatactgactttaggttggagcaagcaccaggaataccagcatttccaaaatagatcatgtctctgcataaaaactgaatggcaatggtgggaggttaaattatggcctctggtttagcaagagttgaaaaagataaatgaatctctcaatattcatcacaattctataataacatcagtgtatccctgcaccctggctccctactcctcaaaccagggatcattgtgggggctttaagaggatggccttagggtcaggttacatgggttttagtcctggctctatcactgagcaccagctggggaaccttggggtaggccattttgtctctttgtgtgtctatatcctatctaagaaaaagggagttgagctagctggtttcatgttttttccactttagccatttgcatctgggctttgtgacttttaaacaatcctatcttcagctttgaagaaataattaaactaaatctggcccctggcgtggtgaggctgtgctggtcctcaaccttaatctagtgttgggttggcatgatgacattgtttaaactctgtacattcctcctgccgccccccaccaccaccccagagtttggtctcttcagtccttgctctttcccactgggtttctagtctaagttgttgtatttcatttatttcctattatttctcctctttcatttatctctctgatattcatctacaccttccagcagacatctccatcttatttccattctgaactcatgaaagggctgctccactcctccatgtctttctctcagccctgcccattggagtgtggccacccgtgctctctgtgagcacagcctctgcctgcaggtcctatgctgcactgagtcttcctccagaaagagtctggccccctttaactaaaacctgataacaccatatacctcataaccctcttcaaaagccattttcttttactccctctacaggtggcaggaagacaggttcataatactccttgctctccacatacggtacattgattcaactactcctatttaaaattccatattctgtacttatttctgctctgtctcattttcaagcccataatctactttttcaaaattctcccccttttcttcatgacttcaggacttgcctcttagtctgcctcctctaacctatagcttttccttgtcctctgcctctttgccattatgatgataaccttctagcaagctggctttatgcttcttcaactctcttcatgtcagttcctagcaataccaccctacttccactctctgccagcagagccctatggtggtctccatcttccttcaaaatgaatagatcttcaagatctcaatatctgaatcccccttgttgatcacataccctttattagccatctctcccacttcctgcaatctgtctcctctttatgactttcagtcccattccctctcacttgtctcctgagtctattgattttagcaacagatttttcccccttaaaatgaaaacatataagggatgcctttgtattccagataaaaacagctactgtagttgatgtgggaatgggagacccctgaggttttccctggcctcatgtggggatctggtaagtgcaggtggaaagccattgtcttcgcccactggctttgctggcatcattttccccacactctgcctggacccctggtgagcattttaataatgcatctcctaggctcaaagattcctaaacctcatgggattttcctataccctaatactttatcctctatggtaatgcccggtcaactccactgttgttactaagttgctgaagggtgctaggaaaagtcactatgaattcacaatcctattaggtccttaaattatttgttgtgtgatattttgacaccttatttcattccacaaaggatttgtctcaaatgtttctaccctaaatcatggtcaaatgttactcctcatttcctataagactgaaaagatgcaaccctttgacgagagttccttaaacaacattctgtttagcctcaatttctctttatcattatttgttccctcttccttttttcccccactacaggaggttgtatccttccttccatttcaaggctaattcccccttttagtgtttttaatactatccctttccaccccccatgattttgtgccatgaaaaaatttgcctcttgctgcttttccaaacttttctgctcactcccccagctttctgacttctgtctatagacgtgtactgattctgaagtggctaaaaacttggcttctgccttcaccatttactgaaactgctctcaccaatgacttcctgacttctaaaatcagtggcctcatctgctctagctggcgactggctttaggaccatcccttgctttctaaaattgtttgcttggttttgatgaaggtttgtttcgagtgtcttactttttcagccccagccagttgctttgcctccctctgcatttcagcgcacagttccatcctccaagtcttttctactctcattctttccctcattcatgcctacatgtcttctgcatgtatcttctcaactctttctcttgtttttgtcaagctccagtaatggatctccctccttgatgggtatgccatccacacactctctcattggctcctcaaactcaatgttttcaaaattgagcgaatcctcttccctctctcattgccactactatttctgtgaacaggaccatcatttttattgccctctgggcttaaaatctcaaagtagccttaactcacaactccccattgtctcaaattctatccattgctaaatcctttctggatgactagtgaaatatatcttacaaaaatcctcttttcccttattaatttcagtacctcaatttgggctttcattattttttatttgaattattctaatgtacttatttctgggtccttacatgcaaaatattccccacatattatttccagatgaacctcctgtcaaactttccggatatgatgaggccccaacttatttactctgcatgtatcttctcaactctttctctttagtttctgtcaaactccagtgatggatttccctactcaatggatatcccatccacaaactgtctcattggctcctcaaactcaatgttttcaaaactgagtgaattttcttccctttcttattgccactactacagagcaaggcctcatcatcaccagtgtacaatactggatagacttctaactagtgaccctgcctcttgttttatgctaacagcctccaattgctgctagggtagcctttctaacatgcaagggtaacccctgccctgttttgaattttcaatagcttcctgtttcctatagaacaaacttttcaattctagcagagcacataggacccttcatcagttcctttctcctgcccatccactctcctgtttctctgtgatcccttcatgtgccatgtgccccaaccctcttgacacacttttgtgtcttcatatatactgtgccctctgccactcagctcttgctctgggtccttttctctgttttatccaggcagaattaggtacttgcttttctgcatttccacatttctaatacatggtcccgtttcagcatttatcaggtctctatatgcctgtttctctccacctgaccctgagtttttgaaaggttggaaccagctctttcaatctctgaaatcttagtgcctggaagattcaacaaatgctgaataaatgaggaatgaatcaaattttgggatgtcatctacatattccttttaggaaacaacacttctcatagatgctgctgagttaccataaggaactacaagtcattcttcagggcccaggtaattgcagctgatggggcaagggagggtgaagtagatcatttgtctaggaggagtaagaaaaaaaatcgacttttccttaagaagcaccattctcattccatctcagctggattaaggttaacatagcctgcagtggggggtgaagatagcctccaaccctacgcttcttacaggtggaagcttgcaattgccaggtctgacacatagactgtcatgtattaatttagatcacatgttctagtgtggtttcgctgatgtagagtgtaccgtgattactctccagataataatttttgctatcagtggcaccaaaccactgggagacaccatttcctgtcaataaggatctggagagtatgttgcattccagttattactcacagaagatgagagtatcatgttacagcatcacctatttggcaggtaacttccacttatcttctaggtgaagctttttggacttaatcagtaatcctttactttctttgactcttttataggttcatattaatttttttttccatttgagatcacaatttgatacagattatcggactacttaattggagttaaaagctgtttcagaaactttaaggcagctgtttaccatcttcactaagaaagagccaagagccgggcgcggtggctcacgcctgtaatcccagcactttgggaggccgagtcgggcggatcacgaggtcaggaaattgagaccatcctgactaacagcgtgaaaccccatctctactaaaaatacaaaaacaaaattagccgggcgtggtggcaggcgcctgtagtcccagctactcgggaggctgaggcagcagaatggcgtgaacccgggaggcggagcttgcagtgagcggagatctcgccactgcactccagcctgggtgacagagtgagactccatctcaaaaaaaaaaaaaaaaaaaaaaaaaaaaaagaaagagccaagaaaaaagaagtcagtttaatagtaacaggtgagattatactagatatagtgaagccttctcaaaggaaagacttgctatgtttttttaaacagagaagatagttgaataattttattctctagaaggttttgaaaataagtactaatttaatgtgaatattattaaatttataagctctatttggaggcaagttgagatgataaaaattattagaaaattgaatttaggatttaaaataaatttatgtattatgtattggttttataattagttataatttatattatacatatagcattgtagtaaataatttatgattttataattaactctgaaagtcttctgacatattggaatcttttatttgacaaagagcaaaatttcatttgaaattatatgtattgattagttacacatataaaagttttgaaaactattaccagatatgaaaaagatatattgtgatttaaagataaggaatcaaaagaaaaaaacaatcaatattaacttggaggagaaaaaaatgagcttgattatcctgcttcattaatgtggtcaaccagcaaagtaaatgaaggtgaatattcccccgtcatttgaaaatgtggatggtgaattgtctctctagtagcagatgcttccgcaaggtattcagtcgtcattgctgcaagctaccggctttggctgaggcttgcctactcctcaaggtgaagatggaaatgactaaattgctgacatcctaactggtgtatgccgaggttgtgttcaggattcgttcctgctctgtcctgttcccattctcacatggagggttctgttcacaactcttcagatttgtagggaatgactacatttttgtcaattcttgttcttcctagtgtaagaaagggcagggggagccaaaaacacctccaaaagtttaaaaatttaccaaatgcttatttaatttagaaggctgaaagatttcctatcagctatgagaagcatttaaaaaatatagagaactaaggaccccaaagatttattattataatctgttttttttttttttttttttttttttttttttttttttcagataggctctcactctgttgcccaggctggagcatagtggcagaatcttggctcactgcaacctccatcttctgggctcaagcgatccttccacctcagccccccaggtagctgggactataggtgtgtgccaccacacctggttgattttttcttttctcttttttgtagagacagggtttcaccatgttgcccaaactggtctcaaactcctgggctcaagtgatccacccgcctcagcctcccaaggaataatgtgtttttattattgatcctgtaatctaagacttctgtctcactaaagtgtcccacactatagtcaacctgccatagacctaacacatgtgtatcatgtgatctggttcaggaacgcagtagaggtggccaacagctcctttgtccaaatgagggtgtgaggacagttcttagggtgtcttcttcagggctccctgaatggtcacttataaaagcttaccagtagctgcctttatcttccattctttgttcccaggtcaatagaagggaccagaaaagttgttaggttttttcattttctttccttcagctcttttcaatggcactctctctaatagtagttactactgatgacaaaagcagcaaagaccattctggaaatgtgttctaacttctactctttgccgcaattcaggcagactgggaagagacggagtctctacactggcccagggtacagtggtggggaacagaaagcagggcaaactagctagatctgttgctcagccatgctgttgttacagggagatgatgaggttctggaaggagacttggcctctttggcagaaaaagaggcagcacaggcagccagggaaagggcagtaagattccagcagaggagatgagagggctccctctatgacatggcttggcaatgcctccagggctttgtgacacttgtcaaagcctaatgtgtgctgtattaattattttctctatgaaacaaacatgacaccttcctgttttaatacttgtaacacatcactatatacagacttcttgtatttcctctttgatcagtgatacagaatgttttaattttcatgtgagaagatttcattttttttctgggcatctccttccttggcattggaaatacatatgagcattttctgttttgcaaactctggcctcaagtcatcaccaatacagcaaagagactttttgccatgattcaccatctacacaaatggcctggttgctatagaaacatatgtattacaaagggggcagcaaatggtggcacaggataaagacataaataaagcagtggaaataaaccatggtatactaagagtggcaataaaacttttattatcagttatttgggaagacctttacatctaatgtgaccataccaaacctatgcaataaaagaaaagaaaaaaatcctcacttaaaaaaaacaaaaaaacctttgcaatgctatcattttttcaggtctttttgaagtgtgaataaaagttcatagcattttggaatttatggtttgaataaaatacaaaatgtgtgatctcctgagacacatttataaacattctggtatgtttattgtgagtggtgctctagtggccaatgtctacagcaaacacaaacaactagaaatgtattgaaataggtatttctaccatgttgaagaataatgtcctgattcaagagagaatttatgcgttggttatgcatatcagtgacagcgctgcctcagctttgtttcctactacaaaatttaagatatgaaaatatcaacctgagatagccaaacatcatttgtttgtattcactaatgtccctaatcaacacagcaagtcttacctaacacaaacaaatactagcctttgaagcagaagtatgaacactaatgaattcattttaattgctcttccctgctgagtgctgttagcctgtttttgtcactgaggagtactacacacaaagccattatctgttaaaaaaattcatacacaaatacccaccacaaaccctgaaggcattacatagaagactaaagatctacgtattatgccaaaatgtacccctcgttaaaaagattgaactttgagagcactgtcaagagattttctcatgtgacaattcatatttaggccgatgacagttaacacaaactattcaaaatagctaacaattaaattgtgcttactatttaccaggtgttgttctaaacacatatacacatgcaatctcatgtaatctcaattacccaatgaagtaattcttcctattttcagtcaaggcatacctcatgcagtcttcacaattacccaatgaagtgattttccctattttcagttgaggcatagagagtttacagaagttgctcagggtcctacagctagaaggtaatgatgctgggatggaacccaggtagcctggttccagagtctaggcttataaccagttcactgtattgcattcaactagtttcttccaagagtaaataatttactctagtgtcagctaaaaaacacatgggactccaggagtactttgttctcattttgactaaactcaatcttccactttcctaatttcatttttactatcattttcatataccaaagatgacaaatctccttatatgtaaaagtatgtgcaagtctaaatcatgtacaaaccacagtggtgaccctgtcttatgcaatggagttcactgtagggaaagcttcagtttcctgtatcatgaagaaactagctcccagtgtgggtgatagctggtcttgggcacttagggtggccctggtgagactggagagagatcctcctggggagatgaatctcttgcaaacaagctgaaaagccagtaagtccataacagctgtgaagtatctggctttggttttatttaagtaacttaaggatgttccttatttttattcccatggtgagcacaggaagagatcccatcttctttaaatttctctgtttaaatcataatcatggccatcaaaagggatacatgacaagaaacagactctctagactatgattaggtctagttagaaaggtcagtgttctcttcttccacaagttatatgatcatgataagagagaatgatcttccccaatagaaacgataaatgtaggagtgatttatatttctttctttttaaggcattcaatcaccttttttacccctctattcagacaaccagctatcccaaagcaagtagccaactatatcttcctagttttgcttagtctatatcgtgtttggctgtccagatcatttttacaagaatcatggttgaaattcctagactttaggatgcttattgtaaagctgagcatccttccaatcttccttaggctggagtggacagtaagaagtgtatgttagatcactgattaccagtggggtaggcttctggaaaaagtattggagtcttggggaatgagatatagtttaaaagggaatgttcatatttatcattgttttggggaggagggtaacaaaatataatttagtataaaatttatgacaacattaaatgaatgcatgagaatcttatatttatcaaaaggggagcatcgttttcacaaaatttctttagaatgagtaagaaactaagaacaaaggtttcatgtccaaagccacccagaatataataaaaggagtcttaaaggaaaaatcatatctttgggtatgttatgacatcaaaagagcaagaaaaatctcaaatctcaaataaaaagttgtaggcaaaggtagtatgaatgaattcagtctgaagttaaattggggtgcagtcattgccaaacagatactgggtatcgtgtcaacggtctttggcacagagctgttagctgctcagcatctacctgatcacttaagcaactgtgaaacactcttcccacaatttcggtattttcaaggctccattgcccacaggttttttccaggccaaatgccattggctgtcatttcacttacatgagcttttgaagtctttctttttcagtctcctcctcatcatggttccacgtgggctggtggagtagaggcttcgaggtagagtccccatgttcagggaactcaggctgtatgcactcatggaggtaggagagaaggatgaagacaccaaagctgctgcaagagagtgaagacgttgcacagagcactctcaggtgaggtgtgagcccgccacacttgtcaaccagtaacaatccagaaagacacacatgatgcatagcaatggctaggaaggaccccagccagctagaggccagctctcaggagcatgagacaatgctttacaagagcctacaaatgctgaggggcagcaggatctttataagctcataggaacacaaagagactctgtgagaattgctttaaacaaacaaaagaacaactttgtccatgaacaactcaatgcatcagatacataatctcattttcatattttctgacatgaatttcataagtgattccacatatacaaagaagacctgagaacattgtctctgtataatattctgaattgttacttcctgagccacatataaagcattctgaacatttacatcctttcctaacaacaaatgctttctgatggaaaagaaaaaaacctaggagatgtcagaaatgataaattgctactataagaaacagaaaaaacaacatccatgaagccaaagatgagaaaaggagagtgtgagaaaaatataattgaaataaaagaccaggaggagaaagcatggaacattacgagggctgtttggaggaggtgctttcgggaatgtcagggctggtactctgcaatggtcagggtggtacgtgttatagtgatggttggtgtgaaggctgctgtggttgctggcccaggaatcccaggtaagttgcctgtcgctcctctgaattttcactgcccatatgaagtgatgatgaaaaataagaaaaacaaacgaacaaacaaagaaccaaaaaagaggaaaaataactgaattgcccaaattaaaagtataacaaaaaagaaagctgcttgcaaataaaaacaaatctacttggctttgcccttttctcagtggtcagcaaaatagatgattaacataaaggatgtaaacttttcatcttcccaagaataatgcatatctttcctcagctcgttttttcttcttttaagatgactattgaatcaatttctaatctccctcagtgctttgcagctgagattaagaacattttttttaacttaaaagtcagcccctcaaagatctatggcacacaattagtaattaaagatttgcaaatcttggccagttagtagcacttgttttgagaaaaagaaaagaaagagcaataaatcacgttggtgcatgattcaagtggtttactagtcacacatcagaatttactgctctgacattttaattgcactacaatccatcacttggacttgattttcctcaacaataaaccactctaatcatctatcagtatcagaatcttatctgtatctcgactaataaggagaagataaaagtctctatattttatgattttttgaaaaagcatatttacattagaaataattattaaaatatttcacgtttttatatttccttgatgccataaaattttaataaagtttatttcaaactttattaaaatttcaaattgccgtcccttttatgttttagaaaatctttatcatgtttccattctagcttcaatattaagatttgatattccacccagtgttctgaaatatgagcaatataatgtttgttattatgtctgatatgaagtttttcatttaataatcttaaagaactcaaaataacatatgaacttattttatttttctagagatggggtcttgctgtgtcacccaggctggagtgcagtggtgtgatcatagctcactgtaatcttgaattcctgggttcaggcaatcctcccgcctcagcctcctgagtagctggcactacaggcccacgccaccacacccagctaattttttattattttatttgtgtagaaatgagggtctgcctatgttgcccaagctggtctcaagtgatccttctacctcagccctgagttgttgggattaaggcatgagccaccatgcctgacttaacatatgaatttatatctccttctactttcatgattttggtgttaggtgtcttacaagtgaatatgtagagaggtgaaatactctatgcattgaaaggacagtcgtttagataagaacttaagttacatcaactgtgatgccagctgaattggtcaattcgcatcctttctagaatgaaacaggacatgaaaaaaaaagcactagcacggacagatcactgcggggtgaagcagacctgggtttcagctctgcctccagcccttcctctttgtatgaccttggccagctactcagccactctaaacctgaatttcctcatacgtcaaatggagatcatgaaatcatctacctcacagggatattgagaattaggcaaatacggtgcttagcatggtgctggcacacagaataaaaacaaatgagtttagagtatattgatttgtctacttttccatttacgtgccaacaataaagtatcttttaaaggaaataaatttatttttcactcaacaaatttcactcgttggacatttaagtttagagaatttctcagaaatctgcagcagaaactttcatagccactataattttgttaccctaaaccatctggtctgctccttctactcaactgccctgtttgtggtttggattccccctctctctccactttcctacttcaagctgccacctccttcatctaggccactgtaacaccttcagacatggcttcccaactcatctcctgcatacctaccttccacaacatagctagggtggccttctaaatatataagttagatcatgccactcctgtttgaataggttactttttttttcttttgagacagagtttcactcttgtcactcaggatggagtgcaatggtgcaatctcagctcactgcaaactctgcctctcaggttcaagtgattctctcacctcaccctacccagtagctgggattataggtgcccaccaccacgcccagctaatttttgtatttttggtagagatggggttttgccatgttagccaggctggtctcaaactcccgacctcaggtgatccgcctgcctcggcctcccaaagtgctgggattacaggcatgagccactgcgccgggcctgaatagctaactattacaaagagaatcaaaggcagcccctgcctatctctctagtttcatccatatcactctacccatcatttgtatattttagccacactgatcttatgtctactcttagaacaagtcaggttccttcctgcctcaaggcctttgcacttgctgttctttccccagttgtttgtatgactgcctccttctcatcattcaggtctcacccgaggtgccacctcctcagagaagttgttgctgatctccctggctgaaggagctgccctccccatgctatctcattactgttttacattcttcatggtacttattgctgtctgaaacagctttatttatttaatatatttttaatgtttgtctgtctgtactagaatgtgaattctataagagtagggatatactttgcctgtcttgctcactaaatatatcctagcaactagaacagtgcctggtatataatgactaatacatgaatgaatgaataaacaaatgcatgaatgaacgggaatatcagccagagtgtccatgtgaacactgcagcagcattttccttgagacaaaagagtatttattgcaggagatgtccctaatggattctctctcaccatcctcattctactttgggtgtacaagaagacatttcagcaagacgcagttattactgtgtttggccaatttacaaccaccgacactttagcgtacttttcacaaagtaccatctgtgtttcaaatgaagccagggtacggtgaatgcacttcgggattctacacccaccttttgacccgcttcttcattgagagctttgaaaattactgggcatttgttaggactgtacagcacaattaataagtcaataaggaagatattatttaccagctattgctttctcagactgtgccaattgctacaggcaggttaaaggtcataccatttaccttgactttgaattactactggggattaaatcttcatacatataaaataattaagagacaaaaatgatataagataatgcacaaaactgtatgccatggatgatgaatgcaaaaggtgttgaacaaataatgtaggccagagaagagagctgctgcctattttgaatgtacactccaaatgttttctgttttacagtggtgtacttgataggcaagtatttccaaagtttaataataagatgttacatttttggcatgtcctgtcattttgcaaagagcacttatagacattctctcatttaataaagccaataattgtagcctactttcactgattacttattatatactaggcactgtgctaggtgctttttcatggattagctcagacaatgttcacaatattcctttgaggcaagtattattatgacccccattttacagatgaagcaactgaggtatagaaaagttgggtaacttgcttaagaccccacgtggtggagtcagaggtgaagctctggacacgtgatcctaaagtccccgcttcaaccaccagacataccgcctcttcctatgggtatgtctaagtcccttgttatggataagaaaacaacacatttaaaatattatggttcttgtatcattccatggtgacgtcactactgcagtctcaagagatatatggccacagaagttacttttctttcttctttctctaattgcagcctcttactctgttcaggatgttcgagagagcagaccacagtggttccaggttgccctggagctctcaaatggaaggtcctcctggtactgaatgtgtcgagtctagtgactctggtcacattttcctttccaaaacgtcagtttccttcaatccaattatgtctcctgaaaaccctcagtgggaaaaatttctaacctcactgaaaactcatttctgtcagcttctttaatgctgctatttatcagtgaaaggcatagctaatctcttatcccaagttgagatattcatttccacactggcctgaaaactctgtggtatatgctttactgctaacacaatctggaaatttgggaagtgtgttgagagacacactgttcaggcatcagagatcttgaaaaaacaatcagaactttcttgtggagaaagggtaaaactatgtaaaactccactagtcaaaaatttgagaattgtaaacacaataataattttttgtttgtttttcttctttactatgatttaattatgtttaggagccaaaatttatttcctcttggaaatccaagtctgattttaatgtgcaatataacggaaacacctgcttgataagaaagacagtgaacaactttcagtaaacgtagacgatggagtcagaagtggaagctagaattacttaaacttcctatcagtttcctatccctgcaacacaaacgacatcaggttttccacaataaaggcaaaaaatttgtgcttagtccatatattttagtgtataaattaaactcaaattgccttggcaggttaaaaaatttaatattccatgagttgaaaacacttgaattatttatgaattgtatatagggccaattaaagaaaaataaaagagattactaaagatgctaacattttaaaagggtctggtatgcatttccgattcgctgataccagaatttagcaagcaaaaccccatgctgagagagcactacacagtgtacattcttatggctactgtgctccaaatccaatgatgactgccgattaatttaaagaaacttaaacagcttcagaaatctctcctctctgccagagtgcaggaagggcccacggggcctcctgataggaatggtgtgcatccttgtgaacggcaccttcctacagctgtttgcattgctattccaatactgtgatgctgattttcttttcataacctgcctatgctgcatcatttctctactccaatgtgtaaaattaaaatctgataagggtaatgttgtactagagattttcattagcttcagggctgtctaagctccatttaattaaaaaggttgcatccagctgactgatttagtatgaaaattatctggtccctctttccccccgccccagactgtggagaagtgtagtgcattttaaaaggtgggagacacaatacaaatgaccccctcataagcaaaatttcaatttcagagaaaactgcactgtgtctaaatatacagaaatgcattatcctccttcaggccaccctgacaatactagtgaggcctctaatttcaaggagtacaaaggaatggtgtttgctttaaggaatagggcaggagagggagtcggaacaaatatcctactggaaaacttgacttcatttgatttggggctcaaagacccctttctcataccaggttttgcctaaaggtgcctaggtagatggtataaacacccagcaaatgtatctgtgaatttcaagggagtcaaaatacagataccttcagctgacactttctattgaataaatggagttaaatattctgattctcccagacaagatgtttgctcagacaggttgttctctatcctaagaaaaaaactccactggcaaaagacataatatattgtaaaccaaggcttcatataactggttccctctgattcctgccaaatatttgaaggttctgctattaaaatccactttacttatttatttttaagtgagagctttactatttgccttcattggccttcatctaggctggaaattcaaaatgtataccaggaagtcaaattattttccttgtctgcacattcaatttgcaccaaagacttttttaagaaaaaaatatcaaatagcactagcctgaaaattttttcctcgatgttagggtttcaagcaaattatgtgtggcttagaaaaaagactttggaagatgaattagagtaaacaaacataaccttgttttgaaaagaaatgatgagtctgaccaacatggtgaaaccctgtctctattaaaaatacaaaaattagctgggcatggtggcggtcacctgtaatcccagctactcgggaggctgaggtaggagaatggcttgaacccaggaggcagaggttggagtcaaccgagatcatgctactgcattccagtctgggggacagagtgagactccatctcaaaaaaaaaaaaaaaaaaaaaaggcagaatgagacccagtgtctttctgctgtctaactctgctagagggagcaacactgtgagggccagagaaagagcttgatccaggtggaccatctcaccatggtcgggcccctttagggccagccgggtctgatgatggggaaggatctcaagcttgacctggtcagtggtgttggccaggaactgggttgcttctgcaagtgtacagtactccatgctggttccatcgatggagaggatgtgatctcccacatgcaatgcgccacatctacggaaaggagaaatactcggtaagaggcagtgccttcctctttggaatctgactttcatgtccttcatagttaaaatttcacagtttttcatttacttaaaataaaagaaaagaaaagtttgagtgttataggaaacaccatctgccaaattttaagtaccttgaatatgaacaaggaagtaaaaccttgtggaaaatagagaaaaattcaacgaaatgttttctcttgtctttctttaaaaaaaaaatcttattttggagtgcttgtgtggaaagttgagggaaagcgagcaagaggaaagggaaaaacaggaaaatgtttcccctggacttttgtctgtgtttttttgttctaggcttttctatctataaacatgagtgggtaaatcttcagaatctcaaacatgactctcagaattggaatagggtctattttatgtgtaaagaagaataacttggggagatttcagtaatacttccttggaatcctcacacaaactccaagatcaccagttctttattattatgttattctggagttgaacatgtattagtataaaagctcttgataatggtagaaattatgcaggagtcaagtgagtaataaaaccaggcctgcatggtgagtcaaggggaaagatgggggcagggaaggggctagctgctacatcttgctgaactcaagagctggctactggatgagttaagaaaagctagcgcagtcgtcagcatccccacataccagtcaagtgaacagctccttaaactggttaccccctgtggaatgggaaaaaacagagggagaaaattaaagcatcctgtgccattgaactgcacaacacccctggatcaatggctgtcactgataaggactgaatgttgggtaagaccacaatggagatgtagactgaccactacggggggttgctgcagttcactgcaccatggctggaggtggaaaggcaggttgaggggcacgtggagaagagggctggaaacatacaggggagactggtcattcaggtgcagtatatctataaattcccagtgtgaatagtctacgtctcaagacaaaagcatttcaagtcatatcttccaactaaaaacataattccacattttttgcacttggagtgctttagctatgggagatgaggtttttcttaccaggagctgtaaaataattaattagatggaaaggtagtctttttttatcttccccttttaccttacgagtataaaatattaattagaaacatgaaatttcatttttattgtggcattgaagcgaatgatgttttaagacaccctcgaaggttgtaaaatcctaagattaacatgctatgagagtataggactttttaaaagtattgtaaaaaatattttaaaaagtattgttttatttatttaagaaacaaagaaatcagattttatggtagcaggatttaattgtcaacaattcaggaaaacccatcactgctctgcatggggtttaagaaagatctactcagctaccctacattaagaacaggctagtgccctaggacacagtaagaaaacttgcttagttgcttgatttttttttctattgctaaaggccacaccaaacatctggatgacgtgaagtgacatcatggggtggctgacacataggtgaatttttaagccctgtaacagtaacttgcttctgtgtgtgaaacctgtataaactggcaagagaactgtgtgtgtgtgtgtgtgtatgtgtatatgcatgtgtatatgtgtattacaagtgtgtgtacatatgtatgtatatatatttaaaattgcacacatgcaattttgtaaaggggcactttctttctttctttctttctttttttttttttgagatggagtttcactcttgttgcccaggctggagtgcaatggttcagctcactgcaacctctgcctcgcgagtttaagtgattctcatgcctcagcctcccgagtagctgggattacaggcacctgccaccatgactggctaatttcttgtatttttagtagagatggggtttcaccatgttggccaagctggtctcgaactcctgacctcaggtgattcacccgcctcggcctcccaaagtgttgggattacaggcgtgagccactgcgcctggcggaaaagtaggcactttctacaatacttacctgtctgcaatacttgcagatttgattttgtctatgacaatgacttgtttgttacagcacatcgaggtagttagggcaaccccaaggctggcaccaggagttttggcaacttcgactagtagtggcccggatgctgttgccacagagtctgtcaaagaacaaattttagaaaacaaaacaaataaaacaaataagcaaagagacaaaagaaagagatgaagaatattcagtttggtgttagcctgttaattttatcactgaaacttagatttccctccatataatatccccacagccaataataaattcatagggcacctcttaacacacctgttccattcagcttgtattgtgttaatgtatgtgtaatgttcatctcttcaatgagattttaagcttcatgtcacttgggataatatcttatgtatctttatcccctccacagtgcttggcacaatgccgagcatatactaggtctctcagtaaaggttttttaaattaattacttaattcaataaatatcttagcacctaccaggaataaatagacggatggatgaatgaatggatgaaaggatggatataaaaaagaaaggaaggaaagaagaaagaaaggaagggaggaagggaggaagaaagaaaagaaggatggatgggtggataaataaaagaatgacaagagggatgggaggatgaatggatgggtagatagataatcagaagaatggatggatggatgatgtctctagccaagtagtaggaatgttacactaagttgaatttgtaaagcttaacttcatatatgctttatttttggcttggaacactctttgttccttcaactccttctaacatttgcatactcaatgccaacatcaattcctcgggaagcctaaattgtaatttggtaagatgcttttcacatgtgcttctacagcctgctctattcctgctgttgtagcatacatctcactggttcatagtggccagtacggacgacatgcctgtgttccttgccagattgtaaacatgcttgaaggtagagactatgtcttgtcaatcacagcattctcagtgcctagaataatgattagcacatcagaggtatgccactaatagttgtggaatgaatgcatgaacaaatgagaaagctcatgatgttgcttaaagctcattagagccacagacacaagggaaagagtctgggacacagaattaaaacatctggattcaattctcattttcacaatatttgtgtcatggtatctaagacaagactagttactaaaactttcctttttttgtattttgataaaattgacaattaacaatactaaaactttctaagcctgcttgcttacctatacaatggtatcttttccacagtgtttattaaaaccaaaccaatgaacaaagcactttgttatacatataggatattttcattattgctatattatgacctcaagcctttgagtcatgtcatttttcaagactgcatattggtctgtaatctttttctaattttcaactgttctgatgtttgacactccattaatacaattttgcctttctgcaagaacatctttgtcatcaaggccccactcagatatagtgaaataggaaatctgtattcccattgctgaagctcaggtaatatgcactgactcatgaagctgaaaggtccatgggagagagccatcttcagtttgagataagatacttattaaagtaaagatgacaatatccaggccaacaacatgcatatccagtgctaaggattcttgtatgtattaacaccatgtttcctaactgactggtaagattgaaatgttagtccttaaaaaggttaagagaccatcagggcctatatctcttcctgtcaattccagagcagagtttcattaataatatctgcaaggagccaaaggtcttaattattaaggagagtttttggctctggggtattacaactactccagatcctatggttgatttgcccataagcctaactatggtggatgctactctctgctctcgctcaccttgatgtattaattcccctgatctcctgacatcagactagggccaatgacaatgtcctggcttctctctctccttctccctcatttgctgctttgtttctctgcagagtctcacctggtcattgtgcgtcctgccttactctcatcttggagttttcagtgagtgggccccatggctatgtgcaatggtagtttgcacatcatgagccttagtcaggagaccctagtaaagaatccttgttagtccccgcagcctctgttttagttgtccttctatcactaaggtggttagttttgcccacctctcaattttaacaaagatctgtggctgagcccagtgcacacaatatgatgcctctggctccacccccagcagtcagccatcatccttctgttccttaagcacgctgcatagcaacctttttctgctcagccaaacctcacatgagctctggcctaccagggccttttctcacattatctttctagaactttagaatgactaattttgatttctcaaacccactttccatggtcttgttggattttaataggtatgtttgtggggtgacaatcacttatgtttttcctcatggttttgtcatgtctaaagataaatttattttacttaacaggtgaaagtgataaagtttctatattacttattaatctcttttaggaatgacagaaactgctaggtgttccctgatatctcatcttctcttcttttgtcagtaatagggtttctaagttttagctgagcaaatggctgcccagttaagaaccacatttcccagcctcccttgcagcaaggtgtagccataggaccaggttccagccaatgggaagtgagatgtgactgtgttccaggatgtgctcttaaaaagaatggctgtgcccacctctccctcatttcccccttgctggtggaatgtgggctcagaactggtaagccatcttcaaccatgcagaccagggcatcaagccatgagatagatgaagcctaggttcctaaaatcttcagggatttctcaagagattgagaaagaaacttctatcgtatttatgtgagcattgtgagtttgggcctttgatacaatgactgaattggtattccaataggccttttcatttgagaggactgcgccaatgtatctgtcttgaactgtttttataagaagtggctatttaaagtaggtatgtgcagatgtaaattttataaaactacaaccaaccattacccaatactcaaacaaagtattcatttttctaaaaagtactaaatcatgattaaacatgagagtttttaaaaaggtcatcaggatattcaaaaggtgtctaaatataaacccttaagttagtttttttttttcatggcctgtatatttgccaaagtattaaaacttatatttttgtggttttaatgttccaatgatcatgaagaattaacatgaaattgttctggtagaaagaaatgataggagtaggagtattaagaagcttaggaaaaggatgccagatcctctgccatcattaatttagagggtgtgagagagagcatccacagcttctacagtatgcttctgtgactggaaactagaataagtctctctttaagtacaacttgccccattaaggcttgaaaaaacaacaggtgtaatatttccatttgggggatgcaaatatgcaattaatgaatcttttttaaaacttaaagtagaaagctttacagttctgaggtaagattaatttaaagtcatggttaagggaagaggcagtgtggtgctacacaaggctcaaggctggagctgaggaccagctagagggtggttcttgctatatcatcaactcagcatgtggcccgagccatcatctcccttagacctcattttcttcacttgtaaaatgaagagatttgaataaaatttccctagtcattacaatctgtgaatctacagagaaataatgatgccagttaagtagctagccagagaaagttaaggcaggttaaccaactttatgaaaatatacagtagctagaatctaaatcccagtatcctacaatcaatagaagagatgagtagctagatagaaaagtgattcttgataactatgtttatgaaggtgggataaaaatcctcagaccttcaaatatttgtatgacaataacaatatcctttaaagactgagtttggagggatggcttccaccttcaaagagacatcacataatatgaagcttccacattaagaagtttccagggcacaactacaactttctagcaagattctatcatagtaaggtcctaatctaactaaccagaaaaaaaatgatgaagaaaagaggatgtttatctcatgaaagacaatcagggcttattgacaacagtctacagaacatgagctcagtcttgtattctctcacctcagtagcccacagtttcacttacctcagtcactcttaaatccagcacacatcattcccccaagctcctatctgtcacttagaacaatttttggatatctcctaggaacactgacacatgtcccaaactgaagagtgagaccaccctactccactgcttctgcaggtttccttctccagtgatgggttcacgctgccctccatcacacagaccagaaacccaggagccatccctggctccatcttctcccagatccttataaattcctcttgattttaccccctaaatagctctcaatttcatcctttctttccatctccatgatcaccaccttagcccaacttaccatcatctgatttccccacatcctctcatgcccttcaccttccccaatccagagtgatcctttaaattgaatatctcatcacgttaatcccaagcttaaaagctttccacagctgttctggtaatggagtacaggttcttaacatggtctacaaggacctgcatgatctggcttctgcttccttcaccagttttgtcttccaccattctgccctgcttctctctgttccagtcctgaactcctattttagtcattcaaaatgctgtcagccgctgctacagtgccttcatttatgttgttctctctacacagaatgccccacctcttcctgtcccttccttcacctacttttttttttttttaacaactgctctgctcaaatgtcacatcctcagggattactgccctgacctgcaaactatgtcaacctacccattatacactttaatagaaccctatgtgaatgcagtggacacgatgaagaggacattgtttggctctaggagaatctaccagacctgctcatctgcaggggactctgggcaaattatgttgactgacagctgaacaagaaccatggggtagagtatgctgtttaagtcagggtcccagcaagcaacacatggtacactcaaattaggataacttgagaagagtttaataaaggaacaatttagaaaggtgtgagaagcttatagggaaactacaagggatgataccgtactctgggggcagaaataatagggaccataccctactaagcctgaaaaggcaaagaatagaattgctagtagaaccaggattcagaaaagcctaaagtgatgagggctccttgacatgagctgggaccttcagtcaagggaccagtttcagtgaacccacaaggacgaagtcgggagagtaatacttttcatcattgtcctcccttcctctgatcgactgccatgattccctactagccaaactcaactggaagccagaaggcttgagagcccatagtgtagaccatataggtcatggcagagcagcaagaagggtggcaagtggctctggaggtaaaaaggagggtattcttatttgtatttatctctactcatctttacacaaaaatcttgaggctgtttgcttgaaacaaaataagtaatacaaagaaacaaccaggaagagtctacaaatgccctaccacaagggttaacagaggtgcagtttgactccactgcaagcatgacactggactataagtaaatccataggtacagaaagtagaagtacaattagtagttaccagggttgctggggagggaaaaatgactgcttaatggatacaaggtttccttttgggatgataaaaatgtgctggagttagacagagggaatatttgcacaactctgtgaatgtactaagtgccactgaattgtatctttaaaatgattaattgtatgttatgtgaattttgctccaataaaaagaatgactcaatttcccagcaacctgaataataaaggaaacataatcaattatgcagttctcactattggaaaggagaaagtctactagtctctatggtggaaataaagatgattctagcagagagctctaaaagatatccctctcatgggcttttatatacagatggtggtaaatgatataatggataatgccctcaacacattttatgataggatgcagaggtagtttccaacatctgttccctgatcaaggttgagatataagattaaaaagcaaatcaatgatggtgtctctagaatgggacgagataatgtattggtcaacatgatctaaaggtggatcccagggtcaacagactgaatatctcttgggatctttgttagatgtcaatcttttctctcacttaggttttgaaaagaagctggatattagacaattcaaggaagtcccctgtgataaggcactcttatgctggcattttacataagtgactaggaccagatccatatgctttgggcatcagatgaatcagcagcagcattaatgtactatcaggaggctggggaagcctaattatattcttgctaggatagaagtctgtccacctcatagtcccatggaagtggactttctaagttgtcatccattcaacaacatgaacttaaaaactatatttactaactgccaactatatgccatgcacattgaaaggtagtggggattcaaagatggacatttactattccttctttccttctagtaaccccttgggatcccatgccaagaaggtggggagtagtgctgaactccttgattccactaaagaaatatattctattgaatctcatgaagtttctagttacttttttctttttaacatactgtttgcaactcctctcttcctgcccaatgaaatctttaatatagtatggtcaaaatgcttacaaaaatattgagttatctggtggctggcaagatggtcaaataggaacagctccagtctgcagctcgcagcaagatcaacacagaaggcgggtgatttctgcatttccatctgaggtacatggcttatctcactgggactggttagacagtgggtgcagcccatgaagggcaagccgaagcagggtggggcgttgcctcacccaggaagcacaaggggttggggaactccctccccttgccaagggaagccatgagggactgtgctgtgaggaatggtgcacactagcccagatactacgcttttcccatggtcttcataacctgcagacaaggagatgctctctggtgcctaggccaccatggccctgggtttcaagcacaaaactgggcggccacttggacagacactgagctagctacagaagtttttttttcataccccagtggtgcctggaatgccagtgagagagaaccattcactcccctggaaaggaggcaggaaccagggagccaagtggtctagctcagcagaccccagccccatggagcccagcaagctaagatccactggcttgaaattctcactgccagcatagcagtctagagtcgacttgggatgctgaagtttggtggggggaggggcgtccctcaatactggggcttgagtaggcagttttcccctcacagtgtaaacaaagccactgggaggtttgaactgggcagaggccactgcagctcggcaaagctgctgtggccagactgcctctctagattcctcctctctgggcagggcatctctgaaagaaaggcaccagccccagtcaggagcttagagataaaactcccatctccctaggacagagcacctgggggaaggggcagctatgggtgcagtttcagcagacttaaatgttcctgcctgctggctctgaagagagcagcagatctcccagcacagtgcttcagctctgctaagggacagactgcctcctcaaatgggtcccttgaggggacagtgcttcctgactgggagacaactcccagcaggggtcgacagacacctcttacaggagagctccagctggcatcgggtgggtgcccctctgggacgaagcttccaaaggaaggaacaggcagcaatctttgctgtcccacagcttccactggtgatatccaggcaaagagggtctgcagtggacatccagcaaactctagcagacctgcagcagaggggcctggctgttagaaggaaaactaacaaacagaaaggaatagcatcaacatcaatgaaaggacgtccacaaagaaactccaaccgaaggtcaccaacatcaaagaccaaaggtagataaatccatgaagatgaagaaaaaccagtgcaaaaagcctaaaaattcaaaaaccggaatgtctcttctcctccagaggatcacagctcctcgccagcaagggaacaaaactgtacagagaatgagtttgatgaactgacagaagtaggcttcagaagatgggtaataacaaactcctctgagctaaaggagcatgttctaacccaatgcaaggaagctaagaaccttgaaaaaaggttagatgaattactaactagaataaccagtttagagaagaacataaatgacctgttgcagctgaaaaacagcttgagaactttgtgaagcatacggaagtatcaatagccaaactgatcaagcagaagaaaggatatcagagattgaagatcagcttaatgaaataaagtgtgaagacaagattagaggaaaaataataaggaacaaacaaagcctccaagaaatatgggactatgtgaaaagaccaaacctacatttgattggtgtacctgaaagtgacagagagaatggaactgagctggaaaacactcttcaggatattatccagtagaacttacccaacctagcaaggcaggccaacattcaaattcaggaaacacagagaatgccccaaagataccccttgagaagagcaactccaagacacataattgtcagattcaccagagttgaaatgaaggaaaaaatgttaagggcagccagagagaaaggtcgggttacccacaaagggaagcccatcagattaacagctgatctcttggcagaagctctacaagccagaagagagtgggggccaatattcaacattcttaaagaaaagaattttcaacccagaatttcatatccagtcaaactaagcttcataagtgaaggagaaataaaatactttacagacaagcaaatgctgagagactttgtcaccaccaggcctgccctacaagagctcctgaaggaatcactaaacatggaaaggaacaaccggtcccagccactgcaaaaacatgccaaattgtaaagactatcgatgctaggaagaaattgcatcaactaacaagcaaaatgaccagctaacatcataatgacaggaccaaattcacacataacaatattaaccttaaatgtaaatgggctaaatgctccaattaaaagacacagactggcaaattggataaagagtcaagacccatcagtgtgctgtattcaggaaacccatctcatgtgcagagacacacataggatcaaaataaagggatggaggaagatctaccaagcaaatggaaaacaaaaaaaggcaggggttgcaatcctagtctctgataaaacagactttaaactaacaaagatcaaaggagacaaagaaggccattacataatggtaaagggataaattcaacaagaagagctaactatcctaaatatatatgcacccaatacaggagcacctagattcatacagcaagtccttagagacctacaaagagacttagactcccacacaataatagtgggagactttaacaccgcactgtcaacattagacagatcaatgagacagaaagttaacaaggatatccaggaattgaattcagctctgcaccaagcagacctaacagacatctacagaactccccacccaaatcaacagaatatacattcttctcagcaccacactgcacctattccaaaattcaccacatagttggaagtaaagcactcctcagcaaatgtaaaaggacagaaattataacaaactgtctctcagaccacagtgcaatcaaaatagaactcaggattaagaaactcactcaaaaccactcaactacatggaaactgaacaacttgctcctgaatgactactgggtacataatgaaatgaaggcaaaaataaagatgttctttgaaaccaatgagaacaaagacacaacataccagaatctctgggatgcatttaaagcagtgtgtagagggaaatttataacactaaatgcccacaagagaaagcaggaaagatctaaaattgataccctaaatgtgatctaaaatgacacgctaaaatgtgatctaaaaaagatcacaattaaaagaactagagaagcaagagcaaacacattcaaaagctagcagaaggcaagaaataactaagatcagaggagaactgaaggggatagagacacaaaaaacccttcaaaaaatcaatgaatccaggatctggttttttgaaaagatcaacaaaactgatagactgctagcaagactaataaagaaaagagggaagaatcaaatagatgcaataaaaaatgataaaggggatatcaccaccgatcccacagaaatacaaagtaccatcagagaatactataaacacctctatgcaaataaactagaaaatctagaagaaatccataaattcctggacacatacaccctcccaagactaaaccaggaagaagttgaatctcttaacagaccaataacaggctctgaaattgaagcaataattaatagcttaccaaccaaaaagagtccaggatcagatggattcacagccgaattctaccagaggtacaaggaggagctggtaccattccttctgaaactattctaatcaatagaaaaagagggaatcctccctaactcattttatgctcactttatgaggttagcatcatcctgataccaaagcctgacagagacacaacaaaaaaagagaattttagaccaatatccctgatgaacatcgatgccaaaatcctcaataaaatactggcaaactgaagccagcagcacatcaaaaggcttatccaccatgatcaagtgggcttcatccctgggatgcaagcctggttcaacatacgcaaatcaataaacgtaatccagcatataaacagaaccaaagacaaaaactacatgattatctcaatagctgcagaaaaggcctttgacaatattcaacagcccttcatgctaaaaactctcaacaaattaggtattgatgggacgtatctaaaaataataagaactatttatgataaacccacagccaatatcatactgaatgggcaaaaactggaagcattccctttgaaaaccggcacaagacagggatgccctctctcaccactcctattcaacatagtgttggaagttctagccagggcaatcagacaggagaaataaataaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctctacaccaataacagacaaacagagagccaaatcatgagtgaactcccattcacaattgcttcaaagagaataaaatacctaggaatccaacttacaagggatatgaaggacctcttcaaggagaactacaaaccactgctcaatgaaataaaagaggatacaaacaaatggaagaacattccatgctcatagataggaagaatcaataccgtgaaaatggccatactgccccaggtaatttatagattcaatgccatccccatcaagctaccaatgactttcttcacagaattggaaaaaactagtttaaagttcatatggaaccaaaaaagagcctgcattgccaagtcaatcctaagccaaaagaacaaagctggaggcatcacgctatctgacttcaaactatactacaaggttacagtaaccaaaacagcatggtactggtaccaaaacagagatataggctaatggaacagaatagagccctcagaaataataccacacatctacaaccatctgatctttgacaaacctgactaaaacaagaaatggggaaaggattccctatttaacaaatggtgctgggaaactggctagccataggtagaaagctgaaactggatcccttccttacaccttatacaaaaattaattcaagatggattaaagacttaaatgttagacctaaaaccataaaaaccctagaagaaaacctaggcaataccattcaagacatagggatgggcaaggacttcatgtctaaaacaccaaaagcaatggcaacaaaagccaaaattgacaaatgggatctaatttaactaaagagcttctgtgcagcaaaagaaactaccgtcagagtgaaaaggcaacctacagaataggagaaaatttttgcaatctacccatctgacaaagggctaatatcctaatctacaaagaactcaaacaaatttacaagaaaaagacaaacaaccccatcaaaaagtgggctaaggatatgaacagacacttctcaaaagaagacatttatgcagccaacagacacatgaaaaaatgctcatcatcactggccatcagagaaatgcaattcaaaaccacaatgagatatcatctcacacaagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctcgaactagaaataccatttgacccagccatcccattactggatatatacccaaaggattataaatcatgctgctgtaaagacacatgcacacgtatgtttattgcggcagtactcacaatagcaaagacttggaaccaacccaaatgtccaacaatgatagactggattaagaaaatgtggcacatatacaccatggaatactatgcagccataaaaaaaagatgagttcatgtcctttgtagggacatggatgaagctggaaaccatcattctcagcaaactatcacaaggacaaaaaaccaaacactgcatgttctcactcataggtgggaactgaacaatgagaacacttggacacaggaaggggaacatcacaccctggtgcctgttatggggtgcagcaatgggggagggatagcattaggaaatatacctagtgtaaatgacgagttaatgggtgcagcacaccaacatggcacaaatatacatatgtaacaaacctgcacgttgtgcacatgtaccctagaacctaaagtataataaaaaatatatattaaaaaaagaaaaagaaaaaaaagagaaagaaactgtagccctaaaatgtgagagataaaacagaaaaaaaaatcaatgaatccaggagctggttttttgtaaagattaacaaaatagatagaccactagccagactaataaggaagaaaagagaaaagaatcaaatagacacaataaaaaatgataaaggggatatcaccactgatcccacagaaatacaaaataccatcagagaatactataaatacctctatacaaataaactagaaaatctagaagaaatggataaattcctggacatatataccctcccaagactaaaccaggaagaagttgagtccctgaataggccaataacaagttctgaaattgaggcagtaattaatagtctaccaaccaaaaaaaagcccaggactggacagattcacagccgaattctattacaggtacaaagaggagctggtaccattccttctgaaactattccaaacagtaggaaaagagggactcctccctaactcattttatgaggccagcatcatcctgataccaaagcctggcagagacacaacaaaaaaagaaaatttcagtccagtatccctgatgaacatcaatatgaaaatcctcaataaaactctgacaaacttaatacagcagcacatcaaaagcttatccacaatgatcaagtaggcttcatccctggaatgcaaggctggttcagcatatgcaaatcaataaatgtaatccatcacataaacagaaccaatgacaaaaaccacatgattatctcaatagatgtagaaaaggccttcaataaaattcaacaccccttcatgctaaaaactctcaataaactaggtattgatggaacgtatctcaaaataataagagctatttatgacaaacccacagccaatattatactgaatgggcaaaaattggaagcattctctttgaaaaccagcacaagacaaggatgccctctctcaccactcctattcaacatagtattggaagttctggccagggcaatcaggaagagaaagaaataacgggtattcaagtaggaagagaggaagtcaaattgtgtctgtttgcagatgacatcattgtatatttagaaaacctcatcatgtcagccccaaatctttttaaggtgataagcaacttcagcaaagtcttaggatacaaaatcaatgtgcaaaaataacaagcattcctatacaccaataatagaaagccaaatcatgagtgaactctcattcacaactgctacaaagtgaataaaatacataggaatacaacttacaagggatgagaaggacctcttcaaggagaactacaaaccactgctcaagaaaataagagagtacaaaaacaaatggaaaaacattccattctcatggataggaagaatcaatattgtgaaaatggccatactacctaaagttatttataggttcagtgctatcctcatcaagctaccactgactttcttcacagaattaaaaaaaactagtttaaatttcatatggaaacaaaaaagagcccatatagccaagacaatcctaagcaaaaagaacaaagctggaggcatcatgctatctgacttcaaactatactacaaggctacagtaaccaaaacagcatggtactggtatcaaaacagagatatagaccaatggaacagaacagaggcctcagaaataataccacacatctacaaccatctgatctttgaaaaacctgacaaaaacaagcaatggggaaagtattccctatttaataaacagtattgggaaaactggctagccatacacagaaaactgaaactggacccctttcttacacctatacaaaaattaactcaagatggattgaagacttaaatgtaagacctaaaattatcaaaactctagaagaaaacctaggcaatattattcaggacagaggcataggcaaagacttcatgactaaaataccaaaagcaatggcaacaaaagccaaaattaacaaatgggatgcaatggcaacaaaagccaaaactaacaaatgggatctaattaaactaaagagcttctgtgcagcaaaagaaactatcatcagagtgaagaggcaacctacagaatgggagaaaatttttgcaatcaatccatctgacaaagggctaatatctagaatctacaaaaaaaaaaaaacaaattcacaagaaaaaaaaagcaaccccatcaaaaagtgggcaaaggatatgaacagacacttctcaaaagaagacatttatgtggccaacaaacatctgaaaaaaagctcatcatcactggtcattagagaaatgcaaatcaaatccacaatgagataccatctcatgccagttagaatggtgatcattaaaaagttaggaaacaacagatgctggagaggatgtggagaaacagagatgcttttacactgttggtggaagtgtaaattagttcaaccattgtggaagtcagtgtggcaattcctcaaggatcttgaaccaaaaatatcatttgacccagcaatcccattactgggtatatacccaaaggattataaatcattctactatagagacatatgtacacgtatgtttcttgcagcactgttcacaatagcaaagacttggaaccaacccaaatgcccatcaatgatagactggataaagaaaatgtggcgcatatataccatggaatactatgcagtcataaaaaaggatgagttcatgtcctttgcagggacatggatgaagctggaaatcttcattctcatcaaactaacacaggaacaggaaaccaaacaccgcacgttctcactcataagtgggaattgaacaatgagaacacatggacacagggaggggaacatcacacatctgggcctgtcggggggtgggaggctaggggagggatagcattaggagaagtacctaatgtagaagacaggttgatgggtgcagcagaccaccatggcatgtgtatacctatgtaacaaacctgtatgttctgcacatgtatcccagaacttaaagtataataagaataataaatattgagttatctaatatgatatgatttccaggtttccagaaaaattactcaagcatgtcaaaagatccacagaaggtgcctgatgctccctgtccataagggctatagaaagcaattattgttaccaaataactacaacaataactgtcaagggaatggcagtgtcagtgagacttctaggcatctgaggatgctgagcctgatgagctgacatggctgggatgagcttattagatgagatagaatttgattggaatgtttctcatttgactttattttaatgagctctaggagaacaacaaaactattttagcaactactgttttccagcattatccatgtggcagtcactttctgcatcacagaagggaatctacgaatgttaatgtttaattgatcattagccttttctggcaattgttttccataataaatgtttccccacaacaacatcaaagcagctcatactgccttgtggtattaagcctgtttccctagctgccacccaattccattcacagagggatttatgaaaagtaggattccaaaagccctggctttattccaagatgtctaataagatgcataggaaaataaaggcagggagacaggctggataaatggggcactcttatttaagaaagtgcaagagaaaaattggagtgtgtcaaaatgagaaaaatagaggaaaaatcaggaagaaataatcaagagcccatccctagacagaagattagtttatcctgctgaaatgaagcatggttgagaaaaatggatgatacagatataaattattcatggttaaagacatctcagtcattaagatatttacaccatgagtgaagcccatgcatgctgggttgatttatgggctacataattacagaagatacgctgatgactgtttgcatgggaaacactctggatttttattttgttaatcagttttcccacttctgagtcctgcattgcaatcacagtgcaaggcttgattagaacctcccgggggtagtggaaaggctgtgcatggtaatatcaactttgcctgccttacattcctttagataagaaagtaccttttgggagcctttcaacttgctcgttagttaacagtatttttattaatagtacctattcatataatgctattaataatttcaacccttttcagataaaccaaaccccaatacatttttttaaatattttttaaattgctgatttattttttttctattgaaataaagtgcttgggaaagactcacctaaaagtgcaccttccaatgttcaaataagcttcgtcttaaatcctaacttttccccagggagttaaaggagacacagcatgaatatttattgtattgcaagaagagtacaaagcaagtgaaactcgataatacttcccatgctaacttgagtttggataaagcatgtttaattattgactcccactctctgcagcaggctcaccctggtaattgcattaattttggaataacttgaccccttattttacatgacagatttttttggtaccctgcttattaggtaatagtattttaaaaactttttatggaagtatatcaacatgcagagaatgcataaatcacaagtttacaatttgatacattttcataaactgaatatatctgtgtaaccacaccaagacccagaaatagaacattaccagcatcaaataatccccctactcctttacattgctcaccatccaaaaagtaaccattatcctaacttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctaggattacaggcgtgagccactgcgcccggcccattatcctaacttctaacaggataagttagctttgcttactgttttcctttttagaaatactatttatactcttctttggcttcttttgcacaatattaggattgtaagagtcatgcatattgttaggggtaatttattataattgctatattgtatttcatgaggtgacccatgctataattcatccattctacctaagtttttctgggttttggctattacaaatatttctgctatgctctgcacaatggccaagatgtgaaatcaacctaagtgtctattgatgataggtgaatggataaagaaaatgtacacaatggaatattattcaaccatgaaaaagaatgaaatcctgtcatttgtagcaacatggatgggtctggatgacactatgttaagtgaagtatgccacgcacagaaagacaaatactggatgttctcatttatatgtgggagctaaaaaagttgatctcgtggaggtagagagtagaatggtggttaccagaggttggaaaggagaaggggcgggggtgtgaaaagaggttgcttagtgggtataaaacacatttagatggagggaataagttctagtgtttgatagcacaatagggtgactatagttaccaacactttattgtctatttcaaaagagccagaagagaagatttggaatgttctcaactcaaagaaattataaatgtttgaggtgatggatagatatccctattactctgagttgatcattatacactctatgtaggtatcaaaatatcacgtgtaccctataactatgtactattattatcagtaaaaaatattgctgctatgaacattctagttgtctttggtgagaatgggtatgcatttctgtaggaaccataactaggtttggaattgttgggtcacagggtatgcgtatgctcagcttcagcagatactgtcaaagaggttttctaaagagttttatgaatttgctgtcccaccagaagggaatgagaattccagttgctctatatgtttaccacctcttgttgtggtcagtcttttccactgtagccattcagttgagtgtgtagtggtatcacactgtgttttcaatttgcatttccctgatgactaacgtagtagagcaatttttcatacagttattggccatttgaatattctcttttgtgacgtgtctgatcaggtattttccctgattttttattagttgtctggcttattgctttgtgaaaattaaatatatatatataatttaaaaaataattaaaatagttttaaaaactaaaaaataatttcaaaatatatattctagtatgagtcattgttggatatgtgatttgcaaatatactttcctccctctatgacttaccatttcaatgcttaaaggtgttttttgataaagagaagttctacattatttatattatggttatactttatatgttatgtttaagaaatctttgcttactataaagtcatcgtgatgctctcatatgcttttttttacaggtttcattgtttaattttatatttatatcagtaatcctctgaaattgattcctatgtgttgtgcccggtagagtcaagatatattttctccacatggatataattgatccattatcattttttgaaagggctactttttttctcattgcattacaatgtcacctgtgtcacaaatcaggtgaatatatgtacacagacagattaatatatatattcatatgtaccactcatgtatttatgaatatatacatatgtatatatgtgtgtgtgttttctggacactctgttctgtttgtcttttcttcgtgtgtcagtaccatattgtcttaattacttcagctttttaatagatcttaatatctagcagtatgggttctctccagttctttattgttctttaagactgccctgactttcttgaccccttttagtgtggttttactgtgtatttaattcagcaaaaagtaaagctcagtaactaaataagtgagagagtttaggcccttgccaagggaataataatatatgaaataatcatgttagaatttatgtgacagatttcagtattaaatttgatagactgacatggtttatatatatatatatatttaaaaatactctgtagaatactaataaaagtcttccaacttaaatttctagggtctcaatggtgtcccatgtagccaaagaatttttaaatttttaaggcaggtgatatggtttggctctgtgtccccacccaaatctcatcttgaattgtacttccataattcccacatgttgtgggaggaacctggtgggagataattgaatcatgggggcagtttcccccgtactattctcatggtaatgaataagtctcatgagatctgagggttttatcaggggtttccgcttttgtgtcttcctcattctctctttgcctgttgccatccacttaagatgggacttgctccttcttgccttccaccatgattgtaaggcttccccagctacatggaactgtaagtccagttaaacctctttcttttgtaaattgcccagtcttgggtgtgtcttcatcagcagtgtgaaaacaaactaattcagcagacaataagaaaaagcaggtctcaattttttttttttttttgagtgagggtctcactctgtcacccaggctatagtgcagtggtatgatcatagctcactgcagcctcgaactcctgggctcaagtgatcttcccacctcagcctaccgagtagctggtaccacaggtgtgtgccactgcacccaacgaatttttaattttttaatagaaacagggttttaccatgttgcccaggctggtctcaaactccagacctcaagtgatcctcccaactcagcctcccaaagtgctgggattacagatgtgagtcactatgcctggcacaaaatttcttaaaggtctttctgagctcagacatagtaactgggggcacactttgtacataccatcatggccctcattgcacaagctctggaagcctttacttccattgtcagtactaatgtgaagattttttaaaaaggggcatacaggtcatctacaaagaaacgcccatcagactaactgaaactctcagtggaaaccctacaagccagaagagattgggggccaatatttaacattcttaaagaaaataatttccaacccagaatttcatatctggccaaactaggcttcataagcaaaggagaaataaggtctttttcagacaagcaaatgctgagggaattcatcaccacctcaagcctgctttgcaagagctcctaaatatggaagcactaaatatggaaaggagaaactattaccagccactacaaaaacacactgaaatacacagaccagtgatactatgaagcaaccacataaacaagtctgcaaaataaccagctagcatcatgatgacaggatcaaattaacacataagaatacaaactttaaatgtaaacaggataatgccccaattaaaagacacagaatggcaagctgaataaagagccaaaacccattggtatgctctgttcaagagacccatctcatgtgcaaagacacacgtagactgaaaataaagggatggaggaaaagttaccaagcaaatagaaaacagaaaaaagcagggtttgcaatcctagcttttgacaaaacagactttaaaccaacaaagataaaaaagacaatgggattacataatggtaaagggttcaatccaacaagaagagctaactatcttaaatatatacgcacctaatacaagagcacccagattcataaagcaagttcttagaaatctacagagagacttagactcccacacagtaatagtgggagattttaacacccgacaggcaatattggacagatcattgagatagaaaattagtgaagatattcaggacttgaactcagctctggatcaagtggacctgatagatatctacagaactcttcacacaaaaacaacagaatatacattcttctcattgccacacaatacttactctaaaattgattacataattggaagtaaaacacttctcagcaaatggaaaataactgaaatcataacagtctctcagaccacagcacaatcaaattagaactcatattaagatattaactcaaaatcacacaactacttgaaaatttaacaacctgctcctgagtgacccttgggtatataatgaaattgaggcagaaataaaagagttctttgaaactggtgagaacaaagagacaatataccagaatttttgggatgcagctaaagtaatgttaagaagaaagtttatagtactaaatacccacatctaaaacctagcaagatctcaagttaacaacctaacatcacaactaaagaactagagaaccaagaacaaacaaactcaaaagctagcagaggacaagaaataaccaagatcagagctgaactgaaggagatagagatgtgaaaatcccttcaaaaaatcaacgaatctaggagctgcttttttgaaaaaattaataaaatagaccactagctagattaataaagaagaaaagagagaagaatcaagtaaacacaatcagaaatgataagggtgatatcaccactgacccccacagaaatacaaataactatcagagaatactataaacacctctatgcacacaaactagaaaatctagaagaaatgtataaattcctggatgcatacaccctactaagactgaaccaggaagaaattaattccctgaatagaccaataacaagttctgaaatttagtccgtaataaatagcctaccaaccaaaaaatatccaggaccagacagattcacagctgaattccaccagaggtacaaagaagagctggtaccatttttactgaaagtattcaaacaaattgaaaaggaggggctccttcctaactcattctatgagaccagcatcattctggtgccaaaacccggcagggatacaacaagaaaagaaaatttcaggccaatatccttgatgaacatcaatgcaaaaatcctcaataaaataagtaatggcaaaccaaatccagcagcacaccaaaaggcttatccaccatgatcaagttggcttcatccctgagatgcaaggttggtttaacatatgaaaatcaataaatgtgattcatcgcataagcagcactaaagacaaaaaccacataattatctcaacagatacagaaaaggccttcaacatctcttcatgctaaaaattctcaataaactaggtattgaaagaatatacatcaaaataataagagccatatatgacaaacccatggccaatatcatactgaatgggcaaaagctggaagcattcaccttaaaaactggcacaagacaaggatgccctctcttaccactcctattcaacatagtattggaagttctggccagggcaatcaggcaatagaaagaaataaagggtattcaaataggaagggagaagtcaaattatctttgtttgcagatgatatgatgctgcattgagaatactccatcatctcagcccaaaagcttcttaagcctgacaagcaacttcagcaaagtctcaggatacaaaaccaatgtgcaaaaattactaacattcctaacaccaacaacaaatctctctgatttggcaagtagagagccaaatcataaatgaactcccattcacaattgctacaaagaaaataaaatacctaggaatacagctaataagggaagtgaaggatctctttaaggagcattacaaaccaccatacaaggaaatcagagaggacataaacaaatgaaaaaacattccatgtccatggataggaagaatcaatattgtgaaaatggccatactgcccacagtacagtatagattcaatgttattcccattaaactaccatcgacatccttcacagaattagaaaagaaattttttaatctgtatggaaccaaaaaagagcctgtattgccaaaacaatcctaagctaaaagaacaaagctggaggcatcataccacccaagttcaaactatactacaaggttacagtaaccaaaacaacatggtactggtacaaaaacagacacatagaccaatgaaacatagtagagaacttagaaataagaccacacacctacaaccaactgattttcaacaaaccttacaaaaacaagcaatggggaaaggattccttatttaataagtggtgcttggagaactggctagccataggcagaaaattgaaactggactccttccttacaccttatacaaaaattaacttaagatgggttaaagacttaaatgttaaacccaaaactataaaaaccctaggagaacatctaggcaataccattcaggacataggcatgggcaaagatttcatgatgaaaatactaaaagcaaaaattgacaaatgagatctaattaaactaaagagcttctgcatagcaaaagaagctatcatcagagtgaaaagacaacctacaaaatgggagagaatttttgcaatttatacatctgacaaaggtctaatatccaaaatctacaaggaactaaaacaaatttataagaaaaaaacaatcccattaaaaagtgggcaaaggacatgaacagacatttctaaaagaagacattcatgcacacaacaaacatatgaaaaaaagctccacatcactgatcattagagaaatgcaaatcaaaacaacaatgagataccatctcacaccagtcagaatggcgattattaaaaagtcaagaaacaacagatgttggcaaggttgcgaagaaaaaggaatgcttttacactgttggtgggggtgtaaattagttcaaccattgtggaagacagtgtggcaattcctcaaagacctagaggcagaattaccatttgacccagcaatcccattactgtgtacatgtatacccaaaggaatatgaattattctattttaaaatacatgtatgtgtatgttcattgcagcactattcacaatagcagagatacggaatcaacccaaatgctcatcaatgatagactggataaagaaaatgtggtacacatataccacagaatactatgcagccatataaaataccagatcatgttctttgcagggacatggttggagttggaagccattatcctcagcacaacaacacaggaacagaataccaaatactgcatgtcctcatttataagtgggaactgaatgatgattacacatggacacatgaggaggaacaacacacactggggcctgtcagagtggtggggcttgggggaaagggagagcatcagaaagaatagcttatagatgctgggcttaatacctaggtgatgggttgatctgtgtagcaaaccaccatggcacacatttacctatgtaacaaatctgcacatcctacacatgcacccctgaacttaagagttgaagaaaaaaataagagcaaaaacaaagaaaaaagggggcataattctttgaggaccaatctttcaggaaactcaaagtttatcttcctcatttactttaaaaagtgtaaatagcaaaaccgatccagcatttaaagtgacaattaccaatggaaagatgaaaatacttgccaccaaggcaaaaaattatttgccctacctgttaaaatgatttagtatattacacatggtggctgcacaatcatcacattccctatcatcattctacagaaagtcggattcctcctcaatctaaaaatagtcggggctggataagtgattcacaggaaaaatggaatgaatctccatcaggctctgctgaggcagagaaactgtttaagtagcagccagtgtgtgccagcctgagaaagaattcctactactcatattcttaactttccaagactgggaaggaacagtcagtcaggaagagttaatggctcaacagcaacatgcaaatgctctggcatcttgtgctacagttggcttcatgtttcagttaaaaaaaaaaaaaagtatcctagttctttcagaaccagatgtgaaacgagacaaatgaataccaaccactcagatttcctaaaagccaatttacttggaagttgccaaaaatatactttgaaatatttaaagcatctacatttctgaccgacctccttggtttttataggaggtaaacataaaattaaaaaccaaatactactaaagtaccagtctaaagatgggactagattttttttaataaaaagaacaacaatttgatgattatgtatgaaaataaccaatgtcctgtcaaccgggaagcctgaccagggaatcaagagagccaaggcactgagaggcaccagctgagaccagcatgaccgctgtgtagaagtaataagcacacagtccaggatcttgaattcagtgagtccccaataaatgtgcatttattaatcataaaataaataaaatttccaatttccaattagaagaatttgatatagctagaatttgacctagctagaagggacagcaaataagttggatgtcagaatcaaggaatttagactggctaggccaggcatggtggcttacacctgtaatcccagcactttgggaggccaacgcgagtggatcacttgaggtcaggagttcaagaccagcctggccaacatggtgaaatcccatctctactaaaaatacaaaaattagccaggtatggtggcaggcatctgtaatcctagctactcaggagggtgaggcaggagaatcgcttgaactcggaaggcggaggttgcagtgaaccaagaccatgccactgcactccagcctgggtgacagagactctgtctcaaaacaaacaaacaaacaaaaaattaggtgggctagaatggtgggtgaatactttcaaattactgtttaatatgccttacatttttatagtgagtttacaaagtgcttacacatacatcatgccattttcttgctcacaaaacccctctgggatgggcctgggcattttaaatgctctgtaggtgattctgatgtttggtaagagttgggaactattgctttagactgtagcattgctcagcagtgagttttcttttattagggggttcaaattgagtttggtaaggagatcctgaaggcctcctagcattgtagagtggtccaagtaaatgatgctaatattcaattattgtgtgttaacaactttgcagatcaccatgtccatggaactgtatatgccttcaggagcatgttttgaaactcgtattttcaactgtgcagtgagataggtcttctatagacatctgtttttttgactaggttttagacagcaagggtatttgaaagtgataaatagcactttatgccactggaacatatactaccactaacagaaattgagggaactcctgaaatactgtaaaagaccaaggtagaaaactttcctaaagaaagagccaaatagttctgtggataacttgatctatggaatccaattacatgcagagcacattctgcccatgtccatagaattaaggaaggtgagagacttagctaaagggcaagagttaacagattgtttcattttcaaactttcattatggaaacttgattttaatgatggcactgcaggatcactcatgatacctttattatgttaagaagtgaacacagactctaaattgggagtaaacctgtgttccttttcctgggctgcttattcctctcctctctcctgaggaaagctggattctaacacttcattatgaaaaatctgggctgcaggtgtagtgcccaggaatctgtaaagatgcctctgggtatatgtaaaaaaagaggcaggaggattccaggaaaagtatgcctcactcccttaggctgagtagctttaccataacttgaatcaataaaaatacctgaatgattaaacaagagtagataattaattcattgtctcactttcttccttcttactcagaactctcttaggtgcttaacattaaatatttgatgttctgggattttcctttgggtaaggctcaataatgtacttaaatgtacttaaacctaaaactattatattttaaataataagattctacttttatttttaaacactctgttaagacttttatttttgtaagaatattaactgagtcttaaactttgaattcaaaaatcttacatttagaatatataaagtcacattccaatatttgttctgccttcaaaacttttacctatacttaaaacattgtttcatacatctgctatagtttctttcaatcttctgtgagtataatgtcagatttgtgaggttcatctgggtttaatcctaggtttaacactacatggtctgtgtgaatttgaataaattaatttcttcaagacacagttacttcatctgttaaaaataaggatattaggccaggcacagtggctcatgcctataatcccagcactttgggaggctgaggtgggagggttgcttgaagccaggagtttgagaccagcctgggtaacaaagtgagagtctgtctctaaaaaaacaaattaaaaaaaaaaggtagtgaggtatggtggcacatgcctgtgttcccagctacttgggaggctgaagtaggaggatcgcttgagcccaagagtttgaggctgcaatgagctatgattgcaccactgcactccagccagggtgacagagcaggaaggaaagaagcatctcagaaacaaagaaagcaaaaaagagagaagctcttttaagacagagcatctcaaaaaagaagaaataaaaagaattataatgtatgtgtcctagggttgctataactattagagttaatacaatgtgtaaggtaccttgtacgatgcttgtcgatacaaactgcataaattaatgttagttttcttctctacttcttcctgggttaatcccagggaataaataaggatgccatctatgatgcttaattagttttccagttgatgtgaaaaattactttctttacttggccagagaaagctagagaaaaggctcttaagccaaaaaattaaattacctattcatatgtccccagaacttttaagttaatgttgcttctattacgatgcagtgaagttgttcctaaaagaaagttatgagagaaagagaagggcgagcaggagggagccagacagctttctagtgtatcatcagttagatttgcatgtgccgttccacttaattagctttgagtgttgtgaattatttcaatattaccctatctgcaattttagattatctacactgttatggattgagttttataatctataactaatgaattcatatcttgggcaagatattaaaaaaatctacatgtggagcatgtagactgtacaaattacaaaaatgaaacttttttttcccacaggtggcatagttaatattcctgccaaatagtaccttcagcgtgactgaccaaactaaaatttacgtgagccccccacccccgtgccctcccaagtgtgagaattctgcgggaaaggctgccaagctcctgctctaattttgtttggagagttaaatgtaagggaagcagattccacaaggcgaatgtaccactcagcacgaaatcgacttttaaggaactcaacagatgcactggagttaaggaaatcccttctgagaagtcagaggtcccagagttacacaaagccgttcccggcagcgcgaaacatttcagatgtggtgcagtgaaagcaaaggagtcctcggcggcaggtgagcaatggtgatgaaccgaagcgcgccaggagaaggccggcgggatttcatatgagtgcagctgaaatatgacttcagtacttgaaccaattcttgtgagttaatgataaccactcctttccactctctgaaagagtgtgtgtggctcagtacctttctttttctaacctcttgagggccacaagcttaaatgtgccagaaggaaagtctccagtgagctggaaatgtagtctcgatacttagcttgttcaaatatatgatgtttatctgaagccacacctgaacgtgtctaagagcatctccttttaccagtacctgcaaggttcaggctctgtggaagataggggatatggcaggagctggaccacgaatatggataccaagatttacattccttaaaagacccacagaacacccagctttcgatgagccaagttaccacagcggggcacctttcaaaagctatataactagggacttctaccatgtagactcatatttgctattttgctccaacaagcgttatctaaaataggagggctgaacacaaggtcatacaggccactttgtagactgaccccagtgcttcccaatattcaaagaactggagagaaatgatttgtcactgtgtactactgtaccttctctgggggatgtctcttacagcccttcaaagtctgaatctccagactaatatttactgttagactctggagctatagtgctcctgaatcactagaaattgctaatgaaaatttgggtaggaagtcatctcttggtatgggccaatgaatggcctgaaacccttccacgtggtgctctgagattcaggcatcctgatgcttttatctgcagctggaggaaatgcttctgtaaggaaagggaagaaaagggaaagaagggcaataaggggagggaagagaagggaaaagaaaagaaagagagaggataggagaggaagagaggaaaggagaaggaacaaaagaaaaaaggaaggaaagagaggatgaataagaatacaaattgcttacttaagctgttactgcatcttttactactacctttggagttcttcagggaagagtaaatgtgcactctcaatttagatgaaacactgcttttaagctgtctgcatttcattcagataacaagtatttaacacttttttggtgtgtcaggtacacactatgcatgtagtggcaaaaatgcatacataatgtccctgtttccccgtccctgcccttctggtacttattgtctaatgaaagagaccaacagcttagcttaccaacaaattaccattataattgtgataattactatgaaggaaaagtaagggctccctgggggagtaaaacagggagacctaatctagataggatgttatggaagtttgttttgtctgagtaacagacatttaggctgagtctttaaagaacattgcaaaatagctggtaaagaatgtgtggagggattggagaatcacttcttaggcagagggaacagaacttggaaagtccctgaggacatgaacccggcattggggaggagcttaaaacaagagcattgggaatcaaagggaagagagcaactgggaaagttgaacactgagataggggtggcaattctgggtaaagggcatgtaggatttggaggcaaggcacagatttagtggaatggcattgaatggaagtgatgtgaagagcagaggtagacacgagctgggaggtgactacagttccttgggagagagatggcagcatctgtgagtgagaggcacggacaagtgtgtggacagcaaaaatggagaggagcaggctgactggagagagtcagggaactgtgtacgtcaggcctctgagcccaagccaagccatcgcatcccctgtgacttgcacgtatacgcccagatggcctgaagtaactgaagaatcacaaaagaagtgaatatgccctgccctaccttaactgatgacattccaccacaaaagaagtgtaaatggccggtccttgccttaactgatgacattaccttgtgaaagtccttttcctggctcatcctggctcaaaaagcacccccactgggcaccttgcgacccccactcctgcccgccagagaacaaaccctctttgactgtaattttcatttacctacccaaatcctataaaactgccccacccttatctcccttcgctgactcccttttcggactcagcccgcctgcacccaggtgaaataaacagccatgttgctcacacaaagcctgtttggtggtctcttcacacagacgcgcatgaaagtgtaaggcttgggtgtcagtggagtgggacaaataaaagatggtccaggcttttggcttgagaattgctcaagtggaggcactcatgcctgagatggggaagatgggagaggaacaggctaaggggagaagtactaaacagttaattttaagaattatcatataaacgttgtgttaaagctgctctggttaaattgctgttaagcaagggttctgaaatcaggcataacagtttgaattctggctctcttattttctacctgggcaagttattttatttcctctgatttctcaaatagggattcttaagtctatctcttaaggtaaaaatgcaatgtaataatgtttataaaataccttgaacatcataggaacttagtaaataaaaattactattactataatggcaatgtattatgttagagaaaagactcagttttgactttgacacttataaactgtcatacaggcaaaaaaaaaatgtatttgagatttcttatctttaaaaccagccaaattaccctcttttcctacgtcatgaagaatataaaaatgataattacaactctaacattttttatttagtcttgaacctataccattgataagtgataagaggccttggagtgaaatagtctttgtactacaaggaggagaagattataaatatttatagcctgtgaccacaggagctctgtgaaaaacagtactgtaaagagaatagtgcattgggggaaaggtattatttaaggtcagtctcatgatcactgagaaggagcaaaaagatccctaggacatccaaatgtcaactacaaagttcttacataatattttggaaatgtagccttcaacattaagtgtatggtgaccatgaagcctattatgctctgtatcttttgtttagaaaatgggatttattgtcctcttaagttgcaaatgaattcactagccttgtgtgaactgacctatcactgtggaagtcatgtggattcttccattcatcaaaaagtgacagactcccatgtcatcacagccctttcagtctttttctcaaaaaacaagaggtagcctgcttaccttaaataggttatcatgaggataaaatatgatgaagattataaaagtgcatattaaaccaaaagtactctaaatataagaaattattttggatattattacatttgggagaaaggctcaaaatcaaatactcttcatttatttgttcatttatttgcttcatcaaccaataaacaaataatatcttttatgtacagggcacaacagaggatacaatatgggtagaaatagcttctgttgtcaaggagtttataatgcttaggaggagagacagtcacacacacagataactatagtactacactgaatggggcagagactataggaagcatctaaaaaaagataagatggtatgggagttattagaatagaggtatttcctttagctgggtttaccaggataactctaagaacaggctgggtacaatggctcatgcctgtaataccagcacttttgggaggtcaaggcgagaagatcacttgagcccaggagttcaagatcagcctgggcaacacagggagaccctgtctctacaaaaaaataaaaatacaaaattatccaggcatggttgtgcacgcctgtagtcccagctactcaggaggctgaggtgggaggatagcttgagcccagggggtcagggctgctgtgaacctaccacctcacaacagcctgggcgacagagccaagatcttatctcaaaaaacaaacaaaaaaccccaagaaacaggaacaattttgaaaggctgtaatagcagagtaagaaaattaatctcataacaacaacaataataaaacaacaataaaagcagatttcaaaattttctatatgtgccaaaaatgtgtcaagtgctttaaaggtattaacaactttgatcatcacaataaccataggaaggagctgctatgaccaatccccattgtacagacttagaacggtcacacatccagtaagttgcagagccaggaaacaaatctgagtccttttaatcacaatactctattgtctccagataggacgaaagtcatgaagaaacagaaaaacatagtaaaacctcggtgacaaatcattaggtgttcagtgtggctgaagcacaacaaaaaacaaatctagcagaggtaggtctgggaaaggctgggtagagtcttagtgttagactaaaaattgtggtctttattttataactaacagggagatgtctaaatagggacgatgggaattgtgagaacagatgtcaatgttatgagagagagtctttagagacagaaaaggtaaagaggttcagggaaaaatttcacagtgagtctcttgcattttacttgttcttaagtaaaataattcagtaggagaggtgatctgtgtaatagtcaatcattcaatgttccatgtgaatgactccattagatgctacagtgattttcagtgaggacaagtccaacctgtgatgcccccatagagatcaggtgaaagcttgctggcttttccatttcctattttactgctaccaatagaatgtcttcaggtagtaagaactaggtgttacagaaagaagacattgtatattggtgtgctctcaaaagaaattcacattaaaagtatgatctcaacctgcttctgagaatttgcagtagagaaactcttctttaatcttaaaagtaaaccagagggtccttaccaaaatgctctgacctcctgacctcaagacagtttcagggcagtttctatcacggttgtgaaacctgtgtcacacagaagagccaggagacaggggactcagtgggtgttactgtattgagcaactgtaccctcctgggtgatctcacaggtgtatctaggagtcattttcagtgtcaaagtcatagaaacaagtagtaaaatagtttatctccttgacagcatgactgttggagttaacctggtattttaacacccactggtataccagaaataattcttaaaaaaataattttattacataccaagtactgaagttaatactgttggacaaagatagcttaaacatggagaaaattacgtcacgcctggtggggaatattgtagtcttgtttcttttgaagctatatactattatataatggctaatggaaggtaaaaaagaagaatatttttttccccagtgaatgactggagctcattttattaagaggaatgtaaaattagtatacaatcacagagaaaagtaatcttaattagtacttaatagcactctataaaagatggcctcagactgaccttgtgatcaatagaagtgcttgcctgctactcttctcaaaaggaaaagccattcttgtctaactaatacatatacatgacctcaaagaaactcatcacacaaagagagatcgcctcccctgacagaattcagtcagtttttcctatttttaaaatatgctaaaattaaagggataattttctccctaaaagacatgtttcattttagaagtcccatatataatctgaaaaggagggaattttaaccaacttcccattaatttagtaaatatctcagaatgctaagatcaaaatcttcacagataatggcttcacagcagcatgttggctttacacctactgtgagaatgctgggaagtaatctttgaaaaatttgtaattgtcaatgggactactgggtttgatgtgattaacaagagaaatgatcaactttccttcttagatagtgattttagctataatcactttaaattggttaaactatttttatttatagcatttttgttttgtatttatggttacatcaatgaaaaaagcagtgatgataaattctgaaatattttaagagaatttatcaggtccagagacagaatagtggagctggaaggacctctgagatgatatagtctggtctccttatgttacgagttaggagtagtggcccaaagatttttaaaaaacccttctgattctatcacaatggatattacctaaaatataatcaatttggcccttagagaaaaatttataagttatttgtccatgttactcctactctgaatcaactactcatcaccatggtacctaatacaatgctaagcttctagaaggagctcctaaattatattctacagtattttgtattcttacatttgtgttactcaggaatttgaaagtggttatgaatacctctaatatcatttggatgtcatttccaaatctcatgttgaaatgtaattcccagtgctggaggtggggcctggtgggaggtgtttgggtcatgggggcagattcctcatggcttggtgctgtcctcactatagtgtgttctcataagatttggctgtttaaaattgtgtggtaccctctccttctctcactcttgcttatgctcttgtcctgtgatgtgcctgcttccacttcaccttctgccatgagtaaaagctcactgaggccttccaagatgccaagtatatgctgacaccatgcttgtacagcctgcagaactgtgggccaattaaaccactcttctttataaattacccagtctcaggtatttctttatagcaatgcaagaatggcctaacataatctacactaaaatcagactatccaaattacttcaaagacccagaaatgaacaattagcatattagaaattgttacatgaagttaggcatgagcagggcaggagagggctctgctccccacctacgaggaatgtcaggtgattatcaggtgatggtttggcagttatcacattgctgctctaaaaatgataattcagcagccagtgcaccagggagagataatctcctgacggtccacagctgtcacaatgaagtgttaactgaatgcagacaccagggagaggcaacttcccaaacagataaaaacacttaaaattggtaattggctttcaacagggtctcagaaattgggcgagtgaaccgggcacgtgcattaagagacaaaatggtggactatgacttttgggggcatcccaccagaaaagggaagaaaccttcagatgggcatgcatacaacttcctaaacacactgcacatgctcacttcccaagcataaggagggcacatgcaggcagcccaccctaagggagaaatcgtgggaaagaggtgcaagatgctgaaggtgggccagcatataaagccccagggtcaaggttaaatgcctgcttgggtctcttccaagtgtactttcctttctttcccgttctaaagctttctaaaataaacttccactcctgctccgaaagcttgccttgttctctttttctgccttatgcccctcagttgaattctttcttctgaggaggcaagaatcgaggttgctgcagacccatacggattcgccactggtaacctgaataccttctacccctaacagaatgagttgtcaggatacacatgtgccccctgagctgaaagaaacaatcagagtgtggtgaacaggaggctgcaggcctaagggagaaaagcttgggggagcctacagtggctatgaagagagagactgggactctgccagaaacttcccattcctcccaaatatctgttctgggaaatgtgaggttagaaagagaagactgttgaccacttgggacaggaacttttcatagggatctttttgagagtgtatacaagttaggctgtcttggagctaggctggctaaaacaaaaaggtcattgtgtagagcgggaatcacaaacccaagtgcctgagggacaggcatgatggtgacttgctataaggctgtactgtcagggaaatgatttggacaaactggtgagaacatccccatcaagaggggcagtctgagagtcaactcaagctaagggttacatgcaggaatgttggcccagtgatgtcgaattactaagagtaacccaatatttagatttattctaaatacaaagtctctctttttaggtgttgaaagcaaattccaacttctcaaaaacattgtgaaggctgaaaaatacatgttccacagccatgccctccagtttgttgcctcttgtagagggtgtaaaaaatggggattagttacagtgaaaagatgacaacaaactattctattattcagatttatcatatagaaagcctctgaaactgaattagatatggactggttctttggtctagtggcttgaatctcacttgggtctctaagtgggtgtgggatggtaataagatgcatttgtaatcatatgtacctgtagtgctcaggtagatggtgtaggtaatcacagtgctcttttcctttaaatttcaaaatccttcaagcctcaacaatcttcaaactgcaaaatccttctcaatgcagtatttcagatggccaccaccagttaatcagagatgacataaaaaatagaaaatcattgactccccctggcctagatgagcctcatatataatgtacatagttttgtgatactttatcatttatttgtccaagaatatccagagaaagataataaaacatgctgtagtcaaatatggagattagaaaaaatctcaaaagctacttattcatttgtttgaaaaatattattgagagtatcctttatgccaggcacattgctaggcattggagttgctctagctgataacctctaaacaattggttagacttccaactactggcatttcttttctagtcggttcctgtctctttgtcttgattttggtggacagtcccatgacaggcagaatttctgaatttatcccccaaagattccatgccctaagccacagattctgttaatatgatgatacaatatataactccaatgactatgttatgtcatttggcatcagggaccttaaaaggggagattatgtgggtggtcccaaggtcatcaaatgagtccttaaaagtagaggactttctccaactagtagtatgagaagaaggcagaggagaaagtcagagatatatgaaatacgaggactcaatgaaccgttgctgtcttgaagatggagggccatgtcagaagaaatgtgggtggtttctaggaacagcgaatgattccagagagcagacagcaaggaaatgaggaccttggactgactccaaggaattgattctgccaacaacctgcgttagcttggaagggattatttcccagaccttacagataagagcttagcctgctgtcatcctgacctaggccttgtgagatcctaagcaaaaaactcatccacgcctgcctggatttctaacttataaaactgtaaatcactaccctttgtggcattttgctacaatgtaatagaaaaataatacagtaatggtgggaggggttggtgtggggaacccaagagcaacatctatctaaatattagagaataattttatatattcttccaagcttctgtgtttaattctttaaaaaaattccaaaaagtaacccaaaagtttgttggaatgtatagcttatatgtaccaattttggcatttattttgcattcagtagccaggatgagtttgtaacacataactgaaaaaaggcttgtatacacaatatataaggaaatcatataaaccaataagaagaatagaattatccaatagaaagaaaatggatcagaacacttgagcagaccatttcacaaaaatatctatatggccaatattaaaaggtactcaacattcttattcatctgggaaatagacattaaaaccacaatgagatattattatattcttttcagaatggttaaaatgaaaaagactgacaataccaagtgctggtgaggatgtgaaggatgtgaaactgttagtgggagtgtaaattggtgcaaccacttaggaaacactcgttggcagtatctactaaagcatgtaactgacatgtaacctaaggcctagcaattccactcttaggtataatcttatggaaatgcatacatatgttccccaaaagacaaatattagaatgttcacaatagtattatttataggagtggcaagctgaaaaatacccaaatagtaatcaaataaggaagtattcaaattgtgatctattcacacaatggaatactataaaacaatgaaaaagaatgaactattgctatagacaacaatatgatacaatctcacaaacataatttgggcaaaagaacccagctaccaaagaaatacactgtatgatttcatttatataaagtttaaagtccagcaaaatgaatctctggtttaggaaatcaagacaggggttacacatggggaagggatgggagaaaacacaatggggcttttggtgataataattatgtttcatttcttgacctcgatggagaacacataaatgaaaatttaataagttgtacaactaagatttcagtgcttttctctttgcgtgttgtactataatacaaaagtaaattttaaagcatactctattctaatttagtaatataaaagtaactaaaaattcataacctttcctaaactagggtaactcttttctcacccgctagttttatctccagaaacatagtaagtggctctgagtttgaatatgtaaaagggaatgaggaaggtgggagccagagtattctgcaaaaataaacctttttttttcctctaaaaaacagagaacgtataagaaaatccaatttttatcttagaaaaataacattctaagtaaaataccattgtcatttaaaacttatagacttcttttatatagggaaaccctctgaacttccctttaatgacattttccttgaaaggaaagttaagtcggtaacccacaaggaagcttgtgtgtcgtgttataaatactttagcagcccttggaaaactgtttccagctcattgagatcacctgtaagaaactgataaagtatgggccatgcgtggtggctcacgcctgtaatcccagcactttgggaggccgaggcgggtggatcacgaggtcaggagatggagaccatcctggctaacatggtgaaaccctgtctctactaaaaatacaaaaaattagccgggcatggtagcaggcacctgtagtcccagctacttgggaggctgagtcaggagaatggcgtgaacccaggaggtggagcttgcagtgagccgagatcgtgccactgcactccagcctgggtgaaagagcgagactccatttcaaaaaaagaaaaaaaaaaagaaatcaataaagtatgaatagtggctaatttactcttgcgactggtagaagttttatatcttgatatccccccaaaataaaatacaaactatagccaagatgcagttgtgataatgccaataaacctatagtttttgactgcaagggagttaataatctcttctgaagactcatagcagtcttgataaaaaggaattatttaaaaattgctattttatgtttgctcaagattaaaggcgtataagtaaggactacccatgtagctgctgggcaaagatataataccatagggcattcctttctttctttctttctttctttctttttttttacagagggatcttgctcttccacccattctggagtgcagtggtgtgatcataattcatggcagcctcaaactcctgacctgaaacaatcctccagcctccgcatcctcagtatctaagactacagatgggtgctaccatgcctagctaacactgtagggcatttctaaggaaatgataaaacttttctcagtatccttggttttgcatgctagcataatctaggtgatcaaaaagaaaggtttgaagctgagcaaggaaagtaacagctaaagggaaagacagagatttacaggaattcagaaaaatgtcataggtagattaagaggtgttgtgattgaaagatccacgatgtcattgtgcaatgtaagataaaatcatgtagtaacttcattttaaacctacagcataaacattgatgttctgctacattctacacataccgcttaatgatgatgattcataagaacagctaatctatgggtgaacacattgttcaattcacagttgtctttaagtgccttctaggtatgtgtgagggctccacattaggtgttatggaaatactcagataaagatgattggttagtgtccccacagagtttgtagaactagtggcacaacagaaaaacacacagattattaaggtaaagtaaaatgtaaatactttcaagagtcaccaggaaagtattacagagagtgctccttcctctctcaaaaggaaaaatgagagattgaataatccaaataagaacaggatgaatgagggagatggatttgacctgggccggtactatagttttgcaaagtttgtgcataggaatactagatattgggcacaacagtgggaaagctcagggcatttgggaaaaatattttagttattgttccatctttattatcaactacaatagtttgttggttatatttgaaagctactaagatcactgtaaacattaactgtctctcgttacaattactctacagtgagccttgttttattcagccagcaagaatttcatggttactgactgccgtctgtggttctccccagggaaggaagttataaaatagacaactattagagaatcatgtaattttaaaaatccagagcaagttacaagtcagtacagatttggcacaatcttctacatctcttgtctctgtaacacctgcccaaggattggtgttcagaatgatgttcttgagataattgtgtgctcctccaccaaagactcaagtacctaacttaatatatattctcagggacatattttataaatattttagcaaaggtctaagcaaaataagtattccgatgaacttatagaaaataaaatgatccagaacatgtcatttccaaatatgcttcctagcaacaattcaatgttgtcacagagtgaaccatcagctacatcttaattcagcataataggagacttgaggttcattttagagaagtggagcattaagagccaattaaatttcttggtattcactaacagtttggttaaggcgagcactttacatgtattcactcacttcatcttttcatcagtcctatgaagaagtactaccatcatccctattttagagatggaaaagttgaagcttggagaggttaaatattgtccaaggtcaacagagagccaaaatccaaaaccaaatttgtctgactttaaaaggcactgtattttactacagtcattgctttcagaacttttttccttagatgttcatgctttccaaagacatggacccaaatgcccattaatcacagactggataaagaaaatgtgatacatatacactatagaatattatgcagccataaaaaggaatgagttcatgtcctttgcaggaacatggatggagctggaagccattatcctcagcaaactaatgcaggaacagaaaatcaaacactgcatgttctcacttataagtgagagatgaatgatgagaacacatggacacatggaggggaacaacacacactggggcctgtcacgggggcaggggaagggagagcatcaggaagaatagctactggatgctgggcttaatacttaggtgatgggttgatccgtgcagcaaaccatgatggcacaagtttacctatgtaacaaacctgcacatcctgcacatgtacccctgaacttaaaagttgaagaagaaaaaaaaaagatgctcatgctttccttatacttttatgttacttttccaaccacagggctctcagacccaatcatttggtaatatagttcaaccatattgaagtggaagtttttcccatatgcattttaaataatttgttcacaatttattgagcacatatgatgtgccaagcaccacatatgcattaacccttctgctcctcatagcaacttctgagggtggtagtgtaattactaccattttacacaggaaaaatctggcctccatgactccacgcttggccttcgttcactgtctccatcagtgcattggcctcctcaatttattctatagggccctctacgcattcctggttaactactggatggtctcagagctcagtccttgggcctctctcttctctgtctaagctttctcccctacgtatctcatctagccttgcaatataagtgatgatgacttaaaaatttatatcttctgctctgacctgtgtactgaactccccccaaaatactcaactttcaactcatacctccacttacatgattgacaggcatctcagacttagcatatccaaaattgaactcttaatttttcttcaaacttatttttctcagtcttccttatttcaaaaaaattgtccttaaaatgtcaacacagactaaattaaactttatttaataaaactgatagtttcaatagctttcctaaacagaccactgaatttgctaaagtttatcatttgagatttactgaataaatatatctgactccagggttgaggtattgatatctatattgtacacacatacaccacacacacacactttctaagaaataatttgtgtacttgtaatagtatgtaaataaatcaaagtattattaatgaaagtaaaaccaaagccataagcatgtctcactggcaatgaaaaggtgctccacattgttattcatccaggaaatgtatatcaaacttaaaatgagatactaccacatgctgatcagaatggttagaatgaaacaggcagagaatactgatatggtttggctgtgtccccatccaaatctcatcttgaattgtagctctcacaattcccacgtgttgtgggaagggcatggtgggaggtaattgaatcatggtggtgggtctttcccatgctattctcgtgatagtgaataagtctcatgagatctgatggttttataaaggagagtttccctgcacaagttctcttctcctgtctgctgccatgggaaatgttcctttcaccttctgccatgattgtgaagcctccccagccatgtggaactgtgagtccgttaaacctctttcttttgtaaattgcctagtcttgagtatgtctttatcagcagcatgaaaatggactaatacaaataccaagcactagtgaggatgtgaagcaaaggaaactctcatatactattagtgggaatataatatttaacacttaattgtgtcttaaaatggcacctattattttctttgtcaatcccacatcatctactttgggaaattgctatttctctggcttattctgtttgggccattcaacatatgttcttgccttccataccacagttgtagagtgcactatatccctggacacagtgctcagtatagtgatcagcatttgccccaagctaaatcattaagagtcttttagaggagatcagtcttgtttctttttctggcatcacaaactctcaaaataatgtagacttttgggtggtaggaccatcttgccatgacataggagagcctttctcaggcaaggagaactgagagacaaaactcctatgacattattaaacttgtttctaaagccaggatatatcttgggcttttaaggctaataaattccctccttaggctagttgatatagtttggctttgtgttcctacccaaatctcctcttgaattgtaatcccacatgttgctggagggacctggtgggaggtgattggatcatgggagcagttttctcccatgctgttctcatgatagtgagtgagttctcacaagatctgatggtttaaaagtgcgtggtgcttcctctttctctctcttgtcacaatgtaagatgtgccttgcttctccatgattgttaagtttcctgaggcctccccagccatgcagacttgtgggtcaattaaacctcttttctttataaattacccagtcttaggtagttctttagagcagtgtgaaaacggactaacacagaaaattggtattgagagaaatggggcactgctataaagatactcgaaaatgtggaagtgactttggaactcgataacaggcagaggttggaacagtttggagggctcagaagaagatagaagatgtgggaaagtttggaaattcctagagacttgttgaatggttttgaccaaaatgctgatagtgacatgtacatataccactgaactattgttccttatctaatttaagatcttaagtttttaactgaaattgttgtatctatttagctttatctaagagtgatagaaagctattacaatggaagtccataaataactttgaagggaaataaacaactgagaaaagtttttatgaaaaacagatgactaatgcctttaatatataaatagttaatacaagccaataaacaaaaaactaaaagcacctccaactgaaaaatgaataaaggacataaatgacaacagaaaatgaaaatgaccatatgaaaaaatacttacctgcactataaattttttgagttaaattaaaatataatgcaatgtttacctaacaaatcagatatattaaaaatgataatattcaatattgacaaaccctgatgagatgtacacttaaagcattgctggtagtaatataaaatagtgcaacttttctggaagacaattggaattatgtatgaaatatatttaacacattgtctaaatgaaatgagaaatacagacaaacatttaggtagaaagatattctttttagttatttataatagcaatctactgggaaatggttaagtaaatatagaatttatttttgggtgtaatatgaagtaggaatttaattttccccaagtggctaattgtcccagcatcatttacttattagttgaacatttcttcactgatgtttgactatacctctggttccatatggacagtggtctgtttcaggcattttatcctcttctactggtctctttattatcccatgttaatatcagatagacttaaggccacaattttagaatgagtcttgatattgggtagaacaatattctctgtcttcagattgtttcaaaaatattttgactatttttccctgcttccttttctaacttcatgtacattttagaaacagcttattcgggtaacctcaaagatgctttttttgcgattttaaatagaattaaatttgttgatacatttgggagaaatgacatattttagctattaaagcttcccctccaagatcataatataggtctttatgtatttaagtattcttttatgcatctgtatatgcatatgcatatctatatctataatgggttcatgtaacttctataaggtttattccttttggaaccttataattttattgctattataaaggataccttaaaattttaactttctgttttggctgatatacagaaaggaaactgattttttgtataatgatcttatattcagcaaccttgaggaactcttaaaatgagtttccttcctgatggcccactttctcctataaggagctgactaggaactctagggtgtgaaaactgtcaggtttcattcagaatgtgagagtgagttgcaaagaaggcaaacaggtagggacaccccattccctcctgaccctggcaatagtgaaacttggagggctcttccctaaaatggtatctatcccagtggatgagaccttgtctctctgatgtggaatgctgcagccttacagagactattgtcttcagtctgggagctggttccttctaagcctttgggttttaacctgttacctcttcactgactgctctatttaaatcacctgccaaccctcacctgtgcctgcccttattccctattacagaatactgttcttgtcctttatggcaacgatcacactttatgagtttatttgtttggtaatattcttgtttactgtctgtttttcctatccattgcaagcttcataagagcagggaccaggtctattttgttcaccttcttcctggtccctgccatttagttcaataaatgtttgtagactgaatacatgagttagatgtcaaatacctgcttcaatttttaatgttaacaatccacttgtctcatcatttaaaatataccctacttatgtaatctgattttatcttcataattgtctttaaaatagggatgctagtccccatttgacaaataaggcacagggaaatcaaatcatgtgctccaaattaatatctagaaattagtagagttgaaaacagaacccaaatcatctaactcaacatctaattaaaataaaacatataacaaaaagaagagagaaagaaaggaaggaaggaaggatggagagaagaaaggagagaggaaaaaagcaaggtggaaagtaagggaggcgatattcatttgtgaactttccatgtcaagggcataccacatcatttatccttctaaaaactccttaagtttcatactttcccattaggaaacctcatagtctccagacatttcaggccagcagacagattaagaatagtcttgtatgacattgttatatatgagtcatacagtgtgagaaataaaggagtatgcagttatagagtaagcctctttttctcagctacatttcacaacataaaactagctggtaaagtcaggtcacctaatcgagtctgataattgtaaggtttactcacagcatgatttaagtttcaatttcaagttccaattcattctcttataatttttctgccttagtcaacattacacaagacgttggctctcttaacatttaagatccacatgagaatatcttgtcggttttactataggtatgagtgtagaaatagtttctttctagtagaatcataatttaaaaaaagaaaactgcactcaagtttttattttaatcaatgatactacatctcctttatttttcttatccctaaatctgattgtgaaataaatggtcgtttctattattttgattagctggctttgtactgtgaagttacaagaaggaaaggaatcacctactgctgtcagtctctatgtaataataaaaaaaaaaagtaccagtccttaagttaataatactatttttgtgatttggaggggaaaaaacactttgctgccaaagggtaatccacatagaagagctgattgctaggtgaaacactgacagaatgagactctattatggaacctattgacatgagaactctacatcactgtaaagtacagccactcacatattcctgaactcaaacagagtaaaatgatatagtatttatgaattctgtctgctccaggagggcatgacaatacatacttaatccaacatggtttatcagggacagacagtgacgttctggtgcttagagatcacaccctcaggaccccaacatacccattactgagacatcatattctatcagcagtgctgcttcttgtccacattgtttaagaatactcatggcttcagcatgcgtagttccaagaagccgaattccatccacactgagcaacctgtcaccgggtttgatcgtgccctctctgaagggagaataaaggaatagtcttgattaatttagcataatggggcttagtattaatagtcactttagccaaattcgttttgtcacacatattctgccatccatctcatttgcattctttttaagcatcaaatgtgacagtaagagtataaagaagtaaccctgaacagaaaattgctgtaatatgaaaatcagtaatgagaaaataactacacattagcaaaaaaacctaattacccacaggtaattcttggagtacaaaagtaagaagggcacattttccctttttctaggtttttgcctgaatgtctaaaatggatttattggaggccagaaaatactattcacctattttcccaaagtcaggtaagcagaaaagcctgcgaatttcattcaaatcattactagtgaatccaagcaggataggaactgctggtaagaaatctcccttgtctataaatttccctactgatttataaggccatttggcaataattcaattgattcgatctcacattccctggaagaggaaggcaaatgctatcctccctgctgtgaccacagacactcaaggcattgagagatgactcaggacttcagtgacaccacaaaagtacagccagggtggcccccagataacactccctgcctcagggaggggcacaaaaataagaaaatcaaatggtgggattatatgtttaggatttggaaagaataataatgacctttgaaataaaaatgtttcacctagttcactctctaagtcttttggctccaatttttttcttaaattctcagatttctttgagttctaaattaatttggtaatacaagtatgccactcacaagctcgtagcctatgttttgacatttctgtcaactccaactctaaatgttaataagaaatgaaaacattctaatttgcttcaggaagagtgattcactagacacatgagaagggaaaaggggaaactcttggacattttgttacccgctgcaaaagcaaatatacgtcagcaaaagtaagaaaccagtgttttcctattttctaattttatatgaaatatcactttcttaaaagtgagctaatcatatgagtttcaaaggaaaagaagcctgaattcctcccgcagttctttgacttactcactgccatactggcagttctgtcatctgtaaatgtggatacaaagacctcatgtagagggtggttgtaaggataaaataagataatgtccaccaagccctcagaacagtccctagcacgtagtaaatgcttaataaataatggttattattattattatctctatctcttaacaaaggtttttaagtttatcctggtctgaaacagagagacaggaggaatcagtgcattttcctcctccccttcaacaatctctaatggcagcagttgtgttcccccatcattatagagtcaacttttgctgtgggaaactaatacagagatgagtatctccagagacacctaagttgtgagtttactcggggccctaattataacaggaaagttgaaggcatttgcccttcacatattcaaattaacaaggaagagaaatgcaaagaaaactctacagactaatgaaatgtcttccattttacggaaagtcacttccattctgacctacacagtcactatcaaagaataacactaataataagaatgttgagaatggtaagaatctcaccaccaccacctatctgtccaggctgggagattagcaacaggcgaagatgcatttccagcatctgcctaaatgctgagttctgtaagtacctcccctgtgccatgccccctgcaaggcattatatatctccaatctttgataaaactgatcagctctgaaaggtggtattattacctacatttccaatggtggtggaaattgacctcagtattaagtcacttgacaaagatatagtaagtatagaatctagaggcaaaccttttttttttctgattccatagttcagactctcaattttcacattgtaacatgtttgcttaatagctacattttactgtaaaatttctaatttatcaacttctatgttaaagtccccagctttatttattctattttggatagtgacacagaaagataaagtttacctgtcagcaggccctccaggacgaacacatgttatcacaactggacgagatttatttctatcatcatgtgctccccctagcaaagaaaaggaacagagcttaaaactgctttcattgttggcatttaaaaaaaatcacctacaagatatcagctgagaaatgtcctacttgatgtacggaggaaaatatgtaaaattttccttgaggcatacaaaagccttaaaggtcttgctcattttatatagaatatatttttgaagtcaccatttctccatctttcaataaatatatggctgtaaccaggtaatatataaagtatttaacaactggaatggcaagagaatcaaccgattatatcaagtactggcccgatttgaacagctgtcagttatacagtacagatgtgtatatctgtgccaatcaaactgatctaaaatactggtcagtaggtctacaacctaacataaaggaaacaaaaaccaaagtaaaagaaaaatcctagtactaaaaaagaaagccaaaaaaaaaaattcaagtgaccaagtggctttcattaaaagtgagatgttcaaaaatttggggcaaaattttcagactgtgtcaagccagctgcaatccttgaatgggaattttaactttctgttagaaaacttctccacaagaattcatagaaacatagatgtttcaagatggaaggtaatttattgtaaattttctttttaatccatgacccttttgtacaatttccttaatctgtgctcccccagcgtctgcatgaaatgcacgcgtgctggcctacttactagatgtgaggctgctcactccacatttggacaccaaggagtgttagaaagttcttcctaatatttaactgatatctcttttcctttaactttcatccactcgtctttgttctatgatccagagcagtaaaataaaaatgtatgctctcttttacaaaaatgcttttccgaaagttgaaaacagagattatacgctggctaaatctcaccttcttaatgttgaacaatgccagtttccttatctattctttatgtgacctgatttctttgcacatcaccatcctgactgtccatctgggagttttctagtttgccaatatctgataaatataaacctattgtcaattattgctcccttaatgtttgcctgctagaacagatggacatttcccaaacctggcataggccgaaaggtcaacttatagaaaatagcctaagagaaaaattaaaaggcattcacagttcctcaggaaggcaaatgcttcttttgtgctcacttctacgacaagtgatttgtttagtgtgattgattggtaaaagctctcattcagtattttattcttgcattgtgtttagcttctttagaaattcctctttaaaataagaaattcaccactttctcagaaaaaaattttaaaataaaaattttaaatgttaccacaaatgcttgcccatatttatgtaaatactgttacataatttctcttttgcaaggtgatcataaaggataggtttgcttttccctaaaggaaaactgattgagaaaaggatgggggtcaaagatagcaagaaatcgttccataattttggtttgtatttacaaatttcaatatgtaatatcgaatgcttgttaaagtgtgaggtagttttatatttcttgatatgtggcattttactgttatttgtaatgaaccaagttccctgtgtgacttacttaggttctggaagtttgcagcagcaaggccaaacaggaaccactcagagaccagtgatattctcaatcctggtgtacattagtatcaactgggatgctttttgaaaatatcaatgccagggccacagtgcagaccaaatctgaacatcaagcagcatatgttaaatgactaggcccacctacaattttacatttgagaattactagagaaggtttccttgtctaaagtgtaaagcaacttcatggcagagtgcctttcctatcagtccaactcatctcttctggcttgcttgcattaactgaaatttaaccctccaaggtttaggccagaacatcatttttattctatggatgcaagcttctattgtttagggaataaaggttttagaacctgtgacttatagcattagaaatataattccattcatcagctaaaagcttaatgttgcaagttccattctattaggttagaacttctcccatactaaacagatatgctccatctgcaatatcttctctttcctgactgtcctagtattttctattgatctaagtttagctcaactcccatctatgccaaaatatcttatctgccatactaatatttactcacagcactttctcattctgattaaccagtgattcttaagtgatgggtagtgaccaccttttgaacagggaaaatcctccagatggacctctaactaatctaaaaacagaaatcctatatttgattctcattgagaaattattcaaaactccaaaaacttttatgttcaaccaacatattaagggagttattaaggcctataaaaatgcggtcctcataaactaatactggcttattgtaacttaagttttttaaaatcagtataatactatgaagtctgatgtccacacaaatctaggcaacattcaatcattcacttattaagtgcctccacataccaggcagtattctaagctcacattataaaactcctggatatacacacagatagtggaaattcctgcaaactgtgggaagggtgttttactaacattacatcatcagttgtcttgaggtggttgtgcatttcagttgcttctattctgtttatttcttgataataaattactcttggtttagctctttcattagtaatttgattcgctattgactaaccatacagtcactatcaatgaatatctgcaacagcagtatattttggtacagtgtttcaataattaggctatgtatgcatgtgattcaagaaccttctcgttcagatctgtattgcaaaacagatttgtatatatcacccttcagccaaaaattacttgtacagtgacttttcactatattcatctagttattttaaacagaaatttaggaatggttagggtaaatgatcttgggctctgttgctccacctaaaaataggccttggtcagaaaaatgtaataactacaagtctaaacctctcaatgagttcctagttccacatcctctctactactcacttgagcactctatcaacttttgtcttaaattcactggactgtaattccttgtagatcaaggtattgtcttatgactccatagtacttctttccatgctgacatgttgacatgtgcttaataaacatttgattgattgatttgttaagtgactggcacaaaatgaaagctactatttaaaactcaatcacttaagacaaatccaaatctgtacaagtttatccacatctcttttattctttgatgcatacatatttattaagatgtttaattttaattaatgttttaataattttgatagaatttttactctggtgaagtataaaatcttataggtgaagacaaaaacaatcaagaaatgtgaactgttaaaacattcctggtggagccaagtggccaaataggaacagctccagtctacagctcccagcgtgagtgacgcagaagacgggtgatttctgcatttccatctgaggtaccaggttcatctcactagggagtgccagacagtgggtgcaggacagtgggtgcagcgcaccgggcgcgagccaaagcagggtgaggcaatgcctcactcgggaagtgcaaggggtcagggagttccctttcctagtcaaagaaaggggtgacagacggcacctggaaaatcgggtcactcccaccctaatactgagcttttccaacgggcttaaaaaacagcacaccaggagattatatcccgtacctggcttggagggtcctacgcccatggagtctcgctgattgctagcacagcagtctgagatcaaactgcaaggcggcagtgaggctgggggagggtgcctgccattgcccaggattgattaggtaaacaaagcagctgggaagctcaaactgggcggagcccaccacagctcaaggaggcctgcctgcctctgtaggatccacctctcggggcagggcacagacaaacaaaaagacagcagtaacctctgcagacttaaatgtccctgtctgacagctttgaagagagtagtggttctcccagcatgcagctgtagatctgagaacaggcaaactgcctcctcaagtgggtccctgacccccgagcagactaactgggaggcacccccaaataggggcagactgacacctcacacggccgggtactcctcttagacaaaacttccagaggaacgatcaggcagcagcatttgcggatcaccaatatccgctgttctacagccactgctgttctacagccaccgctgttctgcggccaccgctgctgatacccaggcaaacagggtttggagcggacctctagcaaactccaacagacctgcagctgagggtcctgtctgttagaaggaaaactaacaaagagaaaggacatccacaccaaaaacacatctgtacgtcaccatcatcaaagaccaaaagtagataaaaccacaaagatggggaaaaaacagagcagaaaaactggaaactctaaaaagcagagtgcctctcctcttccaaaggaacgcagctcctcaccagcaatggaacagagctggatggagaatgacaagttgagagaagaagacttcagacgatcaaactactctgaactacaggaggaaattcaaaccaatggcaaagaagttaaaaactttgaaaaaaaattagacgaatggatacctagaataaccaatgcagagaagtccttaaaggagctgatggagctgaaagccaaggcttgagaactatgtgaagaatgcagaagcctcaggagccgatgcgctcaactggaagaaagagtatcagtgatggaagatgaaatgaatgaaatgaagcaagaagggaaattcagagaaaaaagaataaaaagaaacaaacaaagcctccaagaaatatgggactatgtgaaaagaccaaatctacgtctgactggtgtacctgaaagtgatggggagaatggaatcaagtgggaaaacactctgcaggatattatccaggagaacttccccaatctagcaaggcaggccaacattcagattcaggaaatacagagaacaccacaaagatactcctcgagaagagcaactccaagacacataattgtcagattcaccaaagttgaaatgaaggaaaaaatgttaaaggcagccagagagaaaggtcgggttacccacaaagggaagcccatcagattaacagctgatctcttggcagaagctctacaagccagaagagagtgggggccaatattcaacattcttaaagaaaataattttcaacccagaatttcatatccagccaaactaagcttcataagtgaaggagaaataaaatactttacagacaagcaaatgctgagagattttgtcaccaccaggcctgccctaaaagaactcctgaaggaagcactaaacatggaaaggaacaactggtaccagccgctgcaaaaacatgccaaaatgtaaagaccatcgagactaggaagaaactgcatcaactaacgagcaaaatcaccagctaacatcataatgacaggaccaaattcacacataacaatttaactttaaatgtaaatgggctaaaagctccaattagaagacacagactggcaaattggataaagagtcaagacccatcagtgtgctgtattcaggaaacccatctcacatgcagagacacacataggctcaaaataaagggatggaggaagatctaccaagcaaacagaaaacaaaaaaaggcaggggttgcaatcctagtctctgattaaacagactttaaaccaacaaagatcaaaagagacaaagaaggccattacataatggtaaagggatcaattcaacaagaagagctaactatcctaaatatatatacacccaatacaggagcacccagattcataaagcaagtccttagtgacctacaaagagacttagactcccacacaataataatgggagacttaacaccccactgtcaacattagacagatcaacgagacagaaagttaacaaggatacccaggaattgaactcagctctgcaccaagtggacctaatagacatctacagaactctccaccccaaatcaacagaatatacatttttttcagcaccacactgcacctattccaaaattgaccacatagttggaagtaaagcacccctcagcaaatgtaaaagaacacaaattataacaaactgtccctcagactacagtgcaatcaaactagaactcaggattaagaaactcactcaaaaccactcaactacatggaaactgaacaacctgctcctgaatgactactgggtacataacgaaatgaaggcagaaacaaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgacggaaatagagacacaaaaaactcttcaaaaaaattaatgaatccaggagctggttttttgaaaagatcaacaaaattgatagaccactagcaagactaataaagaagaatagagagaagaatcaaatagatgcaataaaaaatgataaaggggatatcaccactgatcccaaagaaatacaaactaccatcagagaatactacaaatacctctacgcaaataaactagaaaatctagaagaaatggatacattcctcgacacatacaccctcccaagactaaaccaggaagaagttgaatctctgaatagaccaataacaggctctgaaattgtggcaataatcagtagcttaccaaccaaaaaaagtccaggaacagatgaattcacagccgaattctaccaaagctacaaggaggagctggtgccattccttctgaaattattccaatcaatagaaaaagagggaatcctccctaactcaatttatgaggtttgcattatcctgataccaaagcctggcagagacacaaccaaaaaagagaattttagaccaatatgcttgatgaacattgatgcaaaaatcctcaataaaatactggcaaaccaaatccagcagcacatcaaaaagcttatccaccatgatcaagtgggcttcatccctgggatgcaaggctggttgaatctacacaaatcaataaatgtaatccagcatataaacagaaccaaagacaaaaaccacatgattatctcaatagatgcagaaaaggcctttgacaaaattcaacaacacttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctctcaccactcctattaaacgtagtgttggaagttctggccagggcaattaggcaggagaaggaaataaagggtattcaattaggaaaagaggaagtcaaattgtccctgtttgcagatgatgtgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagttaactcccattcacaattgcttcaaagagaataaaatacctaggaatccaacttacaagggttgtgaaggacctcttcaaggagaactacaaaccactgctcaatgaaataaaagaggatacaaacaaatggaagaacattccatactcatcgataggaagaatcaacgtgaaaatggccatactgcccaaggtaatttatagattcaatgccatccccaacaagctaccaatgactttcttcacagaattggaaaaaactactttaaagttcatatggaaccaaaaaagagcctgcattgccaagtcaatcctaagccaaaaaaacaaagctggaggcatcaagctacctgacttcaaactatactacaaggctacagtaaccaaaacagcatggtactggtacaaaaacacagatatagatcaatggaacagaacagagccctcagaaataatgctgcatgtctacaaccatctgatctttgacaaacctgactaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaacaataaaaaccctagaagaaaacctaggcaatatcattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagagaatttttgcaatctactcatctgacaaagagctaatatccagaatctacaatgaactcaaacaaatttacaagaaaaaaacaaccccatcaaaaagtgggtgaaggatatgaacagacacttctcaaaagaagacatttacgcagccaaaaaacacatgaagaaatgctcatcatcactggccatcagagaaatgcaaatcaaaaccagaaggagataccatctcataccagttagaatggcgatcattaaaaagtcaggtaacaacaggtgctggagaggatgtggagaaataggaacatttttacactgttggtgggactgtaaactagttcaaccattgtggaagtcagtgtggcgattcctcagggatctagaactagaaataccatttgacctagccatcccattactgggtatatacccaaaggattataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccataaaaaatgatgagttcatgtcctttatagggacatggatgaaactggaaaccatcattctcagcaaactatcgcaaggacaaaaaaccaaacactgcatgttctcactcataggtgggaattgaacaatgagaacatggacacaggaaggggaacatcacactccggggagtgttgtggggtgtggggatgggggagggatagcattaggagatatacctaatgctaaatgacaagttaatggatgcagcacaccaacatggcacatgtatacatatgtaacaaacctgtacattgtgcacatgtaccctaaaacttaaagtataataataacaaaattaaaaaaaaatttctgactgtggaaaaccaaatactgcatgttctcacttataagtgggtgctaagcattgagtacacatggacacaaagaagggaacaacagacactgaggcctatttgagggtggaggttggagggtgggaggaggaggaggatgaggattgaaaaactgattgagtatgatgatgattacttggatgacaaaattatctgtaccccaagcccccatgacatgcaattcccccatgtaacaaacctgaacatgtaccccttgaacctaagatagaagttggaaagaaaaaaaatccctgatgtttatatagctccctattgaagctcattgtcatcctatgagttgagagttgttaatgtaggcacagtctttaaggaataaaattactaatgagaaaatataatgcaagatagaattatactttagaattagtaggttttttttttttttttttgagatggagtctggctctatcacccaggctggagtgcagtggcacgatctgggctcactgcaagctccacctcccgggttcacaccattctcctgcctcagcctcctgagtagctgggactacaggcgcctgccaccacgcccggctaatgtttttgtattttttcagtagagatggggtttcaccgtgttagccaggatggtctcgatctcctgacctcattatctgcctgcctcggcctcccaaagtgctgggattacaggcgtgagtcactgtgcccggcctagaattagtagttttatgataagttggagtcacctgaaattgttattatcaatgccatactataatatgatgacttgagctgaagcacatagatacccaagagattagaatcttcgatccatttttagaaagctacaataaccaaatgtgtttctggagaaatttatttaaataaagtcccttaatcctagtgtattaaatcaaatcaagcatactaatcaacatttttcagtgatatcgaaaaatataaaaggaaagacaaaagacatgttgaaaagtataggatgactgaattgacaaggtttataaacattggctttttgctctgtattaatgaaccaaaaatagagctacatatggtttccagttttattatcattcaatgttgcgtttatttaaagaagagaagatttttctaacccagagagtgagagaaaatctttacaaccaatacatccaacaaaggactaatatccagaatctgtagggaactcaaagaaattagcaagaaaaaaccaaacaatcccatcaaaaagtgggctaaggacatgaatagacaattctcaaaagaagatataaaaatggccaacaaacatatgaaaaaatgctcaacatcactaatgatcagggaaatgcaaatcaaaaccacaatgtggtaccaccttattcctgcaagagtggccataatcaaaaaataaaaaaaaaaatgttgacgtggatgcagtgaaaagggaacacttctacactgctggagggaatgtaaactagtacaaccactatagaaaacagtgtggggatccttaaagaacaaaaagtagaactatcatttgatccagcaattccacaactggatatctaccagaggaaaagaagtcataatacaaaaaagatacttgcacatgcatatttacagcagcacgatttgcaattgcaaaaatatggaaccagcccaaatacccatcaatcaactagtggataaagaaactggtatacatatacaatagaatactactcagccataaaaaggaatgaattaatggaatttgcagcaatctggatggaattggagaccattattttaagtgaagtaactcaggaaaggaaaatcaaatatcgtatgttctcactcgtaagtaggagctaagctatgagaatgcaaaggcataagaaagatacaagggactttcaggactcggggaaagggggagggggctgaggaataaaaggctacaaattgggttcagtgtatactgctcgggtcgtgggtgcaccaaaatctcacaaatcaccactaaataacttattcatgtaaccaaatacccaaataccacctgttctctgaaaacctatggaaatattttttttaaagtagatttttctaaccaacacctacctcgaattacaaaaccaaaggtattgccttctttatgtaatgtgacctccactgttcggaaaataacacttgatccttgcacagctgaataaaggaaagagagaaggaaatataacttgtaagtcatcataacatttctaaatcattcaatgtggcataaaatattacagatccctgttgcaaataagttttgagtaataagcaacaattccttttcaaagaaaatgtttaaaaaactgtaatgacataaaaataccataaaacagtcatctgtataagtgactcatatagatacaagtggaaacaaaatcatagctagctcatttccttctatatagttcgtttctagataagagggggatatttacattgtttaaactctacctaacaagagagacaatatttatataagtagaattgttttccttttgtaaaatgcaaaaacaatatttttgtaacacttgtacaataacttctgtatttatttttattttgcagctggcacaggaagaaaaattatcattctcagattgctatcaacaattaggctgatgctaatagatgttctgacatataaatagctattaaactaagacacagcaacccagatgaaacttagagggcaaaagaaattctaagtgcatttaaaatactactactatctaagaaactacagattgacttaattttacttgatatattatgcttatgttgtgtttgcatgattatcactttcatttaacaaaatggaattgtattgtcaagctgcaatctctagtcacattacatacatgtatgatggtataaggtatatgaaggtacatttactaaaatattctgtaagattgcttacaagaacctgttgagtcattctagttgtactatatacaccatttctgcataaaaaaacccataaaacttccacaaactggtattttatcattatgcacagagaaatgtttttattcatagagacttgtaatgtgtaggagaattttagatctttattttgaatttgtacctagttaataccatgttcattaccaagtaacacatttttttacattgctactagatcctgaagggtttattagataaaactatcagcaaaaagtatacagtcaggccaggcgcggtggctcacgcctgtaatcccagcactttgggatgccaaggcgggtggatcacaaggtcaggaattcaaggccagcctggctaagatcgtgaaacctcatctctactaaaaatgcaaaaatcagctgggcgtggtggaagatgcctgtaatcccagctactttggaggctgaggcaggagaatcacttgaacccgcgggggcggaggttgcagtgagctgagatcgtgccactgcactccagcctgggtgacagagtgagactctgtctcaaaaaaaaaaaaaaaaaatatatatatatatatatatatatatatatatatatatatatatatatatacacacacacacacatacatatacatatatacatatatatacacacacaggcagaatccaaaggcattgtttaaaaaaacttttcttacagaaatagcaagtagttttaggctttaattacaattatttttaattatcagaaattctgaaccctcaagggaagaaacatgattaagaaaagtacacatttaaattcataaaactgtccactatctggctgggacataaagtacaataaaaatttggatcggctgaaaaacaacataaacctacagttcaaaaatgttttggtatactgctgatttaattaaatgtcatattcttgctatcaggggaatttcagcttagactaatcaactaggaacagtactcacaaacagatgaaagtgttgaggtacagttttaattaaacaaaaaaaattgagttcattccaaatattttcttatttccatggcccaacaagccacttgaagaaattggttaagaaaatgattttttttttgttctcttggtaagtgaggaaaggaaaggatatggaaagaaataattaataagaatttactgtgtgctcagaactctgcaaaaatggtttacacatattatttcatttactcaataaatcagctttcaatgacatataattgaattctaattctgggccacctgtcctttttggctgggtatctgttatgggaatgcaaagtactgcaattttgattttgctgtagctaaatcttgctgactataaaatcttacaatcaaatttaaagtcaatataaaggctctgtattttctacagctttagattatctacgctattgttctccatcatttacaaagataaatttgaatgttgactgcgttttaatacaattaatgaaatagatttggtctttcttgtttttatttgcatggctggctcttcatgattgggttttcacgtgcagtaccagacatcctgcattgccatgtaaattttactaatgactcatacatatgtatgtatacacaaagttccaattaaggtgcttacccaaaagatcaaaaagtaggtagaaaccaaattcacaatgcaaaaattctcctcggtctttcaattgtgctgttgtcccttctttctacatgtggatattcatgtacttctacacagttattttcctatggtagatgaggtttttgaaattacaaactccttccctgcctccctattccctgtctcaataggagttgtgaactttcctacctcattatgctgcacttgcccatgtgacttacttttgccactaggatgttaacagacacaagcagaggctggaattgcacttacatggttgtgcttgccctgttttccctctgccattgccacaagaagagcgtcctccaggtagctgctgctccctcaaactgaatcccagagtaaatcacatggaggagacctgagactctttctccctctctcctcctccacttcaccaccaccaccaccaccaccaccatcatctgtctattttagaactgagaagtcagaaggctgtcaaagggacatgctttaacacatttatttgagttaaaaatgactccttaggatagaaaggtcatgtgagttagctaatggagtaacagtgaagagtgcctttgccaatcagattatagggcagactgtttttcattaaatgaagtaaacctgtagctccaaggtttgcatgaaaacagaatctaaagacagataaaacaaacaatatgctaggaattgcatcctttctaactattcatgcttatgataattttaggtgttaactaaaaatggatgagaattatgtaacatttcaaaattctttaagagttaagtgaccaaaaaatttgaaggcactgctctagaccaaatttttatttttattatttatttatttttaattgagacagggtctttctatgttgcccagggtggtcttaaactcctgggctcaagggatcctcctgcctcagcctcccaaagtgctaggattacaggtgtaagccaccacagctggcctagaccagcttttaatacataaatatcaggccgggcgtggtggctcatgcctgtaatcccagcactttaggaggctgaggcaggtgatcacctgaggtcaggagtttgagaccagcctggtcaatgtggtaaaaccccatctctactacaaatataaaaattagccggacataatggtgggcacctgtaatcccagctactcaggaggctgaggcaggagaattgcttgaatctgagaggtggaggttgcagtgagccgagattgtgccactgcactccggcctgggtgacaagagcgaaactccatctcaaaacaaacaaacaaaaatacataaatatctaagatacaggttggtaatattctctctaaacacagtctcaaagaatcacataattttaaagtcagaaagagctttagagcttatatagaccaatcattttattttcataaagaaactgaatcttagaaagggccaaggtcaaaccagttttcttctatcagattacacacacacacacacacacactcacacacacacacacatacacacactctctctctctctctcttttctgattctttctgaactctgtggttagctgagactcaaactgctgtgatcctgagatagctaccagtcttggccttgggtcgcttgtcttttagcagtcagttctccttatggaccttcaggtgtggatggcctgtttctgctctagctgtctgagctaagtgaaaggggaacttattaattccttcaaccactctcaactcaagtatccgattactttcttcaaatatagtagaaagagacagattattcttggagaatagaccccttttgatttccgtcacaacaattcacacttttgtgtttaaaaatattttgccccttttccatcagctttattgtatgacagggaaaaagatggtactgcataatgaccaagtcacgataggttttaactcctaaacatttctgatactcatctcctttaactctactaatgctatttttatttaggatatcacttctcttttggaaaatcctaacagtctttgggcttgtagcctctggtcttttctctattttgcctcctacaatgataaatctaaatactcagatcttatgatgctgttctcctttaagggctcctcacggcccactggatgccaagctccaacaatatggcttataaggccatattatacactatttaaattctcatttggtcctcgtgtacctcattggcctcatctatctccaagccccctctttctttgtccctccttctccgtctttctccctctttctctcttcccttcctcccttccttccttctgtccattcttccttctctctctctctctttttgagatggagtcttgctctgttgcccaggctggagtgcagtggcataatctcggctcaccacaacctctgcctcccaggttcaagtgattctcctgcctcagcctcccaaatagctgggattactggcgcccaccaccatgcctggctaatttttgtgtttttagtagatacagggtttcaccatgttggccaggctggtctcgagctcctgaactcaagtgatccatctgccttggcctcccaaagtgctgggattacaggcatcagccaccacacctagccccctctctgtctttccctatctgtttgtagtttaactgtgggctgggctgtcatcttcccttcgcgctgcaccctttgtctgaaatattcctcttcccacctggctagcatgacctcctttaagtcttcctggaaacgcctagctctgaatcacccacaacactggacaaatcttcactattagcctttgcctaaaagctatacttagagtttcttttaggaaggggttgtgttttattgatattcatatccccagaggaatacagatgtataatcaaagagcattagctctagataactggtttctcttatgtctttggcaatggtttgagagagtaatttcaaagcaaactgactcatttaaagttaaaaaaaaaaacacagtactttcagtataataatgtaataatggtaataaggctaatgttattagttacttacaaagtgtttgataatggtctcaataatgatcatgtgattataacatttaatcattacaaaaatcctgcaactactatagctattttatagattagaaactgaaggctcagagaatttaaataacatgcccaaggtcacaaagacagaaatgagcaaagctgccatgtaactgctgacacagtctaagcctttacactctattttattgcctagtcttgctgaaaacgaaaaaatgttgtagcaaggtttgtgaacatagtcttaaattgattttgttacaaaatgactactaaatctttggtgttagactttatgtgaagaatacgaacttgtgactgattatgcacatgtttcctgagtactggaatctgatccccaagcttcgaacaccatctatattcccattactctcaaatgtatatttacagtacagatctttctctcaaactccaaatcatatcttcaggtcttgacatttcctcttgcatgtcaaataggcacctcaaatgtagtatttcaagccatgaactgctgatctttccctcacaaatcagctctgcccacattcttatccattcctgttaacggatactctgtccttccagctgctcatgctcaaaaccttggggttaactttgactcctctttttctgcacaactcacaaatccattaggtaatcctgtaggctctcccttcagaacagatctggaatctgactgcttttcactgtctccactgccatctctcacatggatcactgtaactgccctccagctcatctcccagcttctaccctggtctcttacagtctgttgtcaacacagcagccagagagcctctgaaaacaaatcacatcatgtcactcctctgccccaaaccatatagtgacttcctgtatcattcagagaaaaacttaaggtcctcccagtggcctatagtgataccccacccccttacatttctgaccccatttcctaattctcttactgctcattctgctatagccacactgtcctccttaatgtttctataacaaccgtaagtatattcctggcttttggtcttagcaatgactgttcattcttccgggaactcttttcccccagaaatccatacaaccaactccctcacctccttcacaagtcattgactaatctcacattctcaatgatgctgtcctaaccaccctatttgcaattgtattcccaccctgatcccagcactctcaatccctctccttgcactgctttttcgcatagcattcatagtattcatactgtataattatttattatggttttattttattatctgtcttctgctacaatataaactctactcatgttccccaagctcctagtacatagtggtggctggaacatagtaaatgctcaataagtcattgctgaacaaatgaattctaccaactcttcataatcaacctgagttctcattagtatggaagagcaaaaagctatctcagggtagcatccatgttcatagctaataataggagaggtggtgctagaacagcataaacactgggcagcagtcatatatcagtatacctcacaatgaatatgcatatggactttggagtctggcagcctggattcagatattgaatccaggctttgtaaaatgagaaaaaaaaatgcctatcttgtagtgttgattgcctttttattgaaaactttgatagtgccaggcactattctaaatgttttccaaatactaacttaattaatcctcataacaaatctatgagtaggaactaataatattcgcattttacagatgtggaaactaagacatagaaagtgtaagtaactttctcaaaggcatgtagctagtaaaatgtggagctgggatttgaacctgtctatttgatactaaagttcatctctgctatgctgacactccttgtggaaaggattaaataattcaatgcaagtcaagttctttgtaatgccagacatttggtacaatcaaaatctgttggctactgctgttataattactattattactacttgacaatatgtgttctgaagctattttcatgcttcagaaatggatatatcatatatatatatatatgtatacctactatgtacccacagaaattaaaaattaaaaaagaaattaatgtatccataaagaactaatataaaacatactaaatatgcttttcctaaacctagtcactaagtacaaaacctggatggtacttattgcacagaacttacaaacatgttgaattaaaatggcttaggtggcaaacagaacatgggcccttcataatttcattgttagtgatgcctttttaaattcttcctgagtaggttgtaagttttccaattcaaataatttttaaatactaagaaagttggctttgccattcctgtaatgagatattgatggcaaagggaaaaaattcagaagctgattttgctttggaaaaactggtgccgctgttcttcctctgcgttatgattatagcaattcctccttatctgcagttttattttctgtggtttcagttacctccaattaactgcagtctgaaaatattaagtagacaattccagaaataaaccatccctgttttaaattgtgtgctgttaggagtagtgtgatgataatctcacattgtctgctctatccatctggatgtctggcacattcacgctgtttacactacctgccttagtcactttgcagccatctttggtatcagattggctgttgtgttcttgctgtacttttttttttttttttttaaacagggttttgctctgtcacctaggctggagtgcaatgacacaatcatagctcactgcagcctcgaccttctgggctcaaggaatccttctgcctcagcctcccaagtagctgggactacaggcatatgccaccatgcccgactaatctttttttggtagaaacatggtctcattttgttgcccaggctggtcttcaactcctggcttcaagtgatcctcccgcctcagccttccaaagttctgggattacaggcatatgccaccatgcctagcccttgcagtacttgtgttcaaggaacccttattttacttaataatggctgaaagcagaagagtagtgagattggcatattgatataattattccattttattaatgttgtgtgtgtttgtttttttgagacagggccttgctatgtcccccaggctggatggcagtggcgtgatcatgtctcactgcagcctcaacatcttgggctcaagcaatcctcccactttaacctcctgagtaactgggactacaggtgtgcaccaccatgcccgactaatttttctattttttgtagaggtggggctttgccatgttgcccaggctggtctcgaaccactgggctcaagcaatcctcctgcctcagcctcccaaagtgctaggattatagacgtgagccaccgcgcccagccagttattgttgtcaatgtcttactgtgccaaatttatcaattaaactttatcataagtatgtatgtatagaaaaaaacctgatatatatagggtttggtattatgagcagttttaggcatccactgggggtcttggaatgtatcccctatggataaggggggctactgtacttacagaccggtggaagctcgtactctacttcaagaaccactctttctcccacattcttcagcaagctgatgatctcgtcatggcggaatttggccaggttgattccattcactgctttgatgtagtcacccacatccagctggtcacttctgcaaaatagacaatgttgtttcaacagacccaccctctccataggccagtctgactatatttccactttcccttcatggtaagcatgcaagtgtagaagcaagcctagaaggctgacagcagaagtccctgcctcctaggagacggtgggcccttaagggtaagagtacagctgaagtcagatgagagccagggatcccttttactcatgcagcctgtgatactttggaagtcctgctctgattctgccactatctctgatttttttcctttttgcctgttttatttttaaaagcaccataaaacaaaatcaagagaagcttttttttttttttttttttttttcagttctttgccctaaaccagttggttctctgggatgggatccagatcctagacacaacacatgtctttttattctcaatccctcttgtttttgctgcctcccttttgtacatttcacctctttcaataacttcactgggagtttgtccaggactaaggaaagggtcagcttattttgctatttattgcttacagcaggattgataagaagagtattggtgaaggagaaatcacaatgcaaatattgggtttcagtaacattcttatctctctataccaccataacagaatattggctgctcttggactttagtcaaactccgtttctaaaccaagagcaggtagcaagaccaataataagagttaaaattcatgtcactgataaggaccttcaataacattttctcccaaaacagaaatagctaatgcatttattttatatataaatccagctccaatcattcctccttcaaagagcctcctaatctgctccagtctgcagtacatgcatggcccttacctcactttcctgacacttatgtcaacttaaccgcctaatgctctgtaataacttctgtgctgttgctttttgctatcatgcaatgccatttttactcccaaatgtttcatgttttttatgccttatctccactaatagattgtgagcccctttagggcaaggatctcatctttaattattctgatttactaccttcaaaatggtagtgcctttaacagtgactatttggtgatttttaattctcaatataactggcacagtaatacttttaattacagaattaatacaactgaaaatgctaccctttcctccattcacacttgccttaagggagagctataaagaagctctggagacttatgaacccctagcatcatgaactggccatgattgttataaaataaaggaggttgtgggtgtggaaagatgcttcttaaaagcctaaagaaagcagattgaggtgcttgtgtccacaccagcctcccttacaaacaataacttctgatcatggaggcaatccactggattaagtttataaattgtacaaacaggttgatcattaaaattaatcacagaaatcaccacttcagatgacattttatggggcaagaactcagatttaacctggaattatgtggatatgaatattggtggccagaatttaaggtactttggcctcacttttattttttatttttacttatttatttatttatttatttgagatggagtttcgctgctgttgtccaggctggagtgcaatggcacagtcttagttcactgcaacctccgcctcctgggcggattcaagtgattctcctgcctcagcctcccaagtagctgggattacaggcatgtgccatcacacctggctttttttttttaattttttttttaaatttttttagtagagatgggtttcaccatgttggtcaagctggtctcgaactcctgacctcaggtgattcacctgccttggcctcccaatgtgctgggattacaggcatgagtcactgcccggcctggcctcatttttaatgaaacctgatcttctgtcccctttttctgaggcagatttagaatgtatctcaaggaagcccacccctgcccagtatccaggacattctgcctttggcaataactagtggaatttgcagttcatggaaagaaagacaggtgagacctcctcctctaagccttctgtcctttcggaaaccaactctttaaaatctcacaggtagaaaaggagagaggatgtgagataaacaaaattttcactgaaaactcagagttaggtctcccattctttctagggtagccatgtcccctctctggcacttttccccattcacattatatgggtcatctgtttcacatttagatgattggagtgtctccttcccactgcagcttgtctgctgttcagtggcacatttgcagacaagattcacataggctttttgaaattaaaatcttgtgagggcctggcagctcctgagatgacacaagaacctccctgggactgcagcctaggctagaacagccacatgggcagacctggggaacagcttctgaaacgtgccccactgtgcttctgctggcctgtgctgcctggcagatggcagctgtcatttatttattagtgaccacttttgatggagctttaatttttgaattaattacaccctgtgttcctttcagtagatttccccaagaggcagttacctagcagcaattcctccttgccgcagattagatactcttggcttgccatccttatcaattcctcccgataccgtcagacccagggtagtgccttccttcttcatcagctcgacgactgtggagcccttgaattcctctgttaaaagaaaagcatttgccttattaaaatgagagtagaatcaccaatgtcatttctcctccccagaagttctttccactttttcttttatgagaaaagatatttatggcctccttccattgtaatttgaagaatatttcataaagatgtgcatgcaggtaatgctgaggcagatattctattagaggttatgaaaatgggcactggtggggtattcactccaggttgacaatagtccaaattgtcttatgtacaaataatattcaccctttattttctgccattctcaggtgacattctctggtttctctccttgtaactccaatgggaacaattaaaaattgtaaagtacagaattagaacagaattttagatgataatacgaacatatatagcacagtggcacactccaagttcatggtatgtctcaggttaggaagccaactgaaaggagaagagtgctttctacaggttctagaaaaatattattgactttactttctttgtctttcaaaaacaaagtatgatggcttatgtaacaattcatgtcattcttgcagaatatgtcacagtatggcaaggcaggattgatcctcagaatttccaggtaactgacataaatctttcattctctgcttacgaaattttaaaatttcacagatcttgtggggataatatctatatagcaagatagaactcaactcttttgattttagtcagagcagaaggtaagaaaactgtaagaatatccttcccttcaaaaataaaaatgagtagagtcaatatttaccttccagaggctaattaggataaatgctgttttaaaattatctgtgatgttattcccctatctgcaaatatattttcttggtagggatggggaaattgtccaattttccaacttctcctaaattaagttacacatttcaggggtaatgaacttctagaacatcaaagacgcatattaaaatgcaaaaacaaactcgctctttcaaagtgaaatttaaaaaaagattatttgcacaccttaaccctttccctaattacagttatttataatgttgaaaatatttataaatgtgtatcataaaggtttttaaattgctgctgctagtacattatcctactagccaatgaaaaaatgaaattacattaggtaaggaaacagtatctcaactgatctagtgaggagaacagagtacttgggggaagaaggctggggacggcaggctacttatttcctcagcagcctagagaatgtccttcaaggcagggcttttgagtttgccagctcctgtgactttaacatcccagcataccatcactggaatcctgccttttcatggcagtctcatgacactgtatacataagtcattatcgtcttttaaagtagaagccaaggaggagtctgagcgtgtatgatgtcagcttcatctactacattttgtatgacagaccaaataaaaattgaaattcaagaatgaaaattcttgtcaagtgcatgaaagtacaggaccttttacatcatttaccagaaacatctgtaacaaaattctatcactgtgtgcacttcccttgtgctacttaaaacaaaacaaagcaaaccccagaaatctcatgaaaacatacgtagattcaactgatattgaagacatcaccttaataaacaatccctctaaacccttgctggcagaaggctaggtataaatttttttaaaataaagttaataattaaagtaaccaaaatgacatagatgatgaccgttcatattaaagagatataatgtgcccaacaattttgccaacaaaaagattctctgcatcttctttaaatatgcagagtatcctatatatttagacatctgattatagaactttacatgtagagttggaagcatagttttttttaagtgcttatcttaaaggtctatccaattttcatgaagaagcaactctaaaatactaacaccaggcatgtgagaagtaagtttctattcataaaaattttccttctactccaagttttcaaggacatgcttcctgcataaaataggatgcacgggtacagccttatgggaggcagacaatgtcattttctccagaaggaacccaggtgcttcctgggcttccggctgaatcctgaaaatctagaaaagctcaattattttagtttaatttcatcattattaaaatataaattcatcgatctggctactttttcaactgatacttgtcaattaccctatcatttaaaaacatttcaaatgttttcctaagagctaattttaataatgtgaaattgagaaaatattcctgcaccagttaattgagtaatttgtgcattcattgattcaagcacgtattgaatgcctactctgagccagacaataaaactcaaagatggaaaaagcaaaggccattatcctcaagatgggccacagcctagtcaaagaggcaacgtcacagaccactgtaccatacagcatgagttgtagggaagcagccacagagaagatggtccaggcaacaacgtagagcgaaggcctgagattccaaatgcaccatctattttacaattttgtcttctagccaatctgctgtacttatcgaccagggttagctgagcagagcagaccaaagaaggaatataaattaggcaaaactcaggagtaaagatagaacatacttgcaagaaaatttgctgaatcgcaagaatggtaactgccaataagtatctctggtcccagaagaattgactaaatcttttatggatgtttctgtagggggtgggagagaagtggtcaggagagaaaggaacctgcttttggagtttgcttttggctcacctgaagtctccacttggctaattaatcatttaataccctttttggtgtttaatgtttgcatagtgatctaacgaagacagaagaaatgaagacagatgcattcatttgcatgagttcacttatatatcaaggcttactgaacaaacactgtggtaaaacagtggaacttgggcaagtcaatatgtactgatgatttctttcttttgtgatttaaattgcaaatatcactccctcaattaagaggaccttgtagggagcactgtacactctttcaattagcaagcagcacaggcaacagatgatgtctaactagtgaggaaggaaatggttctgaatttgactttttccttaatcaccatatttatttatcttagaaaataaatggtataggtttacagctataccattacttactcaacataactgaacagaatcccactgatgaaatgaaatttagttgtttgctgtttttctttgtgtttgtaattcaatctttttaattactgaactccagaaatttttaagaaaagtaacagtgatggttggcaaacacaagagaattatgaaaagttcttacgaacaaataagaatatttaaaaacacagatggttatacaattaatatgcagaaaactatatcctttatatagacaaacaacagccagtaaaaggttattatagaagagaaggccccatttacaatagccaaaaggtaaaatccctggaaaaaacttaacaaaactgtgcaacatctatatgaagacaactttaaagtgcttctgaaggatataagattagaataaatgaaaaggcatcccattcattcattcaataagaactgagcacttactatgtgccagacagtgtttgaggcattggagatacaacactgaacaaaatggatactattcctgccatctaagaactaatattccagtggatagcataagtcaacagaaaaaagcattgattttctttaatcagttgtatatctatatagtagcaatgaacatatgtaccttaaaattaataatgaaatatcatatataattgttcaaaaaatgaaattcttaggtgtacaagtaacaaaacatacagtacttacattgtgaaaactaaaaaatgctgttgaaagaaattaaagaaggcctaaataattggagagacaaacatgtgcatggactgggagactcagcataacaaagacattaattctttccaaattgatatataggtttaatgcaaaccttatcaaaatcccagcaaaatattttgtaactatagacaagattattctaaaatttatatgaaagggaaaggaacaatttttaaaaagaagaaagtgggagtatttagtctactcaatttcaaaacttacatagttaagagtaataaagactgtgtggtaggccaggtgcagtggctcatgcctataattccagcactttgagaggctgagaggggagaatcatttgagaccaggtgttcaagagcagcaacacagtgagatctcatctctgcataattttttttttttttaaatagctgggcatggtagtgtgcacctgtagtcccagctactcaggaggctgaggcagtaggatcacttgagcctgggaggtcaaggctgcagtaagctatgatcatgccattgcactccagtctgggcgatagagtgataccctgtatcaaaaatcataagtaaaaccactgtggtattgatggagggatagacatatagatcactggaacaaaacagaggacccaggaatagactcgcacaaatatgacatactgttttttgacaagatgcaaatgcaattcaatagaggaaaggtagcctattcaacaaatgatgctggagcaatttgacatccacaggcaaaataaataaataaatcccacaacttgaccagagtttcacaccttgtataaaatttaactcaaaataaatcacagtcaaaaatgtaaaccataatattatagaaactgtatgaaatatttagaaactgtaggaaaacaggataaaaattttaagatctaggtttagcgaagggtttctagacttgacataagcatgatccataaaaggaaaaaaaaatcagcaaattggacttcatcaaaattaaaaatgaatgctctctgcaagacctgcttaagatgaaaagaacatctacagaccaggaaaaaatatctgcaaactacatatccaacaaaagacaaaagactagtatttcaaatatacaagcaactttcaaaactcaacagtaaaaaagcaaacaatctaattagaaaatgggaaaaagacatgaaatattttattaaagaggatatacagatggcaggtaagtacacacgaaaaaatgctcaacattttccattggggaaatggctcaaattacttaaaaattaaaactacaattgatatcattacacacttatcagaaaggctaaaataaaaattagtgacaacaccaaatgctggtgaggatgcagaaaattagatcactctgacgctactgatgggaatgtaaaataggacaactactctggaaaacagtttagcagtttattagaaaactaaatatgcaaccaccctatgagccagaaattatactcctgggcattaatcctagagaaatgaatgctttcattcacaccaaaacctgtaagtgaataattatcacagccttattcacaatagcaggaaacagaaacaaccaagatatcctgcaacaggtaaatggctaaacaagtgtggtttgtctataccacggaatacttctcagcaatcaaaagggtcaaactagtgctacaagtaacgacccagatcaattaccagagaactatgctaagggcaaaaagtcaaccccaaagatttcacattgtgtgattccatttatttaacattcttgaaatgacaaaattatagcactagagtatgggttagaagttgccaggggtaagggcaggagggaagtggatgcaggtataaaagagtaaaggattgatccttgtggtgatggatatgttctgtatcttgactccatccatgtcaatatcctggttgtgatattacatatagttctgtagatatttctattggggaaaacaaggtaaaggatataaggaatttctatattattttctacaactgcatatgaatctacaattatctcaaaattaggagtttaattttttaaaaaatgtcccatcagtgggtatatgattcaattggtctggagtacgcctaggcatcagtatttgaaaagttcctccagtggattctaacatgcagctagaattgaggaactacttgtggttacttaagagtgaaatgaacatgtgttgttcttttagtttatatatatcttttttcaaatggctaataagttgttaggataaaatatgaactgtgttgtttggacctaactacttagtaaattgaactagtggtatttcatttggcctggaggtgctgtaaaaaattctgagacactaaaggctctgtggactgagaaagtttagaaacttctgccctaggactttatcttgttttcattcagctggtggaaggggaaagacagctctcttgaaagccattactggcctgcttatgttcacatcccaagggcaagaacttattccatccatgtacacacataaattcaaaggaggctgagaactagagtctaaatagagacccatgcaatgggggtagggtggatatggagggacaggtactgactatgccacccagaggcaacacatgatggactaaaatacatcagaggctatgtggatgacatggacaccagacatattaatgaggaggaattttccggagttagagaccaattaggatgtgggaagcatggaagtgagtgaggatcaaaaaggccccaaggtttccaacttgtttgattggtggatgttgacatctgtcactgagaaagggaatctagaaaacaggaagtttgtgttgctgcgggtgattggagtggggcaggcacactatataatgtcatataagataaatttaacattgaaataccacagaaaaacttggtcttaaaatacttttcatcacacctcaaaatgctctataagatcttcaccacatggctgtagcgtaaaaagagaaagtacaatttcaaagcaaccactagaggcatattcagcaaaacaggcgaagctctttacttcttgaagtactattaactgcagagatttttaaaaatactattaacagttaaatagaaatactattggtgaaaactctgtaaagtaagtcacaaattttgaaatgctggtgtcaacaagagtgttttttccctgctgtatctccagcatctagaatagtgcctggaacattcacaggtcctccctggtaactgctggatgaacgagcacatcagtcccaaaacagggaattataatggggtggtgagcatcagcttgtggcaaacagaattattgctggacggtgcagaagcaaaatgataaaggagcagaatctgaacaggagcagacagagttatttccctaagcttacttggttgattaattgtaccaatgccttagtaaggggaattagggcacgcaccagaatactatagctatatctgtgtactactattgaaaaaaatattattgctcatactacagttttatctgtatattacttttggtggtgccactaggaagtttattcccctcaggaaataaacagatgctttttccaatactcatttcaagctcttcctaatatcccctggttcagcaaagctgtggggatcaaagctgggtttctgtgatgaactgctgcattttcagtctcagtttttgccacccagactagcagagaaaggtttttgggcattttccacctctgtgtagtgacatgagggatatactagaatttttctcatcccttgggagtctgaacataaatttgatcagtggcagggatgtacagcacataaatattacctggcacaaatattcatgtgaaacaaaattatgattgggatttatctcatgcagtgatgggagggctggattaatatctgtatgtttcctattgcacctccaaagaaaggggatatacaaatatgcagtgtcaaatacaaaaatatgtgacccctgaagatatgtgatatatgggtcaggattcttttaaaaatagattgaacagagatgttgactgtttttctggcataactgattcaggtatcaaatgccttctaaagcattaagttaaaaaaaaatccctgcttttaaaatatggcaatacgagaattgttccaatttctactgctcccaaaatcagttatttaattgtcaaaatttgctattaagctttccaatgtcaaacttattaacaagttatttagttttcacgggtcttagtttcctcacatctaatttagggataataatggtatctacttacagaatgtggtgaaattaagtaatacaattcttataaggaacttatggtaataacccacacagtaagtgttcaatatatgttagccaaggtattattgttgtcttattgtcattattattgttatttggatattggaaatttccagatatgcaaactgccaattttctactatattttgattgttatgaatataagacaaaagaattaacagtggtatttaactgttggtgaagtcacagactactttgagaatttaatgaaagcagtgaacgcttgtcccagaaaaattgtgtgcattatttcaggggaattcatgaattccccctggggtttatccatataccctactttagaaactctgacctagaagatcaggtttgagcaatgtgacaatcaaagaacaatttacgctggagtgacattttataattcgtgtgtatgttgggtagggggatgtagaatagcaaacagcacccacatctatcagtcacgtattcctacacaatcatctgatagtctaaataaaaccatgatgcaagatatcagaaacaggaaatggctcacctcagtgaaaccgcctctcttcctaagcatgatggcctgagtggtggacatttaaatgtaagagttgataagggccaggagaaagcactgggcaggatatctcggaatcacacttgcttcaagagcctcaggcagttttcctttggaaaaactttccatctgtaattttcacttgtaagctattataaaatcacattgttgacatgattgaaaatcggagtttacaagtaaaactgaagcaattggcatggctatctttgaatttaattactctgattttcaatgttcccttagataagttaactacattcttacaactacttatggactgttttgtcctaaaaacgtttttaagcatttataattgccagactctgtggtagaggctagtattttgaagaccaataatcactgcctctacctttctgcaattcacattctaaatgtctaagagacaaacatctaataattgcaatgaaatgtcgtcagtccatagcatggcctgggagcctgaaagggaataacagctcaacgtatgctgctgagaaagtcctctataggctacagatggctatttagaggtttaagttcttctttagatgaaagtagaatatttacttgcagtattactgttgtttccacttaatagagaagtgaagataccaagtattgcttagcaaattaatgagctatttttgggaggaaatcatttatttttgcatgtatttttgggtgtccttttggctagaatccttttttttttttttttttttgagacaaggtctcactctattgcccagactgtactgtagtggtgcaatttttgcttactacagtcttaacttattgggctcaagggatcctcctgcctcagccccctgagtagtgtgtgtcactaggcccagctaattttttaaaacaattttgttgttgttgttgttgttgtacagatggggtctcactatgttgcttcggctggttttgaactcctgggctcaagcgatggtcctgcctcagcctaccaaagtgctgggactacaggcatgagccacagtgccaggcagggcagtatcttatgttgaataactatttaaatatgaaaatccagaactactgtgcggggattagaatgatcagatgttctgatctgggagtccagctgaacaacaagggatgggagcagctgggtggataaaaagaaagaacactctggaagtgaaagaagatcctgagaaagatatcaggtaaggctgcactacagctagtgagagctagtcattgctgagttaggtcgcttagtgtttaacataaggggccaaatgttgcatcttcaaagacaactaagaggacaaggcttgaggttccattgtgcctgaaagggaaatggagaaaggataaacttcaacaagaaatcagacttcttaaataatcagggcaaagtagaacttagagctacactcacttggcctttttcttccatgaatatctaagtacccacgaatctaacatgagctaggaacctgactgaatagagagattaaaatgaagaaatttgtgatacttttaaagactatccattcttttaaagcagtttatacttttccaagtattcttacatccattcactaacttagccttcagaaaaactctgtaaagaagggcatactaccattttatagattagggacactgagacttgaaaattagggtcctttcattaggccgaacttcatgtctattttacgtacatgaaatttccgcctcatgtaactaaatgctacaaagtttcagactcatcatacagtaattgtcaaacaatggaccaaaagaatgtatagatgaaatacttttgagaaaagggaagaaaagtaaagctagcctcaagcagactccaagccacaagggcactagtaaatcagtcctcattttgtcacagatgcctgtgcatcaggggcatttatttgattgtcccttgtttgatgagacttgattcatttcaaatagaggaacagatggaaaactaatagtgtagtcactgcagatcaccaagaagcaaagcatctggggagccctatggactttccatggagaagccatgggcctgctgcagtgagtcagagcttcatgagagccctactcagacccactggaattcagaactggagaaggctgtgctgcctatatcaaggacagctctcacaccctgtatttggctttctctatcctaacagggagggtaccattctctcctggcccctctcctggtccctttcatttcttctgctctacatgggaaaccattttcttgtcacagagaaatgttccccattgcagtaagcagaaagagaatgagcagataaagcagtcactactgtttcctctttgatgccatccatcctttttattagtacctcaatcaccttatgtaacactatcttacccaagtataactatcttctagcctcactctgagtttgaaatgctttagtccctccctctcttcctcatttcctccctccttccctctccctcccttgtttccctccctatcttccattgaatatctattgataatttcctaaattctaggcactttgctatctagcagtaaatgatgtagacttagtccctgacctcaaggaatttatattctattaaaaaatacagaccttgggaggcagagcaagatggctgaatagaagcctccactgatcatcctccctgcaggaacaccaaatttaacaactatctacacaggaaaagcaccttcgtaggaaccaaaaatcaggtgagcgatcacagtacctggttttaacttcatatcactgaaagagccactgacaagagtaggaaaaacagtcttgaattgccgatgccaccccttccccatcccgcatgtctcatggcacgaagaatttatgagcttgggggaggaaaagtgctgtgattttgggactttgcattggaacttggtgctttcctatcacaatggaaagcaataccaagcagaagtcagccaacacccatggaggaagcatttggaccagccctagctggaagggaatcctccatcccagcagttgccatgtgagctccgacaagccccaccacagtggactaaagtggtttggggccctaaatctacttgaaaggcagtctaagccacaaggactgcaactcctaggcaagtcctagtgctgtgctgggctaagagcccattgacttggtgggcatgtgacctagtaagataccagctggggtggctaagggagtgcttgcaccactcctcccccaagcccaggcagcacagtttgcagttccaaaagtgaccccttccatcttcttgaggagagaagagggaagagtaaagaggactttgtcttgcaacttggataccaactcagctacagtcagagagggcaccacacaaagttgggaggtgtagcttctgaacaagatttctagacaaaacctgggccaaaactcactgccttgaagggaagaatccaattctggcaggtttcatcagcttctgacttaagagctcttggccctgaatagtcagcagtggtagccaggtgtagtacatgccatgggccttgggtgagaatctgagacatgctggcttcaagtgtgacctagcatattcccaactgtggtggccatgaggaaagactctgcttgagaaaaacagaggaagagtgaaggggactttgtcttgcaacttaggtaccagtttggccacaggggagtagagcacgaagtgggccattggggttcccattccaggccttggctcatgaatggcatttatggacctgctttgggctagaggggggcccactgccctgaagggagaatcctggggctggaagcattcattacaagctgactgaagagtccatggaccttaagtgaacatcggtggtactttggcagtattccccatggcacactggaggtggtggccatggggagaggctcctctgcctgtggaaagcagaggtagagtgggaaggactttttattgtgctttgggtaccagttcagctgcagtagaatagagcaccaggtagctttctaaggttcctgactccaggacctggctcctgaatgccatctctgaacccatccaggatccagaggaactctctaccctgaagggaactcttcaccctgaaggatggctggttctgctacttgctgattatagagttctagggccttgagaaaacataggtggtagccaagtagtggttacagcaggccttaggtgagacccactgctgtgctggcttcaggtctgacccagtgcagtcccagtgatagtggccacaggggtgcatgtgtcactccttccccatctccaggtggctcagcacagagacagactctgtctgtttgggagaaagtatggcaagacagtaagagtctctacctagtaatccagataatttttctggatcttatccaaaaccaccaagatgatgcctctatgagtctataagagccatagcattactgggcttggggtgccccctaatgcagatatggctgcagtgaccaaaaaattagattccaacacccacgtcccttcaaatacctgcagagctctcccaagaaggatgggtacaaacaagcccagactgcgacgactacaataaatacttaactcatcaatgctcagacactgatgaacatcaataaacatcaagaccatctaaaaacatgacctcatcaactgaataacataaggcaccagggaccaaacccagagaaatagagctatgtaacctttcagagagagaatgcaaaataggtgactggaggaaacttgatgaaatttaagataatacagtgaagaaattcagaatcctatcagataaatttaacaaagagattcaaataattaaaaagaattgagcagaaatgctggagttgaaaacatgcaattgacgtactaaagaatgcaccacagtctgttaataggagaagtgatcaagcagaaggaagaattaatgaacttgaagacagtctatttgaaaatagaggagacaaaagaaaaaagaatgaaaaaggaataaggcatgcctattagacccagaaaatagcctcaaaagggcaaacctaagagttattaaccttaatgaggatgtagagacagatagggatgtagagacagatattattcaaagtgataataacagagaacttcccaaacctagagaaatatatcaatatttaagtacaaaaaggttatagaacaccaaacagattgagcccaaagaagactgcctcaagacatttaataatcaaactctcaaaggcaaaggaaaaagaaagaatcctaaaggcagcaagagaaaataaacaaataacatagaatggagctccagtaaatctagcagcagacttttcaatggaaatcttacaggccaggagagcgtggcattacatatttaaagtactgaaagaaaaaaaacttttatcctcgaatagtatatctggcaaaaattgctttaagcatgaaggagaaataaagaccttcctagacaaacaaaagctgagggattccatgagcaccagacctgtcctacaagaaatgctaaggggaattcttcaatctgaaagaaaaggatgttagtgagcaataagaaatcatctgaagttacaaaattcactggtaataggaagcaccaagaaaaacacagtataacactgtaatggtggtatgcaaacttaagaagaaagactaaatgatgaaccaatcaaaaataataactatgacaacttttcaagaaatagccagtatgataaaacattaaaaaaaaaacaacaacaaaatgttaaaaagcagggggacaagttgaagtgtagagtttttgttagttttccttttgcatatttgtttatgaaatcagtgttaagttgtcatcagtttaaaataatgggttataagacagtatttgcaagccttatggtaacctcaaattgaaaacatacaacagatacataaagtataaaaaggaagagattaaaacataccaccagagaaacattaccactaaaaggaagacaggaaggaatgacagaaaaaaaaataagaccacaaaacaaccacaaaactaataacaaaatggcaggagtaaatccttacttatcaataataacattgaatgtaaatggactaaattctccaatcaagagacacagagtggctgaatggataaaaaaaaagactcaactatctgttgtctataagaaacacacttcacctataatgactcatagactgaaaacaagggatggaaaaagacatcctatgccaatggaaaccacaaaagggcagaagtagctatatttctatcagacaaaatagattttgagacaaaaactgtgagaagagacaaagagggctcattatataatgataaaagggtaaattcagcaagaggatataaccattgtaaatatatgtacacccaacactggagtacgcagatatacaaagcaaatattattagagtttaagagagagatagaactcaatacaataatagctggtgaccctactttcaggattggacaaatcatccagacataaaatcaacaaagaaacaatggacttaatctggactacagaccaaatgaacctaattggtatctacggaacattttattcaacagttgcagcatacacattctcctcagcacgtggatcatcctcgagaatagatcatatgttagcacaaaacaaatctctaaaaattccaaaaaatttgaaatggtgtcaagtatattctctgaccacagtggaataaaactagaaatcagtaacaagaggaattttggaaattcaacaaacacatggaaatgaaacagtatgctcctgaatgaccaatgggtcaatgaggaaattaagaagaaaatttaaaaatctcttgaaacaaataacatcacaaacacaacataccaaaacctatgggatacagcaaaagcagcactaagagggaagttatagctattaatactacatcaaaaaatagaaaaccttcaaataaacaacctaagaatgcatcttaaagaactagaaaagcaagagcaaaccaaacccaaaattagtagcataaaagaaaagagcagaaataaatgaaactgaaatgaagaaaacaataccaatgatcaattaaaagttgtttcttttctttaaagttagttttttgaataaacaaaattgataaacctttagccagactatgaaaacagagagaagacctaaataaataaaatcaaagatgaaaatgaagacattacagctgatactacagaaactcaaaggacctatattagtccgttttcatgctgctgataaagtcataacaagactgggtaatttataaaggaaaagaggtttaatggactcacagttacacatggctggagagactcacaatcatggaggaaggcgaaaggcatctcttacatggtggcaggcaagggcgaatgagagagccaagcaaaaaggaaaacctcttataaaatcatcagatcctgtaagacttactcactaccacaagaacagtatggggaaaacacccccgtgattcaattatctcccactgggtccctcacacaacatgtgtgaattatgggagctataattcaagatgagatttgggtgggaaaacagccaaatcatatgaggaccattagagattactatgggcaagtatatgccaataaattggaaagcctagaagaaatgtataaattcctatataaataaaatgtaccaagattgagccatgctgaaatccaaaatctgaactgaccataactcataacaagtaatgagattaaagctgtaataaaaagcctcccagcaaagaaaagtccaggacctgatggcttcactgctgatttttaccaaacatttgaagaagaactaatgccaatcctgctcaaactattccaaaaaataaaggagagaatacttcagaactcactctacaaggccagtattaccctgataccaaaaccaaacaaagacacatgaaaaaagaaaactacaagctaatattcccaataaaccctgttgcaaaaatcctcaacaaaatagcagcaaaccaaattcaagatcacattgaaaacatcattcatcatgaccaagtgaaatttatcccaggggtgcaaggatggtttaacctacacaaatcaatcagtgtgatatacccacaacagaatgaaggacaaaaaccacatgatcatctcaattgatgctgaaaaagcatttgataaaattcaatatcccttcatgataaaaaaaaaaaaaccctcaaaaaacagggtatagcaggaacatacctcaacataataaaaaccatataaggcagacccacagctaacatcatgctgaatggggaaaaactgaaagtgttttctctaagatctggaacttagaaagatgctcagtgtcactactgttattcaacatagtactggaagccctagctagagcaatcagataagagaaagaagcaaaaggcatccaaatcggaaaggaagaagtcaaattatccttgtttacaaatgacatgatcttatatttggaaaacccttaagactccaccaaaaacctattagatctgacaaattcagtgaaattgcagaatacaaaatcaacataaaaaatcagtggcatatctatatgccaacagtgaacaatctgaaaaagaaatttaaaaagtaattccatttacaacagctacaaataaaattaaatagctaggaattaaaagaagtgaaaggtctttacaatgaaaactttaaaaccttgatgaaagaaattgaagaggacacacaaaaaatggaaagatactccatgttcatggattggaagaatcaatattgttacgatgtcatactacggaaagcaatctactaattcaatgcaatctctattgaaatatcaatgacattcttcacagaaatagaaaaaacaatcctaaaatttatatggacccacaaaagacccagaatagccaaaagtatcctgaggaaaaataaaactggatggatcacattacctgacttcaaaatatactacagttctatagtagccaaaactgcatggtactggcataaaaacagatacacagaccaatggaacagaacagagaacccagaaacaaatccatacacctacagagaactcattttcaacaaaggtgccaagaatatacactggggaaaaggcagtttcttcaataaatcatgctgggaaaactagatatccatatgcagaagaatgaaactagacccccatctcttgccatatacaaaaatcaaatcaaagtggattaaagaattaaatcccagacctcaaattatgaaagtacaataaggaaacatcaagggcactctccaggacattgatttgggcaaaaatttcttgagtaatactccacaagcacaggcaaccaaagtaaaaatggataaatgggatcacatcaagttaaaaagcttctgcacagcaaaggaaacaatcaataaagtgaagagacaacccacagaatgggagaaaatatttgtaaactatacatctgacaagggattagtaaccagaatatataaggagctcaaacaactctatagtaaaagttttaatgtaataatccaattgaaaaatgggcaaaatatttgattagacatttctcaaaaaaaaagagagacaaatggcaaacaggtatatgaaatggtgctcaacatcattgatcagcagagaaatccaaatcaaaactacaattaaatataataacatctcaccccagttaaaagaaagggaataacaaatgctggtgaggacatggagaaaagggaagtcttgtacactgttggtgggaatataaattagtacaatcacaatgcagagcagtttggcggttcctcacaaaactaaaaatagagctaccatatgatccagcaatccctagcagcatatacccatatactgctaggtataagccctaaagaaaggaaattgatatatcaaagaaatatctgcacttccatatttattgcagcactatgtacaacaaccaggatttggaagcaacctgtgttcatcaacagatgaatggataaagaaaatgtggtacatacacacaatggagtactattcagccctaaaaaagaatgagatcctgtcatttgcaacaatatgaatggaaataaaggtcattatgttaagtgaaataagccaggcacagaaagacaaacacatgttgtcacttaattgtgggagctgaaaattaaaacaattgaattcatggagctagagagtagaataaaggttaccagaagctgggaagttagcaggggagtggaaggaaagtgaggatggctaatgggtacaaaaacattagaaagaatgaataagatgcagtatttgataacacagcaggtgactatagtcgataataattgtacatcttaaaataactaaaagagtataattggattgtttgtagcacaaaggataagtgcttgaggtgatggataccccatttaccctgatgtgattattatgcattgcatggctgtatcaaaacatctcatgtaccccataaatatatatacttactatatacccacaaaaattaaaaactaaaaaaaaagaaatactgacttaaagaaatagaaaattataacaatatggttagttatgattatttagaaaaacaaagggttaatctggggctaagttgggacagtcacttgaaaaatatttgcaaatggttcattatgccctaaaaaaccagccctattgcctcgcctctggcaagtcactaaatccttgtgtgccctaatctctgaactgtaaaatgagagaactgaagtatatggcttaaaaaaatatatatattttattgactttaaggtgccagcgatcgtaaggcacactgttattttatttgctgctaagaaagaatatgtctgggtttggtggctcatgcctgtaatcctagtaatttgggaggctgaggtgggaggattgcttgagctaagcagtttgagaccaccctggacaacttggtgaaactctgtctctacaaaaagatttaaaaattacccaggcatggtggtgtgctcctgtagtcccagctacctggtgggggatgtgggggtgttgaggtgagaggattgcttgagcctgggaggttgaggctgcagtgagccatgattgcactacagcactccagcctgggtcagagcaagatcctgtctcaaacaaaacaaaataaaacaaaagaatacgctgtcaatcaaattacaacataatgcttatcactaaggttgtttaagtattatacttattaaataactcaaagcacatgcatgaaaagaaaaatgtcagtgaaataaatcagtcaaggtgctcctacaacttttccacattcaccctctgaaccagtgtcactgatgtccatattttctatacgatattgtcctcatcaccagtactttgggcaccaagagcactgtgatgctgcattttttacagtgctctgttattgccccttggattttctttcaagctgctgaggctcatttggcaagtttcaatttttttgaaaaattactttatgaagcttgaagaaatattgagtataattaaactataatctaggcttatatacagcttaataatagttcagttccaaaagaaaagctattgcaggtgagaccgtaacatttcccaacacgattttaagacactgtgctgatttctcaaaacaactctgaggaacccatatttacagtagaaggagtttttatgaaaaatctggcattatgtatctttgttgcatgattatatatgtatgtacgtataatacaatgttagatgcaccatcacccccgaccccctgccgcacagttgaaaatccacatgtaacttttgactatcccaaaacttaactattaatagcctactgttgactggaagctttactgacaacataaacacatattgtgtatgttatatgtatgatatactatattcttataataaaagagaatgttgttaagaaaatcataaggaagaaaatatatttactatttattaagtggaagaggatcatcataaaggtcttcatccttgtcttcttcacgttaggtaggctgaggagaaggaagaggagggttggacttgctatctcgggggtggcagaggtggtagaaaatctgtgtttatgtagacctgtgcagttcaaacctgtgttgttcaagggtcaactgcatatgtatgtgtgtatgtatacagttatactatatatacagtatatacactatatacactgtgtgtgtgtatatatacacatataatccaacatatggactgtatatacacaaacacacacataatccaacatcataagaactagaaaacagaagttgtattccttaacatcagtattagagtgtagagtttgaggcttggatttagaaatgcttttcaacatgtagggtttggaaaaggagcaatcatcttgttttcaaaacctgaagtttttctcaggacttatgaccataactgccacagaggaaaaagggaagcttttcccactgtaattgttcatctgtgtcagaaagtcccatatcctgtgtagatcttataaatattttgctagatttatggcaaagagagacattgatgctgcaactgaagcaaaacacaaacttgaaaaagacaaacagaagaaacccaagaaaggaaggagaaggaaatccaatgggagacaagcttatttcatgaagatggaagatgttgggtttatgatgaatcattactgaattatcttggtgctgccaagcattgggctaggaatttctatttacttgattttttatgttgttgcaaatggtactgctttttaaatttccaattatgcattgtatataattaaatacaattgatttttaattgtaaaaaataaaaaaacaagaaagtctcatatccctgagaaaccattgcaataagaagggaatgaacaggttctcccaaagggagaatgtttgttgcttaattatgcttactgccctggccatcaggtataaactttacatttcctagcccaaggcttggcagcaccaagataattcagtaatagttcatcataaacccaatatcttccaacttcatgaaataagcttgtctcccattggatttccttctccttcctttcttgggtttcttctctgtctttttcaagtttgtgttttgcttcagttgccgcatcaatatctctgattttttttcttaatattttaagttctagggtacatgtgcacaacgtgcaggtttgttacatatgtatacatgtgccatgctggtgtgctgcacccattaactcatcatttacattaggtatttctcctaatgctatccctcccccctccccccaccccacaacaggctccggtgtgtgatgttccctaccctgtgtcccagtgttctcattgtttagttcccacctatgagtgagaagatgtagtgtttggttttctgtccttgtgatagtttgctcagaatgatggtttccagcttcatccatgtccctacaaaagacattaactcatcgttttttatggctgcatagtattccatggtatatatgtgccacattttcttaatccagtctactattgttggacatttgggttggttccaagtctttgctatcgtgaatagtgccacaataaacatatgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatctccttgtggttttgatttgcacttctctgatggccagtgatgatgagcattttttcatgtgcctgttggctacagaaatgtcttcttttgagaagtgtctgttcacacccttcacccactttttgatggggttgattttttcttgtaaatttgtttagattctttgtagattctggatattagccctttgtcagatgggtagattgcaaaaattttcccccattctgtaggttgctggttcactctgatggtagtttcttttgctgtgcagaagctctttagtttaattagatcccatttgtcaattttggcttttgttgccattgcttttggtgttttagacatgaagtccttgcccatgcctatggcctgaatggtattgcctaggttttcttctggggtttttatggttttaggtctaacatttaagtctttaatccatcttgaattaatttttgtataaggtgtaaggaagggatccagtttcagctttcaatatatggctagccagttctcccagcaccatttattaaatagggaatcctttccccatttcttgtttttgtcaggtttgtcaaagattagatgattgtagatgtgtggtactatttctgagggctctgttctgttccattggtctatatctctgttttggtaccagtaccatgctgttttggttactgtagccttgtagtatagtttgaagtcaggtagcgtgatgcctccagctttgttcttttggcttaggactgtcttggcaatgcaggctcttttttggttccatatgaactttaaaatagtttttttccaattctgtgaagaaagtcattggtagcttgatggggatggcattgaatctataagttaccttgggcagtatggccattttcacgatattgattcttcctatccatgagcatggaatgtttttccatttgtttgtgtcctcttttatttcgttgagcagtggtttgtagttctccttgaagaggtccttcatgtcccttgtaagtgggattcctaggtattttattctctttgaaacaattgtgaatgggggttcactcatgatttcactgtttgtctgttactggtgtataggaatgcttgtgatttttgtacattgattttgtatcctgagactttgctgaagttgcttatcagcttaatgagattttgggctgagacgatggggttttctaaatatacaatcatgtcatctgcaaacagagacaatttgacttcctcttttcctaactgaataccctttatttatttctcctgcctaattgccctggccagaacttccaacactatgttgaacaggagtggtgagagagggcatccctgtcttgtgccagttttcaaagggaatgcttcagtttttgcccattcagtatgatattggctgtgggtttatcataaatagctcttatattttgagatatgtcccatcaatacctaatttattgagagtttttagcatgaaggttgttgaattttgtcaaaggccttttctgcatctattgagataatcgtgtggtttttgtctttggttctgtttatatgatggataatgtttattgattttagtatgttgaaccagccttgcatctcaagggatgaagcccacttgaccgtggtggataagctttttgatgtgctgcttgattcagtttgccagtattttattgaggatttttgcattgattttcatcagggatattggtctaaaattcttttttgttgttgttgtgtccttgccaggctttggtatcaggatgatgctggcctcataaaatgagttagggaggattccctctttttctattgattgaaatagtttcagaaggaatggtaccagctgttgtttgtatccctggtaaaattcggctgtgaatccgtcttccaaaaaaaatccaggactttttttggttggtaagctattaatcattgcttcaatttcagagcctgttattggtctattcagggattcaacttcttcctagtttagtcttgggagggtgtatgtgtcgaggaatttacccatttcttctagattttctagtttattttcatggaggtgtttatagtattctctgatggtagtttgtatttccgtaggatcagtggtgatatcccctttatcattttttattgcatgtattctctcttttcttctttattagtcttgctagctgtctatcaattttgttgatcttttcaaaaaaccagctcctggattcattgattttttgaaggtttttttgtgtctctatctccttcagttctgctctgatcttagttatttcttgccttcagctagcttttgaatgtgtttgctcttgcttctatagttcttttaattgtgatgttagggtatcgattttagatcttttctgctttctcttgtgggcatttaacgctataaatttccctctgaacactgctttaaatgtctcctggagattctggtatgttgtgtctttgttctcattggtttcaaagaacatctttatttctgccttcatttcattatttacccagtagtcttccaaaactgaccacatagttggaagtaaagcactcctcagcaaatgtaaaagaacagaaattataacaaactgtctctcagaccacagtgcaatcaaattagaactcaggattaagaaactcactcaaaattgcacaactgcatggaaactgaatgtctctgatttttaagttgaaagtacatccttctaaaggcagtgagattcatattttttctgatctttcaacttcctatcttcttcattatagacatcttcttggtatctacaaagactgcattttcccctgttgcatattttgcatacattacaccattccattccccttcagttgagcagaaggcttctcatcctttggagaaaaaaatcacagtggtaattctgtgcttcctgtccccagagaaaggttcagtgtggaagatgatgtttgcactatcaccagttttggaataattaatattgcattctcctcctagttccattcagagcactgcgaggatagaacatccgtaaacactggggaatgtgaggatgtaatgtttctcatagttaaaacaaaagacacagggcttgtggccccaccctatgttgtgtgtcccaattgacatcctgaggaattttgattaggtccagatatcaccaatgaattgaatctttctgataaacactcagcataaaaggctaaagtaggtggatgatgggaaatctgttcagctacaaattttacattgtttttggaaacccagggaactggtccttctaaaactagctctgtgttctctttggtatcatttggtaatatccattgacactgaaagatcttgctaaaatgactttttgacaattgattctttccttcttgcatgaaaggctgagaggtaccatttcacattctgaaccgttcaatccctggtcaccaatgttcgcaaaaaggttggatatgcaaaaaatgtctgcatatgcttctaaaagagatcctctttcaagaaaaaatggtggaagatctactttagtaagatccatactaagcctaacctgtgacaagaagtgtgtggtaacgctcttatgctcctccatggaccctgcctcctccttgtcaggtctctcatcatgtgaatcaagagtcagcatcacttgttccattggatgtgaaagaattaagtgattctgtgctatctgggcactttagtctgttttccgcactgccatgtgtcaagattgacgcagattcagaagaatctattaagtgctttggggatgagccatgttgatgacattcatcagcattgtagaattcatcttcactgctggaataagagaattctgggattgtatttagagaagccattgacatggcttggagaagttagaccgctactaggtggtgaatgggcactgcctctactatttggtgttggagtctaatgatgtcccaaggcaattagtacaggtccaactggtcaggaagatgaactctgctctgtcttatgcagttgagtaggttccagagggaggtgagacagtctgggaaggcattgtgctgatcacaggttcccagggactaggttgatacactgcatctacaagattaatagtacttataattctatctgcgtgcttctcagcattattctggtcttcagcagtctgcatcaacacagtgcagtgtttcattgattccaccatgctatttgcttctctttgagagtttcagttttctttctctgcttattatctttgcagttttgaagcttgtgatcaaaaaactttaattgttctatcaagatttgtaggtgggcatcagtctctggagcggtggctcacgtctgtaatcccagcactttgggaggctgaggtgggtggaacacgaggtcaggagttcaagaccagcctggccaagacagtgaaatcccgtctctgctaaaaatacaaaaattagctgggtgcggtggcaggcgcctgcaatcccagctactggggaagctgaggcaggagaatcgcttgaacccaggggacagaggttgccgtgagccaagattgccccactacactccagcctgggtgacagagtgagacttcgtctgaaaaaaaaaagaagttaactttcctgtcaaagttttggacactaggaacaaatcctgaatccaaatctctggaggtgacaaggaaggaggcaaggaaagtgtgacatctgagcccatagcctggccctgggcaggcaccagggaccatgggactcaggggtggaggttaggcctctcccagaccctcagggtgtactcactccacaagtgtccagcaagaaagtaatttgcaagacccccacactctgtgcctccaggatagagagggggctgggggctgcttccgagcaccccttttccttctccacttgattggatcctcatttggcaagttttgatacttgtgcttcttgagcttatgggaaagtatcaacagaacagtttagacaacagtacatattccctcctcaggtttatttcaggttctactcagtttcaggtttatttcctgaaacttcaagaagttacatttatccaatgatatcaccaggaactgcaaccaagtaagtgcatgcacaggcaataataataatattatgattatcacatgtctaagaacaactataaaatgcatcccagttcacagttgttaaaatgtgtatgttggggggtagtttgtaggcattgcatgtatgtatgtatgtatgtatgtatatattagagacagggtcttactccgtcacccaggctggagtgcactggtatgatctagctcactgcaaccttgaattcctgggctcaagtgatcctccagcctcagcctcctgagtagctgggaatacaggtgcatgccaccatgcctggctaatttttaaaatttttgtacaggtagagtcttgttatttgctcaggccagtctcaaactcctggcctcaagtgatcccagcctctgaaagtgctaggattagagaggcatgagccaccacaccgggcctcaactgaaattcttccagagaagatagagaccaaataggcatatctctaagtcctaggtcccatcttcagttatgctagtcagttttttcctcttattcctccacataagattttgaaaagaggtttctactgctaaaaaaacaagtgtgaacccctgtcacacttgtatggccatttctagctttagcattctctaagtctataataatgctgcacaggctaagtaactgagtctcgaatttctgggaccttaactggcacaggcttcttccaaagtcttgggaggcatcctagcaatgtattcacaccaccatatggttttgtcaaattcgaaaaatgatatttttgtattttttttcttaaagaactccctcccctcaaattgtataaacttgaggcggcacaaaacctagatcttcctttgatcatacaattttatatcaagacagcacttaagttggccagaagagtcacatacatttgattctcacagaaacccaggatcctacagatgaaaaatctgaagcttttgaaggttagacaacttgcctaaggacaggtatcaggcaaatccttttgtgaggacttaaaactctaacttcagttctcattccacatccagtcttctttctgcactatcactttagttaacatgggttgtcttggcttgaccaggttgccaaagtgactcttatcataaaagagttctgaattctaattgcaagttctaagactatttttcttttattctgaatgtaaacatgaaactgtaaaaccaattgtagctcaagtagcctgtgaaagtcactttcacacgatgtgtaagagaatatttaccgatttgtattgagtaaaccacctgccaaaccctcacttgggaggccacaccagttccagagaataacaactttgtgttaaaattccagaaaaatatgcctgctgagtatcttttttgttgtgtttgtttaatctttgttaagctcagtgatatatgcacatataagaacatatttttctcatatctgaaatctggatacatacttcctgaaaatgtattactactgcctttgtttttttttcattgcatattttcctttcacagattcatcatgtagtctgaatataatacccactcttgttgtcaagcacaaacagaaaagagtacagtttccctttaaaagcacaatgccctattgatgcctttaaaagtcattaaagaatatctcacaaagcccaggagagcattacaataattgcttccctttcctaggtgaaaaaggacatatctgtcaaatagaaaagtgcagaagcaattaacaccttaatactctactgggaaattgcctgaattaacagagatgcttcatggttattgtatttctaaagtttagttactagcatgactgtcctcagtcatttccatttactttccccaggacaacagggctcggagttaggtatgggcatggcagagggtgtatttgagtgtttgcatatgaggcacacatggttcttcagtcacatgtttcagaggatgaatgcagaagtagggctggtgtatgcacttatgaaatcaatacgtaaggatacatatgttttaaatcaacttctcaggcctaaaaaaaccccacacttctggattctgtgctgcccacccatggaactgccttatcagtcctcttccagggctggggtactcaacagaaagtttatatttaccaggccttcctcagaaacagcggaggcacatgaacgaactggggagtgaatcaaacaggtaaaaacccttgtatatcagcggcaagatctagaaagagcctagcagtccaattcattatctctccctcttccaggagatgttagatggtgtttattgagtacagtctaggcatacctacctggttagaattttgagagacactgaaaaagtaaacagggcctgggtcccttttccttaggaagaaacaaacctgtaaattatagtaaaggtaaagtgtgtttccttcctcccaccccacccccaagcatggctattctatgagggatcagggcaactctcagaattctcagagaaaatcatatggggtgttctagtttccatttttacacaggtgaaatcagacaaaagtgaaaaaagacagcatggaaaaaagaaagtagtaatgaactcaggacaatgctgaaggaggagggggcagttggttcaccttgtctggtgacagggtaatctcaggtgaccttcaggagctatctggctcaacgcctatttccatttggttttctttgctacgtgtctacagtctccacccagtaatggtctgaatacccccagtgtgagaaactaatcctcccagaaagccatctatgccttcttcagatagcttccatggataataactcacatttattaaaaactttatatgcagtaggcctgacttggtatgccatggaggacggtgttctctatgatctcatatgttttctatatgacagttctctatgatccttaactcctgatgttcactgcccttagatgtcctctttccttgagtgtgggcatgacctatggcttacctctaaccagtagatatggcaaagcttccagatgcatgttgttatatatatgccgactatgcacatataacatatgtatatatgtcggcatatatatgttgtatatatgtcggcatatatatgttatatatatgccgactgtagcacctatcatgctcacagccttgtctcccttgtgggctttgaggctggggctgaaggcagcctctggggctgacagccagcaagaaaccaaagccctgaactgaattcggccaacaacctgggtgcgcctgggagtagatcctctctgagtcaagactcagtcgagactgctattctatttgacaccttgattgtagctctgtgagaccctaaaaaggaccagatgagccgtgcctagaatcctgacccacagaaactgtgggataataaacgtgtattgttttaagctgctaaatttgtagtaatattgttacatggtgatagataactaatgtaaatgctttatgtgtattaactcgtataatcctcattacactctcatttcacacaatgggaaaactgaagcatgaaactgaagcaaccagcttaattccacacagtagtaggtggcagggccggcattcaagtaaggcaggctagctccagagcctgcgttcctaaccagataggtgtgctgccttcctatgcttagaaagttctaccttaagctgcttcctagtctgattccctaaagcttgaccccacagcacgaatcaaacatccaaacacaggtgctagtcagagaaactgaaagaaacaagctgtgctggacacacatgtacagggtacggatgtgaaacagggtgaagagcaacaggtgctgcctcccagtattcaccagccaaacgagatgcttctgtgtttagacggtgactgctgagagggggatcatgctggttggtgccctctggcctatgagttctagttctgcctctaagatcatggaaaacatgataatcccttttccatatgagctgaaatatttcaaactattgatctttttttcccccaaatcctctattttctcttactcacataaatggtgagttgtttttgctgttctcttttgcaaatggtcttcttgacacgtgcagaaacaaatggttgtaggctctgtgtggtatcagctggcagagatgcctcgtcttcttcctcatctgcagggctgggtcagggatgccccccacccacccaagatatggttctgataggcagcgtcaattcactgatattctttcctgtcattatagcggttttaaaaaaattatccaggtaataaacaaatgcgttttagtgtaagattccaatgagacagaaggatttggggcaaagcccaagggcactcctctgcactctccttctactcctcccatctcagaggaagccactgtcaaaatttgtgccaacctttcactctctcttttaaaacactaacatttcacctaaattggattgaacaccacaaaatgacttgctgttttccaacataccaatatgtcttggagatcttttcatgacatggcctacaggtctacctcatacgtttaacagttttataaaccttcctagaataatgacatcctaatttgtttgaccattcctctattgatagatattttaggttgcttacaatatttcattaacatcttcaacatgcatctctgtacagactgacttgctattatattttatacccagttctgcccactttcatggtcaactccactctacttgtcctcttgcagctgactgaaggaactctctgttcccacttttcttttttttttttttagacggagtctcgctctgtcgccgccctggctggagtgcagtggtgtgatctcagctccgccttctggattcaagcgattcttatgcctcatcttcctggtataacaggcacccagccaccatgcccagctattttttttttctatttttaatagagacggggtttcaccatgttggccaggatcatcccgaacttctgacttcaggtgatctgcctgcctcagcctccgaaagtattgggattacaggcattagccaccgtgcccggcctccattcccacttttcaacagtgaatcagagttgggagaggtcccttcctattcctggtgacaccctcttccaaaccaactgacattctccctcagaggcagtgactgatgataacagtggttgtcaagtctacttatatatttttttgaagcattcctttatcagattaggatgattctaaaaattcaccaccttttatgagtagcaagcacagttacatcttcatgcacaggtgtgagtattattaaaggatatattcccagaaatattgggaaaaacatacattttaaaatatttttattgatgataccaatgtgtcttccaaaaagtttatattcctatgaacaattagaagtgtttatttttcggtatcctagataacacttgatataatcagcattttaaatatttaccacttcatttattataaactcctaaaactttctttccttcattccttgtgtctgaagagcagaagaagagttcttgccaccataatgacaaccaccttcatctggcctcctagaaagaatagatcctggataggctttattagcttataggcaatgttatcctgcaagaatggtagctaaaaggtgttcaggacaactagaaaatttttccaagttctgtagtcccaaataagaagaacataggcaagaagtctctgcttgtagaagctggtataaagttacttttagcatttagctgaaatactgagctactcagttccaatgttgtacctccagtggcttcaaaggagaaaaatcttaaagtagaaaggattgactttaaggttaaaagaaaccttatgccaaaggtaggcaaaatcatattaaaagaatgccctagctgtttagaatatattcaagtttctagagtcagataaagttaagccagagaattaaaataatgtataaacatgactatgaaatgaagataaaaatcaaaggtatgctgaaaggctggaatgagcaagaatctcaatttctatattgaaggatgccagaaatcttagacctctgggatatgtcctggcaacattttagaaaggattattataccactgaagaataaggaaggtaaaccaccaccatatagaaagataatatacactagttatgatattttagtatttcagtgggacttttagaaagatctctcataataacctgtagagaggatggactaccatgaactgagtgaaaatgatacccaaagcctgcaaatcagcatgcatgggtaaaaggcaagatctctgccggggatgctgcaaagctctgtccttggcactgctatgctcaaaattgttaacactatttgatgcttatcaaatttgaagctaattcattgctaagaagagtagtagatgtatgtgatgatcaggaatagagactatttcatcaagttggaaagagaagctgactcactcgagagctgtgtacatagctgaaagaagacagcctttgaattaaggtgattctaaactcaaatatcagtcccgttgttgggtagacttggacaagttacctaagcctctgtgagccttaatttcttcctccacaaaagagggataacacctctgttttttaaataaataagactgacatgatttttggtacataacagatgctcactagtagtactcttcctcctctcctcttctcaaacattactggcagaatataagagaaataaatgtgcagacaattgaatggagagtacagagttgcacagcattacacagagtactacccctcaagggtggaaacctagctcttaagagtgattcataagaataagacctgtatgtgttagttgatggcaagttcaatataaacaaacatcattatttcatttaaaaatacagtcataatctgcgttgagtattacatccagatcaggtgagctaatggttttcttgaactctgttcttttcagaccagcagcgtggcaaagtgtctagttttggctgctccatgctaaagaccattgacaaactaaagaaagactagcaggatatggaaaacatgttctataaggcagaaccggaggaaggaacatattttatctggtttaaacaacaacagcaactcaagcaagagatgatagatgtattcaagtatctgaatgactgactttggggaagctcagaaagattagaagagccagtgggtagcggttcaagataagaaacttcagtccatcagggtaaggaatgctcaacagagatgtaaaaaagcaggggttactttgtaagacagtaagtttcctgtgtctaaaaatattgaagcagaagaaattagatgtggagtttccaatagtgaaagtagaacacaaaggggaaaatatgtgtatgtgatgcacgcacatatttttttaggtgtttattagagaaagatcagtaagagcactccgagttccactctatcattctatttcatcattgtgtaagggttgatttataatattgatgagatcctaaggcaggtgatgaaaggagactctttgatttgacaaacatgggttgcactctgctatgaacactactgggcaaaactttgtgggtggaacttttaataaagatacattttcagctgggtgcagtggctcacgcctgtaattccagtactttgggaggctgagatgggaggattgcttgagcccaggaattcaaaaccatcctgggcaacatggcaagattgtgtacctacaaaaaaagttaaaaaaaaattagctgggcatagtggcatgtgcctgtggtctctgctactcggatgctgaagtgagaggatgacttgagcccaggaggtaaagcttttagtgagccatgatcatgccactgcactccagcctggctgacagagcaagatcctgctttaaaaccaaccaaccaatcaacaaaacaaataaacattttcttgaatttaagggactataaccttaaattaaatgtaagtctgcaatccaggaaaacaattgcagagcaacttgaaacaggatgagtgaaactgctgaaaacttcaataaaaatataaaatattctgggacaggcatggtggctcaggcctgtaatcccagcattttgggaagccaaggcaggtggatcaacagagggcaggagttcaataccagcctgactaatatggcaaaaccgcggtttttttttttttttttgtaaaaatacaaaattgaggggaggagcaaagatggccaaataggaacagctctggtctacagctcccagtgtgagcgacgcagaagacgggtgatttctgcatttccatctgaggtaccaggttcatctcactagggagtgccagacagtgggtgcaggtcagtgggtgcagcgcaccgtgcgcgagccaaagcagggcgaggcattgcctcactcgggaagtgcaaggggtcagggagttccctttcctagtcaaagaaacgggtgacagagggcacctggaaaatcgggtcactcccacccaaatactgcgcttttccaaagggcttaaaaaatggtgcaccaggagattatatcccgcacctggctcagagggtcctatgcccacggagtctcgctgattgctagcacagcagtctgagatcaaactgcaaggtggcagcgaggctgggggaggggcgcccacgattgcccaggcttgcttaggtaaacaaagcagccgggaagctccaacggggtggagcccaccacagctcaaggaggcctgcctgcctccgtaggctccacctctcggggcagggcacagacaaacaaaaagacagcagtaacctctgcagacttaaatctccctgtctgacagctttgaagagagcagtggttctcccagcacgcagctggagatctgagaacgggcagactgcctcctcaagtgggtccctgacccctgacccctgagcagcctaactgggaggcaccccccagtaggggcagactgacacctaacacagccgggtactcctctgagacaaaacttccagaggaacgatcagacagcagcattcacggttcacgaaaaaccactgttctgcagacaccgctgctgatacccaggcaaacagggtctggagtggacctctagcaaactccaacagacctgcagctgagggtcctgtctgttagaaggaaaactaacaaagagaaaggacatccacaccaaaaacccatctgtacatcaccatcatcaaagaccaaaagtagataaaaccacaaagatggggaaaaaacagagcagaaaaactggaaactctaaaaagcaaagcacctctcctcctccaaaggatcgcagttcctcaccagcaatggaacaaagctggacggagaatgactttgacaagttgagagaagaaggcttcagacgatcaaactacgagctacaggaggaaattcaaaccaaaggcaaagaagttaaaaactttgaaaaaaacttagatgaatgtataactagaataaccaatacagagaagtgcttaaaggagctgatgaagctgaaagccaaggctcgagaactacgtaaagaatgcagaagcctcaggagccgatgcgatcaactggaagaaagggtatcagcaatggaagatgaaacacgtgaaatgaagcaagaagggaagtttagagaaaaaagaataaaaagaaacaaacaaagcctccaagaaatatgggactatgtgaaaagaccaaatctacatctgattggtgtccgtgaaagtgacggggagaatggaaccaagttggaaaacactctgcaggatattatccaggagaacttccccaatctagcaaggcaggccaacattcatattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctcttggcagaaactctacaagccagaagacagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaactggtaccagctgctgcaaaatcatgccaaaatgtaaagaccatcgagactaggaagaaactgcatcaactaacgagcaaaatcaccagctaacatcatcatgacaggatcaaattcacacataacaatattaactttaaatgtaaagggactaaatgctccaattaaaagacacagactggcaaattggctaaagagtcaagacccatcagtgtgttgtactcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagtgacctacaaagagacttagactcccacacattaataatgggagactttaacaccccactgtcaacattagacagatcaacgagacagaaagtcaacaaggatacccaggaattgaactcagctctgcatcaagcggacctaatagacatctacagaactctccaccccaaatcaacagaatatacatttttttcagcaccacaccacagctattccaaaattgaccacatagttggaagtaaagctctcctcaggaaatgtaaaagaacagaaattataacaaactgtcagaccacagtgcaatcaaactagaactcaggattaagtaactcactcaaaaccactcaactacatggaaactgaacaacctgctcctgaatgactactgggtacataacgaaatgaaggcagaaataaagatgttctttgaaaccaaagagaacaaagatacaacataccagaatctctgggacacattcaaagcagcgtgtagagggaaattgatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatgaatccaggagctggttttttgaaaggatcaacaaaattgatagaccactagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattccttgatacatacactctcccaagactaaaccaggaagaagttgaatctctgaatagaccaataacaggagctgaaattgtggcaataatcaatagctttccaacgaaaaagaatccaggaccagatggattcacagccgaattctaccagaggtacaaggaggaactggtactattccttctgaaagtattccaatcaatagaaaaagagggaatcctccctaactcattttatgaggccagcatcatcctgataccaaagccaggcagagacacaacgaaaaaagagaattttagacccgtatccttgatgaacattgatgcaaaaatcctcaataaaatactggcaaactgaatccagcagcacatcaaaaagcttatccaccatgatcaagtgggcttcaaccctgggatgcaaggctgattcaatatatgcaaatcaataaatgtaatccagcatataaacagaaccaaagacaaaaaccacatgattatctcaatagatgcagaaaaggcctttgacaaaattcaacaacccttcatgctaaaaacactcaataaattaggtattgatgggacgtatctcaaaataataagagctatctatgacaaaccaacagccaatatcatactgaatgggcaaaaactggaagcattccctctgaaaactggcacaagacagggatgccctctctcaccactcctattcaacatagtgttggaagttctggccagggcaattaggcaggagaaggaaataaagggtattcaattaagaaaagaggaagtcaaattgtctctgtttgcagatgacatgattgtatatctagaaaaccccattgtctcagcccaaaatctccttaagctgataagcaacttcagcaaagtctcaggatacaaaatcaacgtacaaaaatcacaagcattcttatacaccaataacagacaaacagagagccaaatcatgagtgaactcccattcacaattgcttcaaagagagtaaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactacactacaaggctacagtaaccaaaacagcatggtactggtaccaaaacagagatatagatcaatggaacagaacagagccctcagaaataacgccgcatatctacaaccatctgatctttgacaaacctgagaaaaacaagcaatggcgaaaggattccctatttaataaatggtgctgggaaaactggctagccatatgtagaaagctgaaactggatcccttccttacaccttacacaaaaattaattcaagatggattaaagacttaaacgttagacctaaaaccataaaaaccctagaagaaaacctaggcgttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaccaatttacaagaaaaaaacaaacaaccccatcaaaaagtgggcgaaggacgtgaacagacacctctcaaaagaagacatttacgcagccaaaaaacacatgaaaaaatgctcatcatcactggccatcagagaaatgcaaatcaaaaccacagtgatataccatctcacaccagttggaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgatccagccatcccattactgggtatatacccaaaggactataaatcatgctgctataaagacacatgcacacgtatgtttattgcggcattattcacaatagcaaagacttgcaaccaacccaaatgtccaacaatgatagactggattaagaaaatgtggcacatatataccatggaatactatgcagccataaaaaaggatgagttcatgtcctttgtagggacatggatgaaactggaaatcatcattctcagtaaactatcgcaagaacaaaaaaccaaacaccgcatattctcactcataggtgggaattgaacaatgagatcacatggacacaggaaggggaacatcacactctggggactgttgtggggtgggggaggtgggagggatagcattgggagatatacctaatgctagatgacgagttagtgggtgcagcgcaccagcatggcacatgtatacatatgtaactaacctgcacattgtgcacatgtaccctaaaacttaaagtataataaaaaaaaatacaaaattagccaggcgtggtggcacatctctgtaatcccagctactcgggaggctgaggcaggagaatcacttgaacccgggaggcggaggttgcaatgagctgaggtcacgccattgcatgccagctggggaaataaataaaataaaatattctgggtgttataaaaatgattatggaagggagaagttagaggagagaacccagtggaatggaatatgctatatgggaatgtcacgggcctcagcattagaagggtaagtttaatttgtccctttttaatttgaggaggcagggtttgtaagaaggaagaggggtctattagttagcgctatactgcactgcagggtaatactctgacagtgtcctaggtaatccactctcccagtctttgaaatgatacctcctctctctctgcgccttgaacatctccttcccctccatactctctgtggatgacctcacctcttatttcactaaggaaatagagcaatcagaagatgactcacacatcttctcagcagggactgtagcaccctcctgcctctatgcccttccacactgccttccctcccgctgacccgttggtgcacactggatgcacccctgcctcttttgtttttttatatttgattattttattattttatcaattatgatattcagatatacttcttttttttccttctttttttttattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccaccgtccccagagtgtgatattccccttcctgtgtccatatgatctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgctacattttcttaatccagtctatcattgttggacatttgggttggttgcaagtctttgctattgtgaataatgccgcaataaaaatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatgatgagcattttttcatgtgttttttggctgcataaatgtcttcttttgagaagtgtctgacccctgcctcttcaaagactgcttttgcttttatcccctcttcctcctgcacgattttctctcattccactatatcatccgcatcagcacacgaacatgctgcatcctctcttatgtatatattttaaagttctccatagaccacatgctccctctggccactctcccatttttctgctccctttgatagagaaactctgtttagagttgtccacattctctgcctgttactcaagtcctattctcacctccacccattcaaatgaggcttttactcccaccttttcaccgaatctatttttgtcagggtcaccaaacctctcttcttatagaatcttatggccaattctcattcatctcatcatcaatatttgacctagtttttctctccctctttagtgacatgtggctcataacttggattccagggtactacattctcctgatcctcataatcactgcttttgtttcttcatatctttggctgaatcttccttcactgccaacctctgaggcttagtatgccccagtttcaaaccttggacctcatctcaatctatctgtgccacctagaagacctgtcgcccaccctcaagggtgtaactaccattgacaaactgagagcttcaaaatttctatctccacctaagctctcctctgagttccccactcccctgttccactgatccatttcttcctgggttattttctgtttcagtaaatggcatcagtatttacccaattgttaagagcaaaaaccctggaattatcccagacttctcttttcctctctcagcccacatccaatttgtcagtaggttatttaggttctttcttcaaaatttgaccatattttactacttccacctctacctcctagtctaagccatcatcatttcttgcctcaaatactgtggcagcctgctaactggtcttcttgtttccacttttgtctccttaaagtctattttccatatagcagttagagaaattaaaataaacaaaaaagaaattacatcaatacattaacccctacaatggcttcctatactgctcagaataatatccaaactcttaccatggcctaaaagctctacaggacacagccttgtctcttctccagactcatcccttacaccctcagccttgcttcccagtttctggccatgctcagccattcaatttggcataatattgttcaacctcctctctcttttcttgtttcttttcacttattagcagaagtttctttctctgtttatttaaaagccaaggtttttctgccttcagggactttgcatttgctcttcttttggcctagaatcctcttcctccagatcattacgtggttcaccactctcaccactcatttcaggcttactccaaagtcaccagctcatggaggccaaccttggcctttggaggcaatggaggcctcaggttttctatctgagcatggaccccataactttctgctcccacactctctactgtttacactagttcatttccctttattgtacatagcatagcctgaccttaggccaggcattcaatgtttgctgaatgcctgtttcaactgctagcctgccagctccaggaggacagaggctaataggctggattcacatctatattcctagcaccaggaacagtacctggcacacagtgactgctcaacgagtaactgttggataattacatgttgaatgaatgtatgagggtcagtttagaggaacactcagaatcaaaaagtgagagatcattttagttataatggatgtagcgagcaagtaaaggatgggccagagcaaaaaggagaatgcagcgagtgtgcacgggtgaagggcaagggatcaatgtgtcagtggtttacattccgtgcagaaggcagaggggttccaggggtgcaatcaaactgctaaagagagcaaagagctttgccaggtgctgtaaagtatttccacccacattttgaaggggaaatctttataacatctgtttaatgtgtagcccagtaataggttttagaaatgtataagaatatttgattttaaaagaatttgtgtatcacttatatattttatatatttatatatagatattatcagagtcagtgagtcaagactgactatgatgccacagaacacagtgactcgtttcattttctcggtgttattttacagctttgcattattctgtggttttaaaggggaaacataaagcatagttatggtgttaccagtttcagaataagtagttaaaagccttcttggccaattttaatttttttccttgactggaaagctctgaaaggcataagtgtatggaacgaactgtaacacaacccgaagccctggtagttcgcctcctcggtttctcctggtactcagttacttagagagataatggcatgagccctgtgaccccaagccattactcattaacccccctctaattgagggctctagtcaatgaggactgagatggatggagtctgtgacttggatggacagagatcacccacattcagaggcttctgctcacctcacactttcttgatacttctgagcagaggctcaactggccttgagaagtcagtcttcacatttcattctaagtaaggattctcttcaccaccttttcccttccctcactactcaggattatggtcaaaatttatatttaactggggtttatccaaggtctaccgttttctagccctgtaattttagacaagcgactttagctctcagaacttcagtttgctggtggggtgcagtggcttacgcttgtaatcccagcactttgggaggccgaggcaggtagatcatgaggtcaggagttcaagaccagcctggccaacataatgaaaccccatctctactaaaaatacaaaaattagctgggcatggtggtgtacgtctgtaatcccagctactcgggaggctgaggcaggagaatcgcttgaacctgggaggtggaggttgcagtgagctgagattgcaacattgcactccagcctgggtgacacagcaagaccgtgtccccctcctacaaaaaaaaaaattaaataaataaataaataaataaataaataaaagaacttcagtttgctcatgtgtaacaggggaattaataaaacttattttcccccggtgatgtttctgaggaagaaatgagatgatattcataaaaatggctagtccaatacttggtacttagcatgaaatacatggtaactagtacttgtataattattcccctcccccaccttctctctctctctctctctctctctctctctctgtctgtctgtctctctctctctcttactctcgctctaggttaggttactcctatgatcatttcattcttgttattccctaagctttggcgtaatattgttcaacttcctctttctcttttctcgtttcttttcatttgttaaaagaagcccccaaagcctttcactgtcattcaaatgacatgtttctgcactacaaatcaacaactacttactgactactgacaaagtgaagttttgtggttgtcaaagtcatgtcttctgagaagcatctcattccaagtcagtgtttcccaaagtaggtgtgtataaatattgatggatgcaagatgatttaaggtgacatagaaacctttgtttttaattttcagagttagaaaacatttatttatattagaaaaatatgattagcatataaaattacagagagtaaagcctacgataaacctaagtaaagaagtataccaatttaaacttacttaaaataatattaattatagtataggtggaacacaaatatataacaaaaatcatgaggatgacatgtgagtaactgacatttgggaagctgttctgagtcaatataaggtcaatagataagaaaagagtattaataggcccaacttctctattcaacagtaatctatgtaagatgcttcttcactttcctcagtgccaatcaagccatacatcttttacccaatttaattttctgaagtcacctacaaccctaggttgaaggtctagccaaacccaggaatgagagaattaatttttttttcactgcaaaagtaatagagggaagagactttttccttatagctcttatggacatatcctcagtcggcctctaaaatttttctgacactggaggctgttgctagctgtcatcagagtcactccgataccacatgtacctggagcacaacattgaccaagtgccacctctcctgtgacaaaggggtacccaaacggggattcgggaaatatcaaagcacagtcaccacaaaaaaatttcccctaaattgcatgctggaagaattattgtttaaaaatcacttgctgcatatgcaccactttattgtatttcagccaatgtttactaaggcatgaaagaagttcaaacataatagactgtcattcctccaaatcactaatgaaagctatggctctgaacacacaaatcaaggtgctggttttgccttgtgctatttgaggagcactcagtatgtactcccagccacatagcaaactggatcagttctctggaggagataattaatgcgtacctgccataataagtaatatgttcggctctgcattgctctatttatagactagggtttttcctcatattttttagcacttttctacaagcagaacatgtgaatgaatcactcttatcttgtcaattttattattaaatggtgctcaactttttcctagggtgttttaggactgcacagacattttctgggcaaacagaaacaaatgaggctggggggaacctctggcttttcaaagtctctagcttctggctgacctatattccattcattagtcttgggcagcaggcattttgttggaaatgtcatgttgggtggagcttcaaggccaaatgtgagaatctgctgcagcatacaatgagacagaaaacatgtggtcaacagagaacttgttgcacttttttttgtaggaaagtatgccagtcttagggccacagattcctcacagagaaaatctacctgctgacttttgcttattcattcattccacaagtattgatccaatacctaacatttactaagcactgttctatgcactggagataacaggtgaacaagatatagaggacctgccctcctgtagcttacattttagctagggactgagaaataaaaaaataataaatttatcagttaatttcatatagcgataactactatggaaaacaaaacaagacatgggagagggacagaatctcaggtatatttgcaatgctatcagtcttgactttataatcatagaaacttatctgtaaagaagcaatgtaatttagctactttcttaaatattcagtaattttaacactcgtaaacataattttaggttctttcttaaggctgacactgaatggctttggcagagtacacccggcccttagttctcattgtcctcactttggcccactgggagcttgtgaggatacagggacagcccaactgagaagcaaaggtacttatcccttggtattttccccatgttgatcatgtcctcattaatagcagattttgccttagtttctttgggcagcaaccgtgtactttgtatgacatttcatacttgcttgattcaactgactttggtttctcatccctgagatgcactcattttttttgtttatttttattttttactttttgagaggggctctcactctgtcacccaggctggagaacagtggtgcaatcaagattcactgcagccttgatttcctgggctcaggcaatcctcctacctcaatgtcctgagtagctgggaccacacgtgcatgccaccatccccagctgatttttgcattttttgtagagacagggtttcaccatgttgcccaggctgtaactcccaagctgaagagatctgcccgccttggcctcccaaagttctgggattataggtgtaagccactgtttctggcgtcactcatttttttggagagtctcaatagtagaactaaccagatgaagcagaaccaggcatttacacacctgaacagtggtatagctgtaaagtcctagtgtaaaagtcacactatatatcttctgtaataataaaaaattacacaaatgaagcatctaattatatgaataaaaaagactggaaacatttggaacagagagggcagaaccttcaaattcctgttgtagcctcttaacttaaggttaccagctcctccctggtgtcaagggtatggtattatggggattattttccagactttgattgttcaacagatgttgaatttcctggatgcattctaatcagcttgactgtatacatcttgggctactggacattttagattctcagcttcatatttttactacccacttccaaatacctaaatgtgagcaacaacaaagactgatgtaaactgtactcccttaagaccaaattgataagcatttcttacagtctaggaggggaaaagaaatcccacacaaacattcatggcattattctggatacagatttaagaaaatttccctgggtgcatcaaagtttagaaatgtaatagatatgaatatttgacatcttcctgcatttgtcaattgtccagaattctttgggcaattaatcaagagtgacataagcaaaaaaagatgtcctatatagaaagaggaggcaagtcaaataagtaatatactaactctaggctttgaggtcaagtgtagtatcctgtcttcccttcacaaatgagacagacattattaaatgcctcatctctaagtgggcaagaccacaaattattgcaaaatatgccaaactcaaagtctgtacagattttctctaatgacttggacaaacccttcaagtggtcaaacttcatttcaccagtaatctgtcaaatacaggagaatcaatagattctttttaataaacattgatatatggtagaatctgttagttctgaatacctttgtccttggaatttatcttatttttgaaaactaatggggagaaatgaaattgaaaatacatctccctaatatttttaatcaaatattaagtctctaatacaaacttaaactttggtgtcatagggacactcatgtcattttttactatcatccatattaaaattttcattaaaccttatggaaaactaaaaaatccttttattcttacatttaatgccatatgagacatgattaaaatgacaagttcccaaataacatgaataatgtatttctcctttatcgaaagcaaacgcattttgctcctaagagtgtttaatccatttcctttttcaggaagaggaaaggagggtgataaaaggatttacggttagaattggtatttaatgaaagacacatatttggcttgtgattataaaataactgctgtagttattctgagtttagataggagtcatatattttgacatgaataaaaacaaattatgattctgttaacattcagatttacctctttaggacagaaatgtttaaagttactctgtattagtcatggaaatagtagagtctatattaagaagccttatttctgtgtatgtatataaatgttaacttcaggaagcaccagatctacatttatagaataagtttcaaagaacagcttaaaatatcataaaacttagatagagaagcttaaggtgccttctgctactttacactctttttccactgcattccaccccattcatcagagaaagtgctaatatgaacggtcaaatccagtcatcaactttggaccactgggagtggagctttaggggagatataggcaaaagccatagctctgttaagatttcagcctcggctgggcacggtggctcacacctgtaatccctgcactttgggaggctgaggtgggcggatcacgaggtcatgagatggagaccatcctggtcaacatggtgaaaccccgtctctactaaaaatacaaaaaattagctgggtgtggtggtggatgcctgtagtcccagctgctggggaggctgaggcaggagaatggtgtgaacccgggaggtggagcttgcagtgagccgagatcgtgccactgtactccagcctgggtgacagagcaagactccgtctcaaaaaaaaaaaaaaaaaaaaaaaaagatttcagcctccttgtgtttgcttactccccagcagctgggacaggtcaatggccctggagctgcatcttacttgggaggggcctctgcatggagaaggtcagaaactagtacattagccaaactctcctttagggcttcttttcattggtgcacttttctctagaggcatctttccatgctaccggggtgttaaaaataccttgagggaagtaggattgggagtgagcacaggagaaggagactaagactgtaaatgtcatctagattaagcttgtccaatccacaacccataggctgtaatacagcccaggacggctttgaatgtgccccaacacaaatttgtaaatgttttaaaaacattatgagatttttttgtgattcttttttatttttattattactttttttagttcatcagctatcattagtgttagtgtattttatgtgtggcccaagacaattcttccaatgtggcccagggaagctaaaagattggactctcctgaattctggtgcttacagctctatatggtccagcttagtccaggagtggtcaggagaccacttcaggatttttcatttgaagctctggtaaataataaagaggatacatttacttggccttttcctctgtgcatttttctctctctcatggacttagtgggggcacaagtggacatggtaggtgattgctcaagacttctggatgttgggtttcacctctctttaagttacttcttggccaaagatctgagaatactcttctttttgccagaacaaaagttcataggtacttttaagtaagacagtaagggatcagaactccatgagtcattagtcagtcaggaggcaatttccaagaagtttgttaattctctccctaaaatactattaagtaataatctactgttaactactttggtttcttagccctctggctggtgcaatcttttttcttgaactgttctaaataactaagaaaattctgaacactcctaatatctctggcccctaccttaagagagatgaacaaaaagggttctatcaatggtcaagctccaggaaaacatctcgtaaaactcaccaacagttaatgattccagtgacttttaaatctaacataaagagaaggaaaaaacaaaattcatgatgaaaaataatgtgtgccacaaaccagggattatgatgaaccaattctgtgtatttaacatgtaacttaaaaaactactttatgactttaagaaaaaggaaggccttcaaatgtgttgtcatttagaatgtggcattagagaacccatgaaaagaaaacattgataatagcatatttgcttagtatcccatagagttgtaaggacactgggaagtctcctgcttcttcccagcagtggaatactcagtaccagtgaatgtagggtagccaagaaagaattgatgggtaactgatattcttgaacttcaaacgggatatttctttaatgctgacaaggagaaagaggataacacagtccagagctgactgtaatagtttttctaaatgcgaccagcatgaagaatgatgttttataggataaaatagaagacatctcggcactgggtgatgccatctaattgtagaattcaaattgctttagaatcttcaaagcaccaaaacaaggatgtataacatattcataatatgtgtcttcataagtcctatactttcaaaatgaatctgagcctttggaataagagtgaaaataaccacctgaaatttttataaaaataaagaataatcatgaagagagttactcacaaatgggattcatcttgctctttattcaaatggaaaattcttcctttcactgacacatttgccaaaccattccagttaatgtaggaaacaccactttgtttctcctgaattgctaaaactattgtactctaaaatcctgtagctgaggtttagctgtactcaatttgcttgtataaaatatataatacatcattttacataaacgtttaaatgcattaatgcttttaactcttctaagtacaattgcttccataaggaatttttccatgaattatttagttcagattgtttgaatagcattttgaatttcctttcctctttaatttcagaacttacatgtttttgtgtcattcacaaatcaaagcttcaaaatattgacgttttggggtaaagacatttaaagatatttcttcaaaatgttttgttggaaagacatatatatgactcattgtattacaataatatgactcacactttcctaaggaaacaaaatcacaaattttataagagctgtccaatggaagcaaactcaggttcaaagagatgagaagaaaagaataattttgcattcagcatacatgatctgttgcggcaattgtgaatcccttatttctgccagctatggctcagtaaagaaatggatgctattgtgaaagtcatcccctgaaaatgagatgagagtaagtaaatgagtagagttgatacaaattcaagtcattttgcaaaggattttacaatgatggattacaagatgaattctcacaagttggcaaggttttccaaagtctagcttttatgaatattgtttgaacaagtgttgtagaattcagtctatgctctgtgaaataacatgatttattattattattattatttttaccaagttggaattatttagaatcaccaaataacaggattcaaaagtaaaacagctgaaaaatccaacagtctggtctaacctgggatgctctgtctcctcacagccaacgctccatcaggcggctttgtctggctggcggatttagtgtagggactctcatctgcaaaggtacaatgaagcgtttggttaatttccatccagtttctaatgcagtgaagatttttaacggattgcaatccttctgcgagagagaagtggtacagtacagtggaaagtgtcggtaggcctgggtcctatacttgggttagctgtgggataaatctttgaaaatgttgtgaatatgtttcttcccctataaaagagagataaaattctcatctacttcttagggttgtcaggatcaaaagctatagtgctcgtgaagatatttatgaaacggtaagaagtatgcaaatatagtatacaaattatttgtcacctacatttattgataaataaataccagtgaataggtgtaatgaagacaaagaagaaataaaatggttcaatgggcactaagaataatcaggtagaaagaagaacaaagaaagtaaaaaggaaggtaatatttcagataagcagatgacagagagttagtattgcaagggaaataaagccactcagagttagtaggttcctcctgggagtgtgaactggcagccagtgcaaagcagagggatagagatgttcagagggaagaccagaggagctaggttgagaatagggaaggaacgatggtttggcaaaagaagacatatattgcaatgagctggtttgtgctcttttagaaagagatgaaaataacttgcagaattattaaaagagcaactgagaagacagaaggtctaaagcttaatgtatgtgtgagagttaggtaagaagctgaatgactaaaacagcaggtgacaagatcatggagacaatgggtccatccagctctaagtaaggtgatttttttttaaccttgaaaaggattttatctgactaggaataaaggagtagtaatctaggatggcaaatattaaggttaaaattgaaaggacaattcttcctaattgggatggtggcatttataaaaagtaaaagaaatgtgaataacacccttaaacatttcaagaataagatgcacatggcttgagtaaatagaatgtaaaataattatctagcatattcagtcaagctagataatctaaatgtcactgctggccacgctataagatgtatcgttgttgttaccattttataatagcaggaaatcgttaaagaatttaaagaaaccatactgtgcatgacaaactattacatataacaaggatttattcagaacaaggccttatcatctgagaatattaattctcccaactaaatagcttgtgtttcaaaattgaggaactcatttcctctctaggatgaacttctggtttgaaatgattcatgatttcttcataaaattaacaaggtctttatacgcaatgacaaaaggaaaagattaacactgctgtaagtggcaattaacttaaaaaatagaagtcacgctgtttcatgtttatatttaatttgtcacacaattttttatattcttccaaccataaagataaactaccaactttcagataccaattcaatcaatatcgcttttgctttagaagtggtatcttaggtcttcgactcttctctttgcaaacaccattttgagtataattaaaatccacaaaacaaaatacaaaatgtaaacattacactataaaagtctccctttgcctcaccattgtcacttgaatatttgagcgcttttctcacagtgttaataaacaggcaatatgcttcatttagcaccttttaaaacagacgtactatgtattaaaacctgggattctttataagactgctttaaaaatgtatttcctttcattgtccaaaaccttgaaacagtgtgtttatgagcatagagcactgagccagaaaataatcacaacaaccaggcttaggtacggcatcttggaagcctaaaagatttcctcagttttctatttgtcaagattccagccaattaaagtcttgaattgaatccagtgttggatttttataaagggcaataagagattttcccaggagactctggggttatctgcacttgatgctctattttaaggagctagttctttagaaatgtacccagtttgcatttcagaagtagtgaaccctggtaaaatggttttctcatttatatttgaaaacaacttccttgatttagaactgagatagtctagttgagcacatctttaaaaggttgaaactgaattatagatgaccacctggccagcctctccatcaccacccccaacctccactcctgctcccagtatcaagagtgaacttactgagcacaggcaaaagtaaataattatctagaagccaaatcttgtattggttaaaggatcagaatgaaaaagttcagtgttatctaatgttgtcccaagcagtgttattgctttcaccctcactgccaaagccaatcagtgtaaaagcaataattcctaatggaagggaggcagaggcttggcaacattgatcatcagagttaaggagggcatagcagcagagcagcatggcacaatgtaacacttggtttttaagagactttccttaagagtgtctctttattttaaataccttagaggcaccatggccttttataaaaagctacccatcacagaataaacaccagctctcttgacgtgatttactgaaagtcaactcttgattcaaacttgtttgaaaatagaaatggagaaaacacactgaatgaatccgtggctgatggctccacagtaggatactaaaggacaagagtgtccagggtgcatttcaaacccttgagcgtaaagtcatggagaactatggaggcttctatcttctcttgcgtctctaaatgcagctttatagatatatccctagaatttcatgcttataagggataatctagaccactctttcattataaatggaactaaggcccagaaagataaatttatagaagggcacacatctaaattgagtctagatgaaatttcttatgttcttagtcccatgttctttcttctttatcttatttccttttagatagacaataagatttcataagtcattgggtccacatgttgctgtgtcacaggagtgagtgagtgggcacactgtaccagcagagaccttgtatggtgtaagttaattgctacagtgaagcctttgaaaaggagcctgagccacagagccaattattttcgtgtgtatataaatcccattcttccctcctccacatatttgttgcctaaagcaaacaacacttacaaatggtactacagaactaatttatgcttttcagttcatttccttgaagataaaattcaaaagcaatgtcaatatagctcactgatccccaggatgagccttaaaagagtcactgaattataagatctatgttaataattttcctttgtttcattggagagatactaaataggctttcaagttacatccagatatataaacgaacaaaaaaaaggtcaaatgacaaggaaagaaatcaatcagaaccatccctagcacatcgtaggcattcactaaatgtttgctgataaaatatgtgaattaattatattcactttttcaaactagagcatttattgtaatcaaagaacctgaagaaagtgaaacatttgttataaagctatattccctcctacttctgcttttctttttctaggttgatagcctattccttttaaagtcacattatcatccaatagctattaagtattgacttaatgtgaaaaatctgactataaaaatggtatctacatatatttccttccattttcattcagattatagaatgatttattgaccaacctttaaaataatgtctttaaacaaaagaattatgattttcatagcagactctcagcccagacttcgatgatcatattaacaagggattctcactaaaagtcactacggggcaaagcagacattcagctagtgagctactgctcgctgaaatgaatgctccaagcaatcattaagggcatctcagggtatcagcactgccagccttttctaacgacatcttagcagctaggtaatcaccgtcacacatgatggccctccacaggggcttacatgttggtcacaataaggaagaacatgggtccctttagagtgacatctcatgaggctagggaaaaatgccctccattaacagggagaattgacatggtgacaaaggcacagaaagcattagtcaagcatacacttaaagcagaagaagaacaataggagggaccatctgtccctctcattccccccaatttggccagtctcctcatgtgccaaacactggaggggcaaacacagatcatttgttttgatcacatgaagctggtgtttataaacttggaaagcaaccagtgggcacctaaggagcaatgcttcactctgcatcacaaactgcctatgctggagctgggagaatcacattgtgaggaagggagtcaggtctcctcatgctctcaaatcctccaacgtttgcttggtatcaaacagcatccttgtgtcatcaggctggttcctgtttctccatttcctgagactctcatttctcactctgggctatgcagaggcacccgatatgaatatggtttcaggaatctctagctgtgttcaaagctttgctgaagaaagaaaatttaatttcctttggctgagactaatcgtcctatgctaaacaattcctagcaactaattatgcacaattgaggcacctgctaagccagcagacccccttaacatcttgattaggaaaaaataaggcatttggtgcagttaaacattatgaccatttcccagcagagaggagacaggcagggcatgccacagtgttcatgcatgtccttacaaacttgaaagaaaagtctggtttccattaatgaacaaaataaaatccgctgtggatgaaacaatctgtcccttgaattcaattaaatgccacacaatttagtacctactatgtgcaaactaagactaaaaatacacaaaagataatgacaccttcagtggagtggtgatggcagaatcattactacctacatttgagactagaacatggtactggattacccgacggggtgagtgagcatgggcttagggttaggtggaggtgaagcacaggatgagaaagggagatccaccattaggaatttatctatggttttttaatcagaaaagtcaagaaacaagccattttaggctttcagataacatggtagttttgtgtggtggggagccataatcttttcagtaactgggtcctgtgaacattttatcccagtcagcatgaacatatcatggttgcttctctcccatagacaccagccttccagttccatttgcttccctggtggtttgacagcacactttgaaatttaagcaagatttcctgaaggataactgttaaggctttttgacaacagagcttaattatatctttctcttcttgctaaaatgatgtgtaactacaatcacgggggccccgcataatttaaagaaattaaattgttcataattcctgatccaaataaccctatttttctagggccaagcaaaaagtgcattcatgatctctcctagagtcagaaggctgccaagtcctacacaggctttggctctacagctttggtatgtggaggctgcaacatttcatttccttccctaatctgatggagtggtccatacagctaagtttacaccagaagattagggaatgatctgagcttgatggcaagaagcagaggcagtgtgcttccctgtgatagtctctttcctatgaaaagatgacttcccccttctaccttccctcctcccttttgttatttgttttgcatctgcatggcattaatgtctatccttgactctgcaggtttcctcattgtttcataattcagacacaaatgtgctctatattcctaaagggaccagatcttttgcttttttttttttttttttttttttttttgagatagggtctcactctgtcaccctgcctggaatgcagtgatatgatcgtggctcactgcagcctcaaactcctgagctcaagtgctcctcccacctcagcctctgagcagctgggattgcaggtgcatgccaccaagcctgacttttttaaaattattttttatagaggctaggtctcactatgttgcccaggctggtctcaaaaactcctggcctcaagtgatcctcccacctcagtcttccataatgctggattataggcatgaaccaccacatctggctttcttttacttttgaactttggaaaaaaaaaaacacccaaacagagcacaatttcattttaagaacaaatatagagtggtttcttcacaatgatagaatgtcttctaattaaccataatctgataaacacttcagggattaaatattgaagctaaaaagaatggcaacaatatagctcacattgttttaggcctgtgttataagatcatttcttcccctactgctctattatctaactcttgcttctcaaaatgtggaccatggatgagcagcaggagcatacctgggaactgtcaaaaatgcagaatctcagcctccaccccaacccagggaatcagagtctgcatttagcaaaatctccaggttatttgtatgcacgttcatgtttggaaagccctgctccaactgatacgaccaacagcaactgcacaggtagtgaggatacacctgttccaatgtctcacttggttgcatcagaggcagcctacaaagcagctggcagaatgccagtcatatcagcaaattccaagagtatccccaggcctgcaatgatcaaattgctcatggaatggtttcttcaaatggaaaggaaactgttgtaatggtatggttttgagtgaattcaatcttcccttgatccattttaaacctctcaacaatcctgaaatggctgaattataggagtaactagatctatctaaggtcagattcactggagcaagtgactgattgtaataataatctattagtcaatttacattttaaggtggagagaggaaatggtattgaattactaccccttagctagtaaaggtcaaatgaaaataaaaagttatattctgcctcatggcagggacatgagggaagaatcttccatggcactgtctccttaaattcttcctcctcagatacaaatttgcttccttgcatctgcacagttctcctgcaaccaggaagggctccagcacagaacccagcctctgatctgcacacagggacaaacagaactgcgatggccccggagcatctggacaaccttgtggaagtggtctgtgctagctagtctgctcagtgatgcctgcaggccttttgggaaagtaatatctttagccaggttaatttgtaaatcctctctgaaattaatgagcatgaaattgcacattttctgcctctggcattcctattcctaatgtgtctgaatcacaaatgataactcctatgcttcttcctaatattgtttccagcaaggacagctgaaccagtctgttaatggcagtcacagacctgcctcatcaccgaagaatcaaaatttgtcaagggctggaatgtattccataaagttcattttcatgaccatatcagatcccaattaaaaacattaaaatcttaaattcagtatatctttcacattttttctttgtgagagggctatgtgctttaaagctttggtttagccatcagattatgccagctgacattttcagtctctcataggttcaataaatgcttagctttagaatgacaatttggtgcaaaatttggattgcctcagctgacattttcagtctctcataggttcaataagtgactagctttagaatgacaatttggtgcaaaatttggattacctcagagtaatgagtactggctatttaaaatcacattttaaattcttgtttaaaaagcacactattcttcaggaaaaagtatgtattaacaggtataaacttgctagaacatatccgagtattcctggagggataagaaccagtgtttgatttcatgtaatggcaactgagtggtaggattaatagaaatcaataatacatttggagtaattaaggtttctccatttttttttaactaatgaatatgaaattcagaagtcacttatatatatatatacatatatatatattcacaatttggactgcagtaaatttaggggaaaatttaaaatagtacataggttttccttagataattcaagaaagaatgtttaaaatgttctcatggaaaagactgaaagtgatttttaaacaaataagaatgattagtttcaaaactgaatcatttaaacaattatatctcttgactacttaaattgcttctttttttgccccttgtttggaacgtttttggatttctaatgtaaaccgtagagaaaaagagggagctttctgttaaatcagggctctcaagagtccttcttttacatgacattactgcaaaggtttccatatttagaaattttcagtatgatagctgctagaatgaagtcaagactgatgggaaaacaagcagcagcaaaatgcaatcaggatgacttcatttgaagaggtctaaatcttgtgccagtgtgtgaatgagcactgatgtctaggaaaatgatccacatatatctgtggggcggagcattcctgtgtatgtttgattattgagaaattagcctttaatgctctcacctgttgctctgacaatcggtgacaggataaaactttataacttcggtaactttaaaacctggttcagtggctcactatgatctttccttctttttttctgttaatcaagtgtagtgtaaattgatacatgtcaactgcaggcaaattatataaataattgatcagatagtcaccactgctgagaaatttctaaataaaatggaaataaaagtattatcaccactgtttagactcagtttccaatacacaaaatgaaaatgcctctatatctagcatcctggaataacaaggggacaatgtatagtatatatttataaccttgagtaacattttggagctaagagcacagatgattcttcccagggtcattgatttgactgaggaacaagggctatgtgtgattgcctagatgtgtgaaaatcactgtgcaactctcaactccctctctcgtgtcttaagtgtgtaacggccttagaaacaatggtccaaaggatgttcccaataagccaagggaaaccaagatttttccaggcatcaattttcattaatttttaaaacagtgaaataggtgatgggactttgtggtaatggagaaaatggattaagtcagaacttatcagagtgcaaagtcgatggcaggaaaagtaaacctcaggttgatgtccctggttgtatgtaaggggtataagttacacgaagaaaaatgagagtttaattataatcatatatttttagatgcctctttcattaaacagcaatcccactggtttcctctataagtaatctaaataatttcttagagatctgttatttcattctgagttcagtttgagtgtacttcagtcaaccagaagcctttttaatgtaaatgatactaataactttataaataattagagctaatacttacagagcattcatgagatgccaacatgagtctaaatcctttatatgtataatcttatctcttctcacaataactcaataaaatgtaaaataacaaaacagataattccattttacaaaaggagtagtggttttaagaaagaatttgtcctcatctaaataggttgcatggcaaatctgaaatggaactgctattatattaaagcctagggcagggcaggcatattacatgcctagcactctgcttggtacctcacatacattatcagtactcacaacaatgtaattgcacaggtacaattacataacttgaagtatggggatacagaggcttatagagatgaaattatgtgcctaaatttaccctggaagcaacaagcaaaaatgaagctttaacatacgtatctctcttagccaccacgatacactgtttaccaaaatttgattcacatccttacttggagagagagagagagagagagaaagagagagagtgtgtgtgtgtgtgcacgcgcacatgtgtgtataaagaaaggcactccttcacatagtagccactactgtgtatattctgcatgactaaatgtcactgatatagggacttggggctgcatttgaagatcttctgaaattgcagtttagaaaagaatatatcacctcacccaatttttagacatcacttcttcatcatgaattcttggtttaatttatgatataagatgcaagattctttccagcacataaacaaatcacttgaatgaatgcattttagccaagaagctccaagcattttagaagatgaaatctggctgaatttatttctctaactcccactctgagccaaccattctctacagatagaggatttatgaacttgttcctataaatggtttatcattttaaaatgaataaatactgggacactctcttttctcctttagtattctagacaacaagttcatggccttctgcttacaatatttcaaaccttttatgagtgttcatgtagccagagtggggaataaatcttggaccaggccacatctagcaacacaatgaagaaaatggtggtatgacttgtgtagctggcaaggagatcgctgagtctgcctttccttaccctctggctctccaggctcatctctacaaagagccaagctccatggcagaggtgctgccacctcaattctcagactcaggagtagctcatgcagcagagtcactgggtagacaggcatgaattttttgctagacttaagaattttctgaggaacttttgaaaccaaggtgattaacccactagccattatttccaagactgtcatccctcctggccttggatcatttcaggacctatctcagaactcacttttttatagactttagttttgaaaattcccaaatttaagctcaagtcctaagagcaggccagtgtcattatacaccatcttagaaccaacaccttcttgtctcatgtgggcagcaggtggggagggaggcaggggcagaaatcacatttggatgccttgggaataacatatttcatacacatgacttgaattgtcacatattttgctttattaattcattgctggatcaggcaatagcagatgactgcttatcaaacagatgacatgtgtttttaatgcacaattaaagtaggatttatcacggctgtcagaatccagggagtctgtgctttttgttattcaaagctgtagtttggatactctctggttttacagtgagatagtgattataaacacaaaacctcacaaaagtgttagaccagagagaggttttttgtttgtttgtttgttttcaacagtcttgctctgtcacccaggctggagtgcagtggtgtgatcttgactcactgcaacctccacctcccaggttcaagagattctgctgcctcagcctactgagtagctgggactacaggtgcataccaccatgactggctaatttttatatttttagtagagatggggtttcaccacgttggccaggctgttctcgaactcctgacctcagtgatcagccagcctcaacctcccaaagtgctgggatttcaggcataagccaccatgcccagcccagacatagtttttgtatggacaacatcaacaccattttcaactcactagagttttactgtactgcatagctctaccacttactagctgtgtgacctcggacaggttcagtttcgtcacctataaaatggaaatagtaacgaccacataggattgctgtgaggattgaacaaagcagtgtaaataaagtacccagagtggtctgagttcaagaagtggtggctctattcctttatctggaatagatgaggaagctgagtgatagacaaggaccagtaggaatcccacagtaacatgaaacaaattattattattattattattattatattatatatatatttttttacagcacttataatcctaccttaaaatcatcaacctgcttattgctatgctgtgaactcctttgagtaggggatttacttttacaatcatgggtattattacctcaaatttcacagatactaaaactgaatctctgtaaaactgaatctcagttacaaatctgtctaaggctatcaaaagctaataagaatcagagacaggattctaacttaggtctgcctgaaacaaaagaccatccttttcccaatgtcgccacactgcttcaatagagggggtttgcacaacacacaatcattagtggaaaggagagaaaactgggacctgaccattataaactaatcttcatgcaactcaaacctatacctaactttctaccacaataatgatgcagacacttgacatacttttggttttttatttaagctatgggctatcatacctgagtttttatgaagaaattcattgacattaaatggtctattatgactcaatttgtcaatggaaaataaaaattaaaacccccagatgcttagatttaatagtccaaagatgaccaaattatcttcatttgcttctaagacaaattattcagacatataatttcctcacaaattacttgcttgtctaactctccttgggttatgtctacctcatcaacttcactactttcttccataaatcttgcctgaacaaagattcaatttggataaacaaagaaaatgcaattcaattccacaaaatgtgattgtttaattttgaactgattttggagcattatactcaggactcttccaattttgcagtaaatgagttactgacatttacaaacatctagaataaaagaaaccattccttccatcactgtttgtcaattttattgttgaatctgctttgggacacttcaatcatgaaagtaatcatgtaaaactatattgaattctattagtaataataccttagaggaggttcatttatgataactgaaattttctctgactcagtctcatcagccatgtattttgccttaaggtattttaaaaatcaagaagtcaaagctttagaagtgtactcctaaggccttaactgaaccccattatattttgaaacataatttttatgaaatacaatattgatacgcaaatcagtcagaatttttgtgtaaacattgtttaaagtttctatatcagttgaatatcaatgccttatgagaaaatcaggaaggaatatatacatatatatacacacacgcatatatatatataaacacatacacatatatacagatacatagatacacacatacacttatattcatatatatttaacagatgtagacatctacatgtatctatttataagcactgacaagaacaagtatacatataaacagtagatccaaaaggactcctcaatcttaagacatccctcctctcctatcctgcagggcaaaatacaatgggcaaaagtcggaaaccaccatctctatctcagtgacttcttatggagccctgtggtagaatgaccaggaacttagagccaatggtaagaaccaagatagtacagagcttctgtactataccagggactttgaaatttcagaaaatgtatgctaaatttgtcctttatataattcatggactttggatttctacatttgagattgccatatgacattcagagatgctttcacagaaattgtaattcagcttagagacagcctacaaatatgaaacatatgcaatgccaggttcacagcttgtaaaagaacagaagaatagctatgtgaaaaattagtttatctcaggggtcaaaagtgataactcaagctcagcccaacagacattgcagaggtgggaatgaataccatttataatatgtactattcatacatccactgcatacagaaatagcttagaaaggttatgcatttgtgtgcagatctactgaatgatttgggtactgattttaagcacagcctgccttcacatttctccactgtataactatagcctttattggcttctcttttgcttaagacaagcttaacaaaaaacatttgacatttatcgtgatagaataaataacacataatggctattatgaatacaataagggtcagatgtttacttttttaacaattagggatgtattgctcaaaataagtaaaagcatttgtgcattacctgaatatcatcacatttatgtaaacagagatcataagcctgaaatatgtaagtaccactgatgccactcctgtcagcatcttccctctaggagatgatttcaaatgacattttttctttccaagtatgagagacattagctaaaaatctactaggtcaaaaaattctttttgttagactaagtagaaagctttgccattattgtcaaatatctacaaacctaattgaaaaaagatgttaaatttagtggagaaagaccagaaagccttaagcaacttgcataattagaccatcttttcccattgcctttacctttattattttgatcctaggaattcctttttgcatttcatacttgtgcataattaagatgaaatataatgcaaaggctgaactctcattctgtaagccctcagaaacatttgaggaatagctgttctatgactagtgtctataaaaattaaagattgatgtatagccactaaatgatctcttctcatttagactgaattatgtaaacctattataaattttataaatacaaagaaggcatacatttaccacatttatcttttctgccatcagcaaagataagctggttggaaatgtgagagaaggcaattctttatttttcttctacggtttatacaacagagtgcatatatgtattacacaacattcacacaatgcctaatgtttctaggcttatctcaagctagtcttgctgcaaacagtttgaacataagaatgagagttctttttgtagagagagaacatggcaagtggaagcagacaggttttatatcataaaatatttgaaacttggttcctccatttattttggtcaagttacataaatctctaagcttcaatttttttcatctctcaaataggaatactaatatatttttttcaaacttgtgcaaattaaccaatataatgcatataatgaccttggtctacagcataggctgaaaaaacacagccatgtgttgcttagtgatgaagatactttctgagaagtgtatcattaggtgatttcttccttgtgcaaacatcagagtgtacttacacaatcccagatggtatggtctactacacacctaggctatatattacagcctattgctcctaggctataaacctatacagcatgtgactgtgcagaatactgtaggcaactgtaacacaatagtatctgtgtatctcatatctaggctgggttcagtggttctgtgtgtaattccagcactttgggaggcctaggtgggaggaatgcttgagcccaggagttccagacaagcctgggtaacatagggggaccctgagtttaaaaagtttttcaagtgcctgtagtctcagctacttgggaagctgtggtgggaggatcacttgagcctgggaggttgaggctgcagtgagtcatgactgccactgcactccagcctcagtgacagagtgagaccctgttcaaaacaaacaaaccacaaaacaaaaataaaaaaaatttaaatatctaaatatagaaaaggtacaaatatgacactataatcttatggagccaccatcatataagcaatttgttgctgacagaaaccttgttatgcagcataccactgtatgatcttctccatgccactttggcctggtgcgattccatggacccctagggaatttgataaacattaatcgatcaaacaaaattttgtagaaaaaactcatgcaaatgaagatttttaaaagaatgttcttcttcatatgtttctattcaattaccggggaaagacagcatccaaacaacagagaatcagaacactgctgttcacatgtaatgatttgaattaattagagctgagttctgcagggctaaaaatggctccttaaaagcatagttaaataatcccctaaatacacaagaaacctattaagtataaaacttatctttaaaatataatatggtaaatcctcccagaggcataacttagtcccctaaaccagacacatcaggtgggcacatgccaattctttcatagcacgaggatatcatttattaaattaccactttaatagggccctagtggccctagaactaatgctccttataaaggtttaagttagaatgagggggaagatttgctcacctgatcctttatgcataattaccactaactgcacaaatctggcttgtatttattccattaagtacctccaatgatgtcattttgtctgcaccccaaatctgagatgtactttctgtctaggcatagaaaggttcctgtatgttacagttcagttcagaattttaattaaataaaatgagaaacaattgaaaaacaaggcatctacaatctttacataataagtaagcactggtatccttgctttacatgataaatgatgacaaaggacagggtagtatcattatccagtttggcaacaactatgaaaaaaaagaactttccgatttctgtctttaaaattttatttaaaaagtgaaatacggcaaaagatgattactcttgggtattacaaatcatctcccagctaggaagagagttctgtttggagagctggccagggcaaatcgatttgttctttccctgaatcactattagggtgcagtcactttttattcgacttaggtttcttctgtgcaaggatgaaataaaatgcttttgcatcctggagtttaaaacacttaaaacacagtattaggtaccatccacttctggtcagaaggtccacttggaaatcatgtttgaagacacatcagcattaatgctattttaaagcattcactgatcttttcattcttgacatttcagcagtattacaggaatcttccacttggctttgaatacaccatgtggttctggcttcccacctgcctcactgaccacaccttctcaacctctgttggtgcctccttccctttctcctcttcctttttcagacctataaataagtatatgccctaggattcagcccccttcttttatttatgccccttctttccttgctatcacatctacttccatgcctttaaatgctaaaagctctcatgtttatatctgcagccatgacctccccactgaactccagactcaggacatacagccgtctatctggcatctctgcttgaacatctaaaaggcattttaatcttaacatgtcccaaacagaactattgatttcccaacagccctcccccacaccatagcatcctcatctcatcagataatcacaccaaaaacatctggatcctctcttgcccttacattctgccctaagcccatatgcaagttctgtatgctcttccttagaatgtattgcaaatccattccttctcaccacttacactgttaccaccctggtcgatgccaccatcacctcttgcctgcaccattcgagacaacccctgaaacttatctatctactatgcatgcatgactgctgaagttaccttttaaaaattaaagaaaatcacagtacttcccagcttaaagttccccaggggcttccattatacttagaataatatccagatacctgaccatggtctacaaggccgtctgtaatccgaccccaacccatcatcttcaccttgtcttgtatctttctcctcttcattcactgctttcctcccactccttcaacgtgtcaagctcattctcaccttagaactttgactaaaccttgctactccttctgcctggaatattattcccttatgccttggcatgaccagcctcttctcaattattctaatcttacttaaatgttatctcttaaccttgatcatccttttccaagctgcttctcctttcccaagttcctatccattaacttattttcttctcaacacttagaactatctgaaatgtctatgtatttacctgtttaatgtctgtctcccttactagagtataaactccataagagcaggagtcttgtatattgtctatgtgtcttggcacatagttgatattcagtaagtattggctgaatattttgaatgcatttctaacctgcatacacatataatgatgtacagaaatcctataaaataagccaaacaagtaagatcctttatagtaatttaaataataaaatcatgttttttgtcatagagttcaaggactgggaagggtcttagaagttatagtgcaaccctcttttttacaatgttctgacgctcagaggaggggagccactagcagttcacaaagcaagagagaggtggagtcaggctgaccagatccccactgcagcttcaagtagagctggctgctccttatcgtatattatacctgggtggctgttagaactcactgattatacagtacaaagtaactccatttcagcaccaaagtgtatatccactctacatagcaagtaaaaataggactttgaatcataaatttcatctaccttaaatgaatacactagtgttcctaataaatggcaaacttttaaaaaaattttatttttaatttttgaaacggagtttcactcttgtcacccacactggagtatgcagtggtgtgatctcagttcattgcaactttcgcctcctgggttcaagcgattctcctgcctcagcctcccgagtagctgggattacaggtatccaccatcatgcccagctaatttttgtatttttagtagaggcagggtttcaccatgttggccaggttggtctcgaactccttacctcaggtgatccacccgcctcagcctcccaaagtgctgggattacaggcatgagccactgcatctggccttaaatggcaaactttgaattaaccacgatgcctgcattcaaacgtagaaggcctttttggggacaattaaatgatacatatctcttaaaaatatattcaggaaagttttaactgatgcttacagtttctcttcataaacatccctaaatatcacttccagagaatctgtatagctgtgtcttattatctgaatggctttaactaagggatataatgatgtacataatgcagcccccttgagtacctagggcattcctgaaaatcaagagaggcctgggccacaataaatttttgggattcttggtattcttttttttaaataaaaaaatactgaaatggtgttactaaaatgacaaaataactaaaacatttgtatttaacaaattaacatgttaaccccaaaaacagtattttataattataggctgtttaaaaaatgcttagtcttagtgcactagagcctctgtgatctactgcaggaacacatattatacaattgtactcctcatacttctgtgagtctctgtgacatgtgcatgcaaataatggtaacagtctaagtttgaggcttttgaaggggagacctggtcaagtggccctcaacactcatgacaggccttatgtatctctttgtttttgttttttacctccatccagctgcaagcaagcagtgtggggagaggatggtgggggatggggagatcttagcctccaaaagccagcaaaaactaagtatacaaaaggtgagggagggacagaaccttctcagtctcagaactttaaagccaacctaagcaaaaccaactgataactgatgggacctccttcatcttctctgagcactgcctctctgttcctcagggaaaaccaagtagctgtttgagattcacagtgactgtggcttagcccagaacaaggaccacctgctgtgaccacagccaaatcctgacatgcatcttccagatgtgaacggaaaccaaatcaaaatacccatctactagaataaatcacaagggcctcgggcgtgcagatgcatgctctgaaaggtctatctgttcctgagagggaaggcacaggagaaaggaaacaaaggttgtttccctaagagttagggagcaacttgacaagcaacagacgttttgtgtgtgtgtgtgtgtgtgtgtgtgtgtgtgtgtgtgtgtctgcacgtgtgtagatgggggaggtgaagagagttataactgtaggtccctttccatttcagaaaataacctctgtgttgggaccaagagacaactttgctttaattattcaaaaagaatccatctcaggtctgcctgtttcctccacacagccaacaagaaaaaaaaaaaaaaaaaaaaagatgcttgcaagttactgcaatggtggtcttattagtcttctttagtgacattatccatctaataggctttagttcttaattgtttttacaagaatgatgtttaatcaaagctaatgatatcagcgaacttgaatcaccacatgaactaatttagcaatatgaatgcttcatcacattctctctttatttctctcaatattaattagaaccactttccaaagaaagtggaagttccagggatgatctgaatatcccactttactacccacagtggacatattccaagagtctggccacagagagactggctttgattagagctcagtttttaagatattccaaatctgggatattaacttattcttgattttaacacatcataaccaaaaaacattataaaatgggcttatgttattaacagaaattcacagaaaaagaaatactactggctcatgaaagaaaagatgttcaacttcactcataagaaatgcatattaaagccacaggaaatataatctttttcacttcttagattagcaaaaacttgcaagttgatcaacatacatgcttttcaggctgtggggaaacttactctcatacatttcaggtgggaatatgatctgatataacctttaaagaggacaacttggcagtatttatcaacattatacatgcatataccatttgacccagaattctactactgtgatttatcttacagatatgtcttcccatgtacataataaatatattcgttatagcaatttcataataacacaatatttgaaatagctcaaaacttcaaacagactggaaacaactcaaatgtttctaaataaagaattggctaaatagagtagtacaacaacaagaaatcagtaggtgtagtgacaggcacctgttgtgccaacatgcaaagatctccaagatatattttcagtggaagcagcgaagtgcagagcagtgtgcatatgctatattttgttttaaaaacagaaaattacgaatataaatttatagttgcttctatttgcataaagaacatctggaagaattctaagaaaccaataaaagtggttttcattttgtgtacgaagtagaaactggctggtgggggatatggaggagagtgaatcttttcaccatatatcttctcatatgttttgagctttgaatcataaggctgtactagaaactacctgctttgaatctatctattaaaaaaaagtaaaaataaagcatgattgattaggatgtcataatttctgaattttccaaaaacatattgcatatatattactgaatatacttaaaatatcttttgcaactttctttgccaacaaagtctagtaaatataaaaagattaacattgaaagacattttattaatacatgtgcataatgaaatgtttatttatcaatatccactaatgcatgttgtgaatgaactttccttcacttcatacttgtaaaacaattaggaattaaagcttattggatggagactgctgaaaaaaggcaagcaccatcatcatctatagtaaaaacaaaaaatgagatgttcagtagctatcacgtcatcttggtaggataaataaagaatatatttatttatcgtaggttttgaatactgagaaattcgaactcgtattattctgtttcaaaaaaggatgttcaggcagatatgaaccgaagcaaatactcagataaaagtgtaaacaacgtttccttcaagctttgttgttgttgttacagttgtttgaggtcttctttgtgcaattaaaaatgaaagaaagaacccaaggaatgaagatcaagataagacaaaataagataaactagaacatatacattaaagtcaaagtaaaccctgtgaatagagaaatagtttgggatccatagggtgagcagcaagcagcactaaaatatgagtgctatttctcttttaaaacagagtacaaagcctataaaaggtacttttggatgggcacattatgttcataattcataattttaaaatgacccatgagaaccaggtactagaccatagggcctaatgagtattctagagtagaaaaaatgaacataaggaaagagagccattacgggtagatttccttgccctccacaaatcaaccacacttagggactattttctttcctcttagtggcacctttgacaaaaatagcagcccacaaaatttgcactaaaggcccacttcaaaaattagagcagtaaggttccagtgttgccatgtgccagaagtaaaagaaaaaagggccatacatgaacatggaaataaaatcaatgagggttacacaatggccaatttattaaactttttaatttttatctgctttgtgcaagaaaaccaaaaggaggaaataaaaagatttgagggcaattatgaagcaaaaaccttctaaaagtggttgcaaaaaacagatgactagatattatccatctaattttattgtccagtgaaagagcaacatccaaaggaaattctgcatgtacagagggttaaaaagggtaagattttaaaataccagttactattatattgtttttaattgttaaaggggaagtaaaagtaattgatcctttggggttgaacttactgcctcttaaaaacctctagtagcaacaactcttctttagaaaacatttcataatttcagtgagactttacatccattacttcatttgatgagtcgctatcatccatataatacagataatatatggagatcaaagctcagaggcattaagctacctgctcaagtttacataggtagaaagtagtggagcagagattcaaactcagttcatgacttcacaaattgtgtgctccacacatcctgaagaatatgaatatgtgcaagtaacggtaccctggcagtcttagattaaaatgagtcattcaattcctctcaagagtgactagctagggcctaaaggtattttgatgatttctgccaatgatctgctgagggagctctcaaaattaggttcaatgttagttatgaagacacatggatgcaatgccaccatccaggacctttgattccctgtacccaaaaggacaatataattttcagccatgagtggagcaatgaattgattttcctttgattcacattcctgagtaggctgctttagaaccatgggaaagcttccactctcaccttctggacattctacttcattatcaggctgatgttaacaataagagatgttcaaagaacaataaacatggctaagaagctggtgggattgattttacactccaggtaatagctctctgaggatactgtgcctttacaaagctgctgatcagtgcattctttctctttctttttcttttttttctttttctttatttctccttcctgccttccttccttccttttctccctctcgctctctttctcttcttatgacactcttcccacccctcacccccccaacccctcccccccagacttttaatggccaggggaggagggggaagagtggtgcataagctgcttcttcctcatcataaattaagggttggttgtagaaattcttttgaagactggaggctgcagcatgatgattcacttttcctgcccaaacttccctaattcactcaggtttagactcttccaaatcccagaggcaaaagataatgaataaattaagttttcagaaattactgtatttagaaaagttttaacatatttttggaaaagcattttataaattgcaaagcagagcgatttcatttacattttttatattatggtaaaatagacataacacaaattgttcattttaacaatttttaagtatacagttcaacaacattaagtacattcacagtgttgtgcacccatcacccctattatcttcagaacttttttttatcatcccaaactgaaactttgtactaattaaacaataacttcccattgtccccccacagttcctggtaacctctattctactttctgtctctatgaatttgcctattctaggcaactcacatagggcagtgacataatgtgtgtccttttgtatctggccttttcacttagcataatgtcttccaagtgtatccacatttcaagatgtatcaaactgcattaccttttattgctgaataatattcccttgtatgtatacattttgtttattcatctgttgatggacatttggctcgtgtccaccttttggctattgtgaataatgctgctctgaacagtgaggtacaagtatctgtttgagtccctgctttcaattctttggggtatatatgtaggcgtggaattgtggatcatatgttaattctatgtttaagtttttgaggaatccccaaactgttttccacagcagctacactattttatattccctctagtaatgcaaaagggttacagtttctccacattcctgctaatacttgctattttctgttttttaatagccatcctaatggatataaagtgctatcttactatggttttgatttgcatctccctaatgtctagtattgctgagtatcttttcttgtgcttatggcccatttgtgtatcttctttcgacaaaggtcttttccagtcctttgcccatctttgagttaggttgtttgtttttgcttttgctgttgagttgtaaaattctttatatattttggatattctttgtcagatatatgatctgcaaatattttctcccattccatgggttgccttttcattctgtcaataatgtactttgatgtacaaaaggttttaatttggagaagtccagtttatccttttttttcttctggtggctgtgcttttggtgtcatatccaagaaatcactgtactgattccactttgattaacctataatacaattaatttctaagcagaacccttgagttatgctacaagtcacttttgccccaaataaattccaaacaaatacaatgtgatggaggagggagaggaagtggggatgggtaatgggtacaaaaatatagatagaatgaataagatctaataagatctagtatttgatagcacaacagggtggctacagtcaacaataatttattgtgcatttaaaaataaggaaatatatttggattgtttgcaacacaaaaaaagataattgagatgctggataccccatttaccctaatgtaattattatacatgatatacctgtattaaaacatctcatataccccatgaatacatactatgtacccattaaaaccaaaaaatatatatacaatgtgagaggctaaagagcaagcatgccaggcaactgaatactgtttccaattgatcttaaggtccagacaacatggcacatggttttctctgttacctggtccctgcctacttttttagtttcatttcccccttgccatctaacttcaatgatctggaattctctgtctctaaaatactcttcattttccctatacctgccttactcatactcatccttctagtctcaacccagtcatcccctctttcgggatgtttcacatgatctgttcctatttccacctactattcatgcagtgaaagggttgatgtgctagtttgagctcctgcggcaccccatatgttgtttactacaagatttactatacagaattactgtttacttagctgtctccccctctatattatgaattccatgaggacattgagcatgattttagtttatttttattactatatcctcagtatctagaatacttcctgatgaacagtagatgctcagtaggtaactgccgaatgaatgaatgaatgaaccagactaatagccttgccaaaagttttctgtttctagaagtagttacaagaaatattttcatggagaggcataacatttagagatatagcctaagtctctctgcttttcttaataatttatcttcaatgaactttatttcataaatctttaatcaaagtagtgtcataagcactttataagtattaattcatttaaacttcacaataacttgataaggcattcttatctgcagtattcaggaaatgaaacagaagcacagagacgttaagtagcttgcccattgtcacatagctgctaactgggattgggcctacttaaagttgatcagtctgtatcatctcttggtatgatgagttccaactaaatgggaaacaatatatacttgaacatttcagtcttacaaggatggtcaagttcatggaatttataatttttctaaacttggctcacatcaccctcagatttatggtctagttttcctcctggaagccccaagtttcctaactggggctcacataccagtcatcccttccctctttctgtttcttctcagaacctgagtcacttcctcatttcttctgtaggctcagctgctggaagcactgggcatttcaagtgcaagtggaccatatttattttcaggattaaagacatttcctatttggtttttgatgtctctttggtttcaatttgatcaatgtactcaaacaactacttaaaatgaccataggacattttagctggtcgtagctccacataacattttataggaatatatgaattttttcttttaaatttattatcttttggtttccttcaataaaaccaatcttcagctacactattattattattgcagggaagcattttttgaaacacagctcctttataattaattcattcatttgttcatatatttattcagtaatttcagggtgcaacgcactgtgctagatgatggaaatacaattttatcctctaggagtcagtatctttcccacctaaacagatttctacaataagatagaagttaaacattcctctgattttgaatatttaaaaaccttgtaagaaaatgcattatttcaattggttcctctgtttccatatgcatgtttgccctctcaaaggtctagattatgttgcacagagatcagcaccattaatttggtttgaataattaaacaaaatgtcttattttggaaagtgcaaaaatatgtaacaagatgatttacaatttcacgtcaaaatgtgtaataggttgctatgattgtgattaatccctaaagagagaaaaaaattagaagtaaagtaacattttaaagtaaaatagatacattagaaattcatgattggatagattacaaaatgtctcttgcctctgaataataaatataatttattgattctctctgaatgcattagagaaataaagcatgtaaaacaatcatttaggctaagtacatacagcaaagaattgaaattatcctctgcagcaagtactaggctgatggataatagcatatacattcattttcatacctcttaccccttttaaatatatctctaaggaaagacagtggttatttgactttctccatgtgaaatttcccatgcagtgtagcacatctgtaaaagatgtgtgaaaagtacatttttctatcaggattttcattcatagttaattatttcatttagcacgagcaacatttccaatttaacttgttccagagactgtaatatttacagctaatttccagcaaaacatttagaaatggctcaaagtaaaaattcattactgggttttgccatgttttaaaacgtcaaatgcaaatgaaaatcaaggcaagactatactttacttttagatcatgtatttcagttcctttttttttttttaaataggtttggtgtaggtggtaagcttgtaatgtcattctttatttaaaacacaaggcagaaaggtctcaggaaggaagagacatatgttattatctgtcatgaccttatacttatgaatctggggacagatttggagaaaggtcttcaagtgaccagatgggctgccatgttatttaagttgcatatattataatagcttcattttgttcttaaccaatgtaactcgcatcttatcatttacattattgtcttgcttccattatggatggtatacattatgttttccccaaactgaactgactccttgatctgggttatgcatcctacttgcatacagacatattttcacatacgtactttcccatatgaatagatgaccagtagatcttataacacatttttctgagaatttacagtgctttaagttacatcaatttttaaagggactcaataaagtaataaaatttacacatttatattgaaatacagtcatttatactattatatgaaaaaccatagtgagtataagtgattttttattgtaattgctttctgacagtaggtataaaatgaagaaattcaaaatgatggaattacccttgaaatttgagccaacataagcagttttaaagtgttaagagtttaatgagaaacatcactgaggtggaaaaattatgcaaacgtaaattttaaatggagcttccaaaaaggaataattttaagatagtctagcaaatgtaaggggttgctattccttagatgagaagtttgataaaaatataaatagaataaagagtatatagagacatttgcaagtgtctcccatgtagcatttaataaaatatttattttatacctactaagaatttcgggtactgagagttccagagtgggagagaggaagcactatcagaaagagaatgactctctgtggatgtgacatgggctgacacttaaatgagaagaaggaaccagcccacttctggaggggagattctctaggcagagggaagaacaagcttatcagtctcaaaaacacaaaacagtttatttatctttcactttgggaggccgacgtgggcagatcaactgagctcaggagttggggaccagtctgggcaacttggtgaaacccccatctctatcaaaaatacaaaaaacaaacaaaaacaattggctagctatagtggcgtgcacctgtgctcccagctacttgggaggctgaggtgggtgaattgcttgagcatgggaagcagaggttgcagtgagctgagaccgcaccactgcactccagcctgggagacagagtaagaccccatctccaaaaaaaaaaaagtatatttacttttaaaaccaaatgctaaaagagtcaaacaaaagttcaattaaaaatcaatatatttataactaaagtacatattatcttctgaatataaatactacgtgtgcacaacaaatagtatagtatttctctagagaaaactgaggaaacatttcttaaatgtcttgaatataaaccacccatagctaggagtatctggataacctatattctgaaagcatttgcttagtttgccctgataaatgtgctctgtccttactttctcttggcttctctttctgctggtgtcttatgttctgttcccatccccagtaagctggggaaggtgagaaggccttactgtctcaattaaaaggaggtatagtcagcgtcaccactcctcatttcacagttctggacacgagcatagaatcctgatgagaaacagtcctgcttctttctgtagaaatgactctgcaggtgtcaagaagaaagggctctgagtcaggacaaacgagaacttggcactgatgctattttgccaggattcatgctctcatgctctctgaccatccctgcatggtccaagtaattcatttccatggacattaagctccaaatgtcattgtacactgtgccttcccattttctaaccacaggtgcttacagattaggctcttgcttaacctgccactggctgctgggccatcatctgccctacaaagcattatgacagctgtactcattcctttgatgaagaatacttagatgttctttctcatcagtcaaggtagctcacactcactttacaaatactatattactattggctcttcatcagatgatttctttgtggtagattccggtgcctatccttaagatgtttctgtactgctaaggagactgcaatcctgaaattcaacacaacaaccaagtctaccaaatctctggcaggactaccaaacagactcctaattgatttccctgattcttcttcatttcatcagagctcagtacacaaaacaaagtgaaaatatcagttcactttctcattcactcattaattcagcaaatatccacagtatgtattgaatattttccatgtgtcaagtatatgtctgacaagtgtcaaagctgactgtagcagttctcacagtgtagttggggagggtgagtaagttactgtagtggacgagtaatattcttgtctaattagcatccatttctcccttttcttctaatagtatctggatttatctgaggatacgtctttccccaagtcagccccatgccatttgagtggagctgattttccctgcagatttgaagaaggggttgcagagacctagttctagtcaatcagaacactggatcccctgggtgtagtgactggttcagagtcggggagtcattccctcagacatagcaggactcgacttgaggccctttgttggaaattttacaaaggaagaaaatctccttctgctagtcttggagctgggattgtgtaagggctccctggggagaagcctgcctgcctgggaatgagggtgagagggagggagagcctgagagggctggagagcaggagtgtgaggaggaggctaggggagaaagggagaaaggaaagagatttgtttgtgaattccaatacttgatcatttagatctagttgtgcccagagctgtaaggacgatgacagaagcactaacaaaccacaaaataagcatcgaggagaaatcccccaactctgcttggagcagctggggaaagccatagccacctggcacctgcccatccttcactattcttcaaatgtcatctcttcagagcaggctttctctagatcccttatttgttctaaatagattgtgagctcacagataccagagaacatggcttggtaattttatatctctagagctcatcactgtgcctgttagagggaatatacattatgccttcaataaaaattccttgagttcccctgtgtacctaggcctccagtgaaagcaggggtctgaacaggaccctaacactgccctgctttcaagggatttcccgtactaacatgtacaaggaaccagccttcagcaggaaatctaaactagcttgttccttttctcattttccctcctcctctcctgcttcctccagcccttttagtcctgttaacccctcatcagagtttaatacaaacatcaccatgccacttctctgaaagctttgccaatttaggcctagttttccttgttgtgtattcgcaaaatttcttgtaattttccttcatataaatcagggcacctctccaccaggggtgaatttgctcctttcctgagattatgtgacaacatctggagatatttttgattgtcacaactggggaagaggttgctgttggcacctagtggttagaggccggggacgctgctaaacacccagcaatgcccagaacagctcccacagcaaagaatgatccggcccaaaatgtcaatagggctgaagttaagcaccccttatataaataatcacagtttagagttaggcatctattttttaccccaccaaactatgaattccaaaagggcagggactaagtctgttttgcaccattgtacttccacacactcacaagtagtagctactcaacaatcatttttaaatgctatcattaaaggaatgttaaatctattctctgaaacacaatacaccattcaggtaatttttccttctttattgcaagtatgcatattagcatgcaaaatttaattctctgttttcatttatcatattctagaaacaaaagttctgaattgtatggctggattttggtgtaattgaggaggctctattccacaagaaaatatttgttttagtacattaggatattcttgggaagttgacaagacatattaaaatgaatgagcctggctggagcagtccctcacactttgcagcacatagtgctgacaagccttaacgacacaaatggcatgaagcctaacacatgtgatgaccagcatttcacagagttatcagagtggcactgtcatgttcctgaagcaaaaggtgatacaagctcctatacttcatctccgctccctaataacaataagcttggattccactgagccatgtcttcgatgactggtagttctaaagcctctaattataatcttgagtcgtaatatttgctttaaagctttaactcaagtgaacattcaaatgtaatttttccacagaagtcaatttctggaagggacacaatgtaaaaacacagggaaaagaacgtggttaattattaaaccaaatctgaaacaatgtactaaaataacacttaaaagcatgttacaaaccacactggacctactttcatccagaaatgtttgctttctccatgagggagtgaattctttaaatatacatagagccttcatttgaaagaatactaacccattcatctattacattcccatgttgaaattttgtgtgagaaaatatgtcaagattctagtttcatatagcttaattttaccttaaaaagacccacaagccagttttggttcttgttgtttttcctgaaagtctttgaatctcgggtttttactctattaagtataggccagggcttgggggcctttacacactttttttttaaataataaattttgcagctacaatatccaaggctctttctactaggtattgaagagaatataaaaaaattcagagctgggtgtggtggctcacacctgtaatcccagcactttgggaggctgagacaggcagatcactggaggccaggagtttgaggccagcctgggcaacatggtgaaaccctgtctctactaaaaatacaaaattatctgggcatggtggtgcatacctgtaatcccaggtacttaggaggctgaggcacgagactccttgaacctgggaggcagaggttgaaccaggatcaagccaccacactccagcccgggcaacagagcgagactctgtgtcaaggaaaaaaaaaaaaatcagaatccctgtcctcaaatcccaactctcagtctctctggatgtggactttttcctctggtctcttccctcaaggggcttaagttcttatggggcaaaaaacatggactttagagcttgatttgtataaaaatttttttgagtgaaagaatgaatcgcatttgccaggtgagaaaagtaagtcttggagaagttagttgaaaacagtttaaaatggagtctatcttcctgggtgtcttaaaggccatacattcaaaagttagctgtgctatcattatgagactgtctatgagggcatggacatgagggcagtgagcagagactcagagtggttcagttactctcttatgaatcaaagcaatagtctgcttctgcatcttatcacattttcagtgcaataaaagatgttttcaaataggtgaaagcctctattgaagaactgtctattcttaggattttactgagattacattgtagagaagaaatagccagaaagcatttctgcaaaactaaatctccacgtttgttggctatatttattgggataattttagtaataatagatgagaaaaataaaactttttttttttggagacagaatttcactcttatcccccaggctggagtgcagtggcatgatctccactcactgcaacctccgcctcccaggttcaaacgattctcctgcctcagccaaccaagagtagctgggattacaggtgcctgccaccatgcccggctaatttttgtatttatagtagagaaggggtttcaccatgttggccaggctggtcttgaactcctgacctcaagtgatctgcctgtcttggcctcccaaagtgctaggattacaggcatgagccatcgcgcctggctaaaactttctattactccaatgacagtaagcaaatcaggaaagctaatattttcttgggcatgggcttgattgaaaaaaaccgctgaagctggcgttatttcttattgatttttgtttcccacagagcatcttgtacattataggcacttgataaatatttgttcattggctctgcttactgctctgataaaagagatcttaaaggtgatattcaaatagaacatgaaaacctactaacaaaacaatactatctatacctaactgtttcattgagtataatagcactactaaagtcatatagagtgtacccattttcattgctgccattttcctccatttagcaagcattaagaagatgcgagatttctctctttctctctctctctttttaatacgatgcccatctactgtcatcatctgactttctgtgtaacaaagggaaaaagacaagtgatactatgcttattattatgggagactgatgacaaattacagcatagtggtcctaccatgtgagtcagttgatatagaaatttctatctaagcagaggattgtcacaaggtgagtattttaacgtgacagaactagagcagaacatgtaacactgaatatgtgccaaggactggctgcatattttatatgcattattttatttaagtatcgtataaccctatgaggtaggtatttcttcctacacaagctcataatggaaaataacatatgtgggactgtgaaggggaggtgagaatactgagaggatctcaggagcctgtctcctaccagggcttccaaggtggcattcagctccttggttattttaccatggttctcatctttgggcctctcccttgtaggtgtagaaacttgcattatcagcaagtcaagagtggccccatttctcagaagtaagaaatgcatcaccaaaccaaggggactggagtataatgagactggtggaagtatagtaagacatttgttgtcacaggtatagaacacttgctataaacagaactgcatgggagaaaaaataaaaccagaaggtcacaaggcaagtagggaatggaaacaaaataagctttatctaaagagaaggcaaagccattgtaattggagcccttggagctctcagcaacaacccctctctatctttacatcagggatgatctagttattgggcttggaacacttgaagaccactagctgaggtaccctctcttccctggatggtgccaatgtttccttctgccatcctcctttttcccatgcttccttccccaaaaaggaaggtttcttccctttttccagtgagaaccaaattccattctaatgaacactttccttatcgatttgtatagacacatttggtcaggtcacattcaggtcttgctttataaaattctttggtctcatgttgaggaaatggttcttaatctctttggggtcataaactcttttaagaatgtattgaaatacaaagacatataaattaaaatacatacaattttgagggatttcaagattcttagaaactcatactggaatccaagttttaaaaccactgcttaagaaaactgtgcataatcctgctcttatccattaatgtagtgataaggtgtatcagagtctatgagggacctataatccttatgaattgggattgattctattttataaagaagaaaattgaagctcagggtataagtgacttgcttaaggcccagtgagggcagaatacagaatatgtcagtctctgtagcagatataagaatatctgtaacttttttatttttttgagcagggtctctcactgttgccaaggctagagcgcagtgacacaatcttggctcactgaagccttgacctccagggctcaagtgatcctcccacttcagcctcccaagtagctggaactacatgtgtgtgccgctatgcccggctaatttttgtgtgtgtatgtgtatatatatatgtgtgtgtatatatatatatatgagtattttatatgtattatatataatatatataaaaatatattatatatatattatactataccatactacactatactatactatactatatatatatagtagagatggggttttgccatgttgcccaggctggtcttgaactcttgagctccagcaatcctcccacctcggcctcccaaagtgctgggattacaggcatgggctaatgcgcccagccaaatgtctgtaacttttaagatcactatttaaaaataaaactttcatcacaaattcaaaaaatccagaaagagaatgtggagagagagggaaatggcatttgtaacttttgagtacctgaagatggccacattttttttcttttagtcagtaaagacatggattaacttgccactatctgcattttacagaaaagtagaaatttcccgaggttaaataacttgcccagatttctttaactataagtgacagaactagaatttgaagtaggaaactaagaagttgtatttcataagctgtgctcttaccccctctgctatgtgacccctggccacagcctaagcaatttctggcttcactcatctctattggcaaggtcttaactgaagttgccaaaggcagtcaaataacatcctttaagcacacttgagagtgtgattgtgcaaaaacagtaaagcttcaagttcaaaagagtcagagtccaggataaccctcaggtggatgagaggcatatgattcatatcctttccttcagtttttcagagacataaaatggtttatgttcgacttcaagaatggtctatctttgcattttctttgtgtgttgtgttatacttcattaggcaacaaaggcttcttttcttctcctccaggtaataagtagtgatttatcacaatcacctgtcacatttaacttagcattcattccacgaaaagatttcccatacatttccaatgtgaaatttaaatgttaatgtccatagataaagaagtatagcagtatgtgttacattttttttcccactatgaaaaccattttcaggaatttagactgttaaataaccattccttttatgagactagctctaaaagatacatataaattttgaaatctatagtattacttggcaattttagtgctttactttttgcagccaatcatggaagacttgcttttatagctttctctgcagagtcatcttaattatagggaaatccctttacaaatggctttccatttacagtgcttcagctagaatctaaagttggttttattggaaatgataaaaaattactcttcctgagacacagagttaagaatcagaattggaaatgaactaagttcttttagctttagaaaaaaaatttaaattgatcatatattcttcccttctaaacagtttatcccaaagaggtttaacacagtaaaatctctttgactttcagacacttaagaaaatgtttcaaggcaaagaagtcatatagattatctaattcaatccacacatttaactgaatgtgagcttcacccaatttacagaactagtgatagagctgggactagaacccctgcctacggggtatcatttgtaccatttcagccacactctgcttccaatgttggactcttcttgtgctttctacataacccacatgggtgggagagatctctggacccaataacagaaatttattttagtctttctttatagcatctagacaacctggcatcatattatttgttcatttggctattgtttttctccttcaacaaatataaactccaggaggacaaataatctgtgacctctaatggtgtctggcacatagtaggagtcaataaataacttgttaaatggaatttcaaatttaaccttaaacattcttgtttaaaatacatagtttgggtcaggtgcagtggctcatgcctgtaattccagcactttgggaggctgaggtaggaagatggttgaggtcaggggttcaagacaaccctaggcaacatagcgagaccccatctttattaaaaaaaataaaaattagctgggcgtggcgatgcaggcttgtggtcctagctacttgcagggggtggctgaagcaagaggatcacttgagcccaggagttcaaggttacagcaaactgtgatcataccattgtactctagcctgggtgacagagtgagaccctgtctctaaaaaaaaaagaaaaaaagaaaaaagaaataaaatttatacgttacattttacttcctaaaatatccatgtttgctttgactggaattttaaataattaatatctgaatgtcttcagggaagaataattattcaacaagataaggaatcatcaaaagaaaacatcgtaaattccattatattaagggcttctactcaacaaaaagccaccataaagagattgtaaatatcagaaatcaagagaagaaaattgcaacacataaaagaaacaaaggattagtatccagaatacataaataacttctaaaaaccagtaaagaaaataaataccagttacccattaaaaatagtaaaagatataaacatatattttaaagaagagaaaacacaatcactaatggccagtaacgaccaataaaagtaagatcagctatttcacctctttagtaatcagggaaatgcaaactaaaaaccatggtaatatacccttagtctaatttaaagcaggaactcaaagagacatttgtacacccgtgttcataggagcattcttcacaacagcccgatggtggaagcaaccctactgtcgacagatggatgaatggataaacaaaatattctgtttacaaataatttacaatggaatattagccttaaaaaaggaagaaagtcttgtcacatgctataacataaactttgatgacattatgctaagtgaaataagcaaggcaaaaaggggcaaatactgtatggttccatttctatgaggcatccagagtagtcaaattcctagagactgaaagagaatggtggttaccaggggctgacaggagagggaacggggagttattgtttaataggtagagtttcagcttgagatgatgaaaaaaaggtctggaaatagattgtgttaacggttgtacaaccatatgaatgtacttaatgcctctgaactacgcacttaaatatggttaaaattgtaaagtttgttgtgaatgtttaccaacaaccacaatgagatatcattttatatccactagattgaaaacaaaaatctaacttctgacaatagcaagcatctgttaattgctatggaatgaattgtgtctcccatccaccctaaattcatatgttgaaccctaacctccccctaccttgaccatttcacaatatgactgcattggagatagggcctttaaggagctgattaaggttaaaatgaggtcttaagcatgaagccctgatccaacagagctggtgtctttataaaacagggggagacattagatctctgtgtgtgtgtgtgtgtgtgtgtgtgtgtgtgtgtgtgtctcactctctctctctctgtgccatgtgaggacatgaagagaaggtggccatctgcaaaccaggaaaagggccctcaccagaaaatcaaatcttgctgggaccttgatctcagactttccagcctccagaactgtgagaaaataaatttctgctgtctaagctgcccagtctatgacctattgttaggacagcctgagcaaactaagtaacagtggagcaacgggtgtcacatgctgctgatgggaggggacacagaacagtctggcctggtccagcacagctgcactggtgcaggcccataacccagccaggccgcttcatggtgtgcattccagggaacctagcgtgtgtgtaacataagacaagtagagggaagttaactggggcatcatttatattggcaaaatctggaaacaaccaaaatgtacactgatgggagagtagaaactgtataaaataaataaataaataaataataaaaaaagataaataagtttaaaaacacaggacaaccttatatttgggaagataaaggatgatgaaatctttgagggatatagaggggcttaacatggttaccaatattctgtattttaagctgggtgatgggcatgtgaatgtcttcttttgtcttcttttttaaaacatgtatgtccatctacatactacatactcttattttacacatctagtatacatagtaacaatttaaatgaataaaaatatgcaaacccaaaagcatatagcttaattttattaatcttggtccagaaatttttgttaataattttatatctctcctcttgttatttttgtatgtttttttttaaatttacagaagataaacagttaaagtaattaagctcgacttaaaaatttcaacttcttattttattcattcaaaatctgagcccgctgggagccaattttccataaagactgcagaatcctctactgatctcccaagtcctcctagtcttgctcagctccgttacacaattttccagcatatctgtctatcatatgataatgcaggagagagagaaatggaaggtcataaataaacagagtgtaaaacttcaagtttcagggcataactgggacagataactaagcaagcaaaattctgatataataaattacttgaactgcctgaaagagtcagctacataaatcacaattttactggaagtgctacaaaaatccatgctggctaccaaatgcactgtgaacactaaaaattcttttgtacgctgtcagccaagactccacatggtgtatgtaaagtctgagggccatttagatatatgccacaggcttctatacacaatgatcaagaacaactttccctctcagaatgagaacatagttgttcttatgaaagcagttatttttgttatggcttggggtgagagcgatggcaagttgttagaaagagtgagagtaaaaggttatgaatattgaaacccctaacaaataccatattttgcattttattccacaaattattttgagggttctgatgatgttacatataactgttttaggtgtactcacatttatcactttatttaatctgcaatatatacccttgataggtattacttctcccattttgtacattaaataaagagaaagaggttaaataacctgcccagggttacaatgtgagcaggtgagtgttaaaattcaaacctagttcttcttaatcaaaccccagtactttggccactgtactgtttcttactgccccacaaaatagttttttataatgacagacaaaatagttaacaagtcaagagctaatcagccaggctccttgattctttccctagtttaagcacttctcttacctttttggctatattcctactaattagtttttagtaagataaacaagaaataaaatacgaaatcaattttgtcaatttaggcccttctttaaaggtcagatcatcatgtctaaggtgagtgttgggatctcattctctctctctctcttttttttgtcttggtctcagctttacatcccatagctttacttgtaacacacacaaagtgcatatgatatagtgctggcctacagccagagttgtgaggtgacagtgcctgggtaaaaacccagggacaatactcaacagctctgtgcctttgggcattttacataagctccttgtgtttcagtttctttgtgaaatggggattagtttggctacgaggattaaacaatataatgtattaggttggtgcaaatctaattgcagtttaatagctaaagcatgtagtcaatcctggcatataacaagaggctaataaatggcattattattagtagcagatatacatatatacatatgtgtaaatattatatattttgtaatatatgcctaataaatgttaggtattcctattactattagtataccaccgttagtagggtactaatagtattactaatcacagagtatgctactactagcgaactgaagtgccatgtagggtgggaagaagtgagtactgaggcagaaaaggattagggagaccttctggaagaggctgagcttgagttatgtttcaaagggtaagcagaagttagctaaaggaagaagatgtgtgcattgggggagggcgttccaggaaagagggaatggcatttgtgaaagcacacagcatagaacagcacaatgtacaggctggatgggtgagggagaaaatcagggaccaattacagcaaagtgggaggagcagagatcaaatttaagtggattcattaaggattggatagcaagtggaaaatgactctttcaggtaggtgggttgtgaagagattaaatagttattccaggagttagaaagaaccacagaaaagaatgataaataatccagcataaaatgtccctttgaactatcattgcattcttagttttcaaatttttgaatcttctagttaaaagtctaaaatttcagagataaaagttgtaaaaaacatctgcttcaaatatcctcattgccatttttctattaaaaattaccacacatgaaaatgtgcaaaaactattctttcatgacacatatgagcaactggatgaatttagtacaagcacagttacactagtagaattaaaatagaagctgagacaagctctgaggaaacagaattaaacaacatcattctctatccatcctgaatgaccaacaaccccttgaacatatgctatgcctttccacatacccacacctctctctagaatgtccttcactcctttctttctggcctgatattttctacttggtcttcaaaattcagctgaagggtcacttctcctgaaagcctccaccaaccttccaaccagctttaggtgcttgttctcttggtcccaaagcatctcatgcatacttccatctcagctctttctacaccgtagtataattgttgctgttatgcttatttgaattactactaaactatgaagtttttgaagacagagatcatagttattcagaatagataccaggcctgactctatccctctaattccaagcacattacttagcacatattagttgctgaataaaaatatgcaatttgtcagttcaacatcagacaagcatagactgaaaaataaattggtcatccctagaataacaagatgtcttttaaacagattcctgatttctccatctcaaaactacaaatagattatatggcaaaatatcccagagatactcaagctagaagaaaagactcaaacgatgtctctcgaagttgattttgagagtgatgagaatgttctccttcttatgtccattaaaactcctttggtttccagatcagtctaccttcaaatcaacagttatgatttttcattcttgagaaagaagaacaactctcacatccacaaaataggccattatagcattactgggccattttctccacacacaagcataaaaaaactaagagagaattattcaaagaattaatgtttcaagcaaaagccattctgggttttgtcataatctttcaagggaattttctctctggttctcccaaagcatattttctgtacaaaggaaaatcacttgacttttaaagcaaaaacagacaaaatacatgtctggaagtagttcataaatcccactgggggaaaattccttatacaacaagaacagaacaacaacacagtgaatcagacaatgacaaaatccaacgcaagagtgccaataactttttttttccagaggatcccctaaatttctgcacaaatttctatgctagaggaggctgagtattaactatacatagtttagtcatatttttcctcattttagacaaacatggctttatctgacatgctgaggtagtaatcctttaggataatttgtcaatttatccattcacttaagtatgccaggctctgaggaaatggtagtaactgagacactgttgatgcctcacagaattcacagaaacagatgtctgcagtcaaatgtggtgagcacaaagatctgcacaggtgctaccactaaccaggggcaagggcagctaagccagccagtgggcgctttgacaaaaccatgtgggacatctgaggggagctttaagagatgagcctaaataagtcagattgggggaggaaggggtgggcctggatccctgaacacattcttatttagtttttaaatttttgaattttctaccctaaaagtctaaactttcagagataaaagttgtaaaatacacctgcttcacatatcctctttgccgtttttctataaaaattatcacacatgaaaatgagcaaaagctattctttcatgacacataggagcaactggatgaatttagtgcaagcacagttacactagtagaactaaaatgggagctgagacaagctctgaggaaatgttatttctttgagttaatacaagttaattcaaaagaaccctgagaattttgtaaagacctggaaggattcccaagggcattaattctgtgggtcacctctctctctcttaccttggccatgccttataaggatcgcagtgctaccatcacctagcattgttcagatcatgttcctactgaacatatgcgaagtagaaataagcatcaccttaaaagtgaaggacagagtaatagttttcataacagccatactgccaatagaaagggtatcctgaatggaaaaaataaagatcatagtgttgtagactgctttattcttcaacagaattgactgtgtgccctcagtgccaagttacaatgtgaattacaatgccaaacaagacacagagcttggacgaccttatcagtctcgtgggggagagaagccagtggacaggttcttacaatatagtgttaaatgccatcctaggggatgttacaggtgccaagagaaaacacaacaggaacaactaaaccagactttgcagggaggagggtggtgttgggaaagtgacatctaaatcaaggctggaaagaaaggtttacagaagaaaagggggatggagaggagagaactccagcaagagggaactccagctagaactccagcatgtgaaaggcagggaggcaccatgtgcctggtgcagtccatgggctagcagcagttcaggactgctagaaaggagtacagtggaaggggaaagagggtgcatgtgtgtgtgtgtgtggtagggcagagagagaaattgaagctagattgttaagtaagagccaggtcaccaatgagactatattaaagagtcggagccttatccccaggatgacggggagccatcatggtgtcttcagcacacaaatgacagaagcagattcctgctttaggaagaaccctatggatgccgggtggagaatgggttgaaagggatcagtcagggcccagaagggcagttaagaatctgatctaagtaatccaaagactaacatttgcaaattatgaacaatgattctaaaatccatttggaaggataaatgagtaagaataggcatacctccttcctaaccctctaccccatcccatctaagatattcaacttaagactaatgtaattaaaatacagtgataatagcacagaaataatgcagatgaatcaatggaacaaaaagtcaagaagcctaagtatatatgagaactcaggttattacaagggaggcaagtggaattgttttttaaaataaactaggctttgaccatatgtaataacaaaatatattctagacaaagatttaaatacgcaaaacaaagtaaaggcaattcataaaacaagacaagcagatgcaaaataaacacagataccaattattacccagcagattggcatggattaaagaagttcataatatccaggggcactgagattatggggaaataaggacccttctctactttggtaggagtgtttaaataggcatgtcctttctggaagacagtttaacaaaaggaaccaaaacttttaaaatgtgcgttgggtttcacccagaaaccctattcctagaaatgcatcctaaggaaataactagacagctacccaaacatgcatgtatcacagtggcaatagtaacattctgaataataaatatattagtgacaactaaaatgtcttgagacaatgaaatattatagaaccacttaatataaagatatcaaactattttaatgacatgaaatgatagtcacaaatatcagtacatgaataaacaaggttatagcatagtggggatagtacaattctgaaatacatatttgcctagaaaaaagggaaatttatatagaattattaatagtagttttctctggtgttagaattatgattggttttggtattattattattattttgaagcacagttttgctttgtcacccaggctcttagcttactgcagcctccacttccctggctcaagcgatcctcccacctcagcctcccagtagctgggattacaagtgtgcaccaccatgcccagctaatttttaaatgttttgtaaagataggttctcactatgttgcccaggctggtcttgaactcctgggctcaagcagtcctcctgcctcatccttccaaagtgctgggattacaggcatgagccactatgcctggcctggtttctgctttatccttacgtattttctgaaattgtcttgccatatgtattagtccattttcacactgctgataaagacataccagagactgggaagaaaaagatgtttaattggacttacggtcccatatggctggggaggccttagaatcatggtgggaggcgaaaggtacttcttacacggcagcggcaagagaaaatgaggaagatgtaaaagcagaaacccctgataaacccatcagatcttgtgagacttattctctaccaggagaacagtgtgggagaaactgcacccatgattcaaattatctcccaccaggtccctcccacaacacgtgataattatgggagtacaattcaagataagatttgggtggggacacagggccaaaccatatcaccaagagtacatattactctgatgatcagaaaaaacatatagtgttcatttttccttttgtgaagaactgccaagaataacattgatggtggagttaataacttgagagaaactacagaaagagcaattgcctgtatcacatttcaagtcattaacaagtgactgctccacagcctcttctctgtggattcaaaagaaaaactgatacagaaaaactttctaccaccaaacctcaaaagaagattgaaaatccttatcaggaaaaccagcagtattattgaataaattacaacatattttgcacttcaattgcacagataatgtagatactcatacaccactttcacactcaatccccatatcacatctctgcatttatcaaaccatgtcaaatattataatcagataacttagcataaagaaacatggctttatcttacgtaggactctgtctgacttgcaagaattctcatttactcatttaattctgtttttgcaattatgaaagaataaaaagctgtttcatctattttaattttgcatatcaagcacagcatacaatactatggtaaatgttttcataatagtctaaaatcagtagcaataaatgccaccttagttttgtaatgtataatttttcaatactcttgtttaaattagcatacagtctttaaaagaccatgtttagtggaagaacaggcatttttactggtagtaatagtatttctactaataaaaatgagttattattagaggaatttatttccccaatggctttatggtcaatcaaccacaaattcagattcacacccagttttagttttatcatggtatctttttcaacttctacaaataacaatttttaaatgaaaaatattgaaatactggaatgggctaattgaatttttctgccatctgcatagtatagagtttttaaattatggagcacatatagttcaatctccttatcttattgatgaggaaactaaagcccagagaaagtaagcagctcttctcatatctcaacagtcattaacagattggaaaacagaccttaggtcgcctgacctctattacagtgttttcttcactgcgctacagaaagtctgaggaccttatacatgcaacaatttacagaatgttctctcattcattgagctcccataataaccatgtggagtattactattattattctcattttacaaagggattaactttggcttggagaatttaagtgactttgtaacactttcagtcatgaagtccagtgctttagattccaaagccagagctttgccactcaaatcaatgctgggatgtgttttccggaattaactcccattaaaagcaatccattgctggaaaagttttggaagtataaaattaagtgtaaaattatataagaatcttataaaaagattcataaatttcaagataattattttccaagaaaaaaatcttttagagtatgcatcttctcaaagcatcagctttctatagataattaaaaattgaactcagagaataatgaaagcttaccactatttgacttagcaagaaattcaagaggactctgatccaggttaacctttgtatcaatatcaggaggctcatagtttaagtgaaaatcatcaatgtaagcgtctagggcttcggaggcagagaaatacagcttttctttatactgtatggagccatcagtattaaaggatatgctgttcagtattaaagttgctggaagataagattcagaagtgctaaactgatgtttcttaactgactctgccatggctttctcacaatgggccacaatgtccattcatctttcaagaaattctaaacacaaaaaaaggtacgttaagttttcagttaagtaggaatggataataatactcttggaatccttgctaatctttcatgtgtaattacttattaaaaatgaaattactctttatctccctttatgttttatgtatacttgactttcaagcaatgttcattgattgatagatgattagtttcattggcatgactgcaagtgtaaactgtgtttcagaaatatatttgggggaagggcgagagcggtggctcacggctgtaatcctagcgactggagaggccaaggcaggtggaacatttgaggtctggagttcgagaccagcctggccaacatggcaaaactccgtctctatgaaaaatacaaaaataagctggatgtggtggcgcgcacctgcagtcccagtgacttgggaggctgaagcaggagaattgcttaaacccggaacataagccttgctaggtgaccacataagagaggtactgctttccttcgttttcagttttacttgattaaacaagtgttctggaatcttgagatatttttatttgctacgttaaaagatggcagtcctccattatcacattctagttttcattcccttcacctgtccccaccccattgatgggataaggaaagtcacatataaattcaagatgaaagcaacagggggccctggcataatagtgatggcaaatagagaccaggtagcaagaagaggtgagtgctgaaaggagtagaattcaggcgagagggtgtcctctcatgtgatactctggctttggtacaggagttcagcagctgtagacctctctattctcaccttacatcaatcacttactctttgcaaaattataaaaggttgctacaattagtaccctcattttccagatgagaaaatggtggtacacacagattaagtaacttgtccaaagctgcagactagggaagcaacagccaggctgaactccagctgtggattctgagtctgaacttaaccattgtgctagactcccgccttatgagtgcagtaactgcccagatgacctgtaatcctctaaacgttcaccacaagttacatgcatcaatgtctgccaaaattgggtgccgaggttctgtggtttccaatatacttactcattggtatgtgtggggcgaaatgccattcatgtgacaataatatacacataagtaccaaagattaaatacttactttttcagccctttgaaatttaggtggacatgttgtattttcagaatgttacattatacgacatcataatacataaattttgcatctgtggaatatttttcagtttcctctaatatacacagaagcttttgagaatctgaagaaaactatgaatcaccttcccacaaaaatgcactttagcagacacagaggcaatgggttccaggattcctgaggcttgttcatggtcctcctgcatctgaattctagattaagaacttttgtctaaagaaattgacagaagtgaaaagaaaggaagagaaagaaggctaaccaggaaaagaaaaataagacccttattagggatggaacaaacaaatccaacatcacatattcttagagatatcatggtaaaaaatcttttgactttagaggccctgctcaaaaggtactttgtaaatcatgatcgtctttttcctcctccttctctggatttgtcagtatgaattaattactattacagatcagagatgatgggttttggaactaaagagacctgggttaaattcggtttatctttaccagctgtgtgccttaatcccctccctaacatatgattcctttattttaaattctgcttaataatctttagaccttgtagagtagctgcatctgtttgatttcctgctgctttgcactagcatagccatttcaggggtaagacattgaaatactttgaaaatagttgctaaaagctgcttccctccacccactcttcccccctccctccaccagtgccttcttgctaccgaggccctggcccacttcacctagaagccttcagacctgctcatgatccagcaacttaaggggcaccatctggctccacagatcccgctcctggcttgtggctcatgcccattctgcctggttggtgcctggccatatagattgttaaatgttttgaatatcatcccggaagggccgtggtatgcagtaagtgttagtgtttctcccttcctcatcctttagtgctttgcctttctctattctgcatatgtatcatgatttgaccaaatgatcacgagaatatggcttctcccttctctaagttccaacaaaataaggaatggatgggtatttgtagttcccagcttacggcagttgttcaataaatgtttgctgaactggacttcagccaaaatactccattcaccataaagcattccagtgtgactgatgcagttggtaaaaatgttctgaaagacggagtctgctgggtttattgacagctgctgagaagcaacaaaataggcaaatacagtaatgtattcgagtcaccaatttaatcagagaatggctgaatgcacagcgagcaagaagttgatgacagagtcggtgacattatcatgcatgttagtaatatttttgaggttcacttatggcaaatctttaacaccagactgtccagtatgcttccacagctcaaagtccaattttaactggagatttaaagacgttttctatatccacttagttgcatgaataacattgtaaaggaaagttgacaaatatttctaaaacaatctagaaaatcaatgtgtaagatacgccagtgatcctgataattgaacactatttataaacaagtttatttggtgactttcattttatcatgtacgtgggaaagtgcaaattcattctcttggtttttcaccgtataggctcacagggggttaagcaaagaagaaagtgaacattcttgtagtttaaaaagcaagaggaccatatgcaatagcttaaaaaaagaatctatatatttcttaactgtatatcaaataaaattgcagattgttcagatattttccctagcaatttcatgtttgaagttggtctggctcgattctcttgatagtatttttaaaaaagtattcatcctataaaatcctcagggtgcatgcatctaccaggaggcaacccacttcctgaagaatagacaatatttcaagtagagggactagagaaagccatcagctctgtatttgttatcaccttaggctaagtcaaactcagtcagataagctgagtccctcaagtctgggcagagaaaaaggtccagaaatttgtactaagttcagtttctccctctcattcaattcaattaaacacacaattattgactgacaatgtgcaaggaaccatgctgagcaccgtatagggatacaaagatgggctaggcattatttccctcacaaggagcttgtagcccagtaggaaagataaaagcagcacatgaatgtaacccaaggaaaggcatgctaaatgccatcgagcatccccaagagtggctgaaacacagaggagagggaaattacttctgtttgatggaaattggtaaagtttcattttagacagggtagttaaactaggacatgaaaaagacgtaggtttcggatacacggaaatgaggaaaatcgatatgtcaggaagaagaaacacagttgaagacattaaatagtaaaatcacacacatatggatgtaggaatatatcagatttccttgggctcctttccttctgtggaagagcaggctagaaattctatgttatgaaccaaagtggtgtgttttagggctagctattgtatctattttacagaaagggtaaaccgagccacagaaagtttttaaaggctctaggagaatgtgtctagcgagttatagagctcatattatttccactacaccacagtgtccactttgcctgtcgtgcccaacggcagctgaatgaagccagcaccgtctccactggccatttccttccaagtgcccaacggcgggtagctccacatccaagggagggcatcccactccacctgtgcagttctcagaaatctctacctcagtttaagccactgatagaagaatactcttaaaagtattcttaaaagatcttatgggcccaagtccatctatgccacctgtatctcaggctgcttgggggagacaagaagcaccatgacagatttatttcttaatcttgtgagctttttccaaagaacttggtaagcaaataaagtatgttttatgaaatagataccatcttaactattctcagtctgactcaagaaattataagcccttaaaaatcaagctgtgagtatgctatgttatggaatttgaattttagtagaatatagtcagtaagatgagttgcatagctttctggtagaaaagacctaatggaaatatgtcacacattatctcaatcactggacactgtgatcaagaataccttccttgagagataacttacacatgctggtcactatgattaactatcagcatttagaccattagctgatcttaatggtcacgaatgaggaatagaagaaaccagtgtttgaaatacatagagcataggactggccaaccctataatcttgagggttcaactcttccctcaaactactaccctactgcctcttgtttattcaacaaatctctattgtcaatgtagaaaggtaacacacagtagagtttaggagtctggctctgacaccacactgaccagcttcaaatctagcagcataaccttgggcaaactaattaacttctctctccctaaattgcttcatctccaaaatgagcatggtaaaaatatccaactcatagcactgctgtaaggactaaaagggttaatatgagtaaaatatttaagacaatatgtacatagtactactgtacacagttagtaattattattgcctgctatgacccagatgatgtgctagctcctcctagtagaacatttgtttcctatcatgatgcatatactttttggttttaggggattccagcctacctagtcaacaggtggtatagcaactctggaatattaagcaccaagaaaagaaacctagaatttcattccctgtatccatttatctccttaaatttacattccatagttgaagggattaccctaaagcaggatcaatatttggtttatttcacacactggaatcatctgtagagctcagaaaagcctgaggctggaggagaggcatcagcaaaatttaaactatttcccaaatcttaagctttgagagatactgtgttctgctctagggactgcttttctcccgatgtcatttagctttttccccagcattctcaatcctctttatttccaaatcagagaatactcatgattgttgttcttttaacgtggatatgagcacttgagcaaatgtagctgctgaaagactttaaaagattttattcactttaatacaccatggctaattggggaaaagagcaaacaagcacattaggattatatctgtaggcctataactgtttaccggcacactggcaacatgttaagtagaatgtgacaatactgggtaatgaggaaaaaaaattcatttgcttggggaaaatctctatggacctaactttgaggaggagggaggggagcatttactcatttttttctaaactaaatataatatcatccatcacttctaaatatttttttttaattaaggaaaaaaatactagaatgaagaagggaccaaacaggctgcccagatccatttcctaccataatgtacaccatattttgagagttttctcagtggaggttgtggcatctggaaatacttgtgagaaaaatttaaatactatgaagcaaagggggttctgaggagtatgttgaaatttaatggaagagaagtattctgccttttgggaaaggtgattcttcttaatgaaaaatcaaatgacttgaaacaaattcttatttcactacatctctaggcaaagtcctatagtagcagctatgggagtgaaatgggttggctgtgtccccacccaaatctcatctcaaaccgtaacccctataatccccacatgtcgagggagggacctcttaggaggtgattggatcatgggggtggtttcccccatgctattctcatgatagtgagtgagttctcatgagatctgatggttttacacatggcagtttcccctgggcttttctctctcacctgctgccatgtaagacatgcctgcttctccttctgccatgattgtaagtttcctgaggcctccccagccacacggaactgtgagtcaattaaacctctttcctttacaaattaccttgggtatttctttatagtagtgtgaaaatggactaatacagggagaaaacaagaaaacgtaggagatagtgctttgccttcatggagattctgatgctgtgggagagaagaaaaatgtgtttgaaagttagcagttggcactgggcaggtcatattagtctgctaatgactagagccaacaaatagaggtagacgctctgcacagcgggtgctagaaagcatttccctgctgatctgagtggccatgtccccatcactccaggtgcttttcctgctctgtgaccaaagctgatttcaataacaagaagtctggtctggccttttagaattcaataaaaagtttccactccagacactcttggacttccattagggcctgtgtatgccttgcatatggtggagagccagatgagggttatgaaacagactacagcttttcatccctagcttgtttgatctgtaaagtaagaatgccagttgctttacttgaaagactccagaggtagaaaagactatcttaaaagagtacaagagtaaagagtttaaattggttgttctgggataaattctatttgcttacaactagattttgtcagaaaagtcatggttgttccaggtgtgatggctttgttgctcttggtaagagttgaatccttggatttcttgatattgatttctagatctcaggctctccgtttctacatacaattttcactgaatttctaaacttaaaataaaaaaaaacctctttcctacaagtgttaatatttaatcagtctaattaccccatcataactttccaaatatctctttttaggtaaaataccaaattgttaaaaccagggcctttataaacattaggtgcccctgtaagctgaacagctcacatttttgcagaatattcaggcattttgaacttgccaacttatcccctggaagtatcacctagaatgagaactatttggtaaacagaatcagtgaacaatctcacacctctgtattagccattcctccacttcctaatctcatgtagtagaatagaagctttagcacagtattgccttatcttcagtttcttacatgcttaaatttggcagtttagcatttatgtcactgtgggaggatatcgaacccaagaaactgttgacgcacactagactaggaagaaactatttgctataagcatttggcagatgcactgtaaaccacacccaagataatcgactgcctgaaacatcaacacaattcagtggatacctccaatagactgctgcttatgcttaacacatagcaatgaaatttaaaacaaaatttagggggcatatctatactcaaaaacaagatttatacctctgtggaccaaactttgaactgaaatatacacaattgagtagagaccagaggtgtccagtcctactgggtcaggactggacagaggctgtgatgacctgatgttcacagcctcagagaacagagactaaaagcctttcacatgcaaaagtcaatgaattcaggatcactgcaggaaccagtggctgaggcagggcatccttgctacagaggctgaaaacgctgtggtcaccactcagcactgtgaccactgattgattggggtagagggaaagaacaaagctatcaggcaccaaacataggtgatagattgaaactttttcaacataggaatagaatccctagcagtgataagggagacaactacaaaaaatttggacaagaagaagtgatcttaaagaaaaaaaaatcacaaaatgactaaaaaaccaaattaaaccacactaaaactattcaagatgaacttgcaaagataaggtaaaataaagtatctaagtgaatacaacctgtgccaaaaacatgataaggaaaacaaatataggtcaagtcctacagaagagggttgtagagaggatttttggaaaggtaaaaaaggaaggaaaattttgtgaaaatgaaacaccatacgcaaaatcatggaagttgaatgtggaatgttgcttggtccctggttaagtatcagagcactaagaaaagaggagttaggagtagttggagagagaaatgtgctttataaattgacatggggccaaactatgctggtatgtaaataccaggaagagaagttgaacttgatttctaaataatggcagcaggacaaaggtgtgataagcaaggtggtagcatttactggaaggaggagaggagggctgtggggtcctcagatgtttggggaggtgatgagagttgttaagatatgacatgaggatgtctgcgccattatgtacaataaagatggaaagagatgttttaaaggtagaattcataaggaacagattgggttagccactggggataaacaagagggaaaatttaaatattgtaagtctgggaagctggtgccactaaagcaatggtgaaaattagaaaagacattcccctaggaataaagaaaaaaatctaatttagtcatgctgttttttacattcttattttattttcattacctctttaaagtattgtacgcaggaacatgaagaagacatgagatgtttaaacactcatcatcaagatttcacaaatgtatatcttttgttaaaattgtatcagatatttttaaagtaacaaaatgatccagatactactctggatcaacttctccaactcatatccctccacgttcccccaagaggcaaccactatccccaaatgggggttgttatcctcctgctgtgcacttttatgcttttcccacatttggatgttcttatacactattactttgtgtgctttaacaattcatataaaatcatgctgcaaatctttctgttttgttttaaagacttttttatggtggctttaggttctctgcaaaattgagaaaagggtaccgagatttcccatatgcctcctgccctgccacatgtgcagcctcccccactatcaacatcccacaccagtgtggtacatttgttacagctgtatctacattgatgcctcattatcacccaaagtccacagtttacagtagggttcactcttaactacttttcattctatgagtttggacaaatgtataatgacacgtatccaccatacactaatatttttttgcagtttttttgtactttttttttttttttttttttgagacagagtctcgctctgtcacccaggctggagtgcagtggcacgatcttggctcactgcaagctccgcctcccgggttcacgccattctcctgcctcagcctcctgagtagctgggactacaggtatccgccactgcgcccagctaattatttgtattcttttagtagagacggggtttcaccgtggtcttgatctcctgaccttgtgatctgcccgtcttggcctcccaaagtgctgggattacaggtgtgagccaccgcacctggccttctgtacttttatgctttgaacacatatatatgttaatacaaagagagctagtgtattgatatatcatttgagggaaattagatatactgaagatcaggtgaaggactggaactgtaagtattgatttgacacctataaatatatagggaataattgaactctgagtataaattttttctccaggcatccaatagactctgaggtttttgagagcaatgagcctgtctcattatctttgaaagccacatggtgccagtcatggtgtgatactcaacaaatgattgtcaaatgaataaatgaacaactttttctctctctgtagaatatgcaacacagcttggaaactggcagccacaggcaaaatttgaactataagtgaattttgttagccaacagtgtatttttttcaatagaataaatcttttaagattgggagatttcccattttaaaaaaaaacagatcctgggctttattgcaaaatctaaatatctgacaacacctggcttgtacttcagcctggcaataatcaaggtgagtagctgcagccctccttaaacagactaagtttccagtgtgacattaccacttcccagtgcctctctgacaccaagaccaattgtctcttaccacggattattgcttgcactgttgtttttcttatggtacggcatatttcactgtatcctagcttctaagaaagagggaaaaaattaaaatggactgaaaggtcccagtgcttcatgcaaaactggaaataacatatttctttgcaaaagtaaaggctgtatccttaggtgtttaatatgcaaacagtgtatctaggtcatgggggatggcacttatttattaattaaataaatattaaatgcctggctcttgaaggtatttcagtttgcaacccgacctcctcttctcagatacttttaagaaatgcagtatttacatgaactttaaagaaaatgaattttctctttggctttttagtatttagtctcacttggtttttatcccaatagaaaattctaataacctggaaaccttgctaatctcaattttctctactagattgacctagtagaaccagccatgattcttgtgtaatttactatcagcaaatatttccaaaaattgaaatcagtttgattttgatgtaaacaagaaaaaaaaatgggagcaattcattttaactctaactctaggattgccagttatagggaattaatcaaaaggttagatttgcctcaccaaattttcacctttaaatgatgtaagacagctctctaaatgacaatttatcaatcaaggatactcatcagcaagggtcctgaaaggaagatgatgatgagaagtagctgtcagcctctactgaaggaggaccctccccaccaccctggtcccgccccattcgccgccacaccactgcccaggtgaggttgaaccacttctgactttgggatgggaaggcagtggctttagcacccaatcctcataactggacagaatatagagtgtcaaaaaaggtggcagggactggctggctttatgtctcaagtagggtgtccttctgtcctaaactgagcctctattcaagctttactccaatcatcatcttagataaaatagatctttcaggtctgttacattaacagaagtttatttttatagaaaacatggtcttctgttagaaagtaatgttattagacttaaaagtaggggacatctgaacccttgctggagaagcagattctaaaagccacaccatcccttatcccatgtttgtatgaattcagacacttaatttccagccctgacgggtttcctttccactgcattttaaagctattcccgcatatctagcatgaacctaatcgccatgaaaatgtatgactcttcctagatggataagagaaaaacaacagacaaagcacgatggccgtaatgtctccaaggcgacaggagggattctattttaggggattttaaagtttgctcttaaatgtctgaaaaagtcatgtttcaagaatttaacttaaatttaggttcttacagaaacataaaaggtattttaaactttattagtcagtagtttacagttttctcacaccctaagaaggtaagtcctgataaacccttaagggggaattctctacatttaaagtgtacttattagtgaaagtaatggtatgaaattatttcaaaagttaataaacataaataaacatatatataagaatatttatacaactgatttgttaatgcaaaaaaacctctgaaaaataaagacaaaagaaatcaataagaatgatacaaatgatacacaagatttttgctactattaattagcaaattactttgagaacttaatgcaacctaagctaaccgtaggtttgggatgaggactctcttcgcagctagaaaagatccttgtaaatgtgaaggaatgcctagtaagtaaagtacggtagtaattaaaattgtagtcttgtattcctgtaatccattccttttgggagcatccttttgggggcatgactgcatgtggatatgataagcaaccaacttaaaatccttcatctagctggggcaggagaatggcgtgaacccgggaggtggagcttgtagtgagccaagatcgtgccactgcactccaggctgggtgacagagcgagactccatctcaaaaaaaaaaaagaaaaaaaaatccttcatctaaaaagcagctcctggccaggcatggtgcctcatgcctgtaatcccagcattctgggaggccaaggcaggaggactgtttcagcccaggagtttgagacctgggcaacacagggagatcctgtctctaaaaataaaaataaaataagataaaataaaataaaatagccaggtgtggtggcatgcacctgtgttcccaactacctgggaggctgaggggggaagattgcttcagcctgggaagttgaggcttcagtgagccatgatcatgccattgcactccagtctgagcaacacagtgagatcttgtctccaaaaaaaaaacaaaataaaacaaaaacaaacgaacaacaacaacataaaaggataaaaataaaaagcggctcctgaactccttgccttgcttaccctgctctagcaatactgtgccccgtgatgatccttacatgccaagttcattcctgctgcatggcttttgtacttgctcttctctctgtgtagaatactctaccctagatagtcatgtggctttcatgtcttggctcaagtatcacctaatcagaggctgttcctgactactccatttcaaatagcgctttccccctcactctgtaacctcacaccctctgttaactttctgcataacattgagtgtgcatttatttgaatatttgtttattgttttactctgccattagaagtgaagctccatggatgcagagacaaggcctattttatttgctgctgtgtaaaccctcaccacccagagttttatctcacacgtaggtgctcaataaatatttgtgaatgaataaatgaagttgtcattgtgcatttctttttgcaaacaactttgctctatttatttcataacaaaatacttaaaagttacatttccacatgcattaatacagtgtcacataatccttgaggatgtgaatgttaaggtgtttccatttcataagctcctaaaaaagaacacatgtaccagtctctgtattgattctaatttaatataaactctatatgtacacaatctaatagaacaattcttttacatttaaaattgctgttcattctgacagtatgttttgtatgttctctaaacatggacattttaaagatatagttcttgaaggacccagttttgtagcatatactcactgatgactcaataactattaactcttggtgacttgttgccatgcaattctcttgtaaattctctctagtggaaaagaaaaaggagttctaccttgcttttagaccacagaaatggtcttatatagtataaactcccaaaacgcatagagttaacacacaggttcaacacacaaaataaacaaagggttgtttttctattaaaatgattctatttgctgtaccaagatagcatcaaaataaatcaatgttcatgcttctttagagagaaaaactaaagtatctactgttttctatgattctcatgttgatgcctaaatgcataaaatgtgacggcctcagcccaactattctcttgtgaactgttagctgtctttgaagtaaggaatcaatattgtgttcacgttagaatttgtgactatcttcaaaccttagtttggctattaaaatggtctataaaattcataccctaaaataatagctaaatattaaatatcaaaatcaatatcataatatatctcctattataataatgcacctacgtattcaaatgaatgactgtagcttagtattggaatatttatcagattgttcttatgtcatgggtaaaccttcaatgctgtttgaggcactgaggaaaaatgattaaattaatgaattatcctctaattgatatttaaatcaagaacttatccatcagctaataacaaagtatcaattagttattattaatcaaggtctgttaaacaagatttgtattgtataattacaacatcttcaacatttatatttcatgaaaccataagactacataataattgtacaaaattttacaaagcaatttcacatacacatttctcataaaccagtttcagcccattgtttcatatggcagcacataacacatttctgctgcatgaagtgatgtttgaaaagaagcctacgttattagtttgtcaatttgcttttattcagatatttatatttatattattgattccctgctaggtgctaggtattaaggatactgagaggaataagatatgggctatgcccattagagtagtggctatttttgcagagcatccaataaatttgtgtgtatatgtttatatgtgtgtatatatttatgtatacatgtatacatgtgtattacatgtatacaaatatatattatacaaatatatcatcttatctttctaggatataaatagttatactctgaacacatataaatattgaagttggaatgaatgttatcattttaggaaaataaaagcataatatacagataaataatggctttcctggaaacgacagaaacatgcttaagtttccagttgtgatgcacctagaaattgagaaatacttgaaaaaatggctcctatacagtaatctgaaagcagaactgtccttcagattaggaggcaacttccatcgccaatttgagaaatttcaggaagagcttcctatgctgaatatcaactggccgaagagtgtacagttcttccgttggagatttaagtcatctaaaatttccagtgaaaaaggccaagtctttggagcactgaaacaatcaaaatccctaggagttaatttctcaaaagaggaattacttccatcaaacaacaaaaagttggctctgaaagtaaggttgtacgaaaatgaaagctttgttagattttggcaaaaaaaaaaaaaaggtggaggggagatgggaaaaaaaataaaccatacttactactattttcaatttgacttgggggaagtcctgtctagagaatttagcataatctttttcaaaacctcagagggcttccatatgaatattaaacaccatgtaacacatatcttacccttggtgttgtctaaaatttcactggagttgtaggaaagatcagataattcatacattttcgttttctcaagcaaatatttttctgagtttttgtctagttttacatttagcattactgtagtatcatctcaagcctgtacaatggccagtattctatttctatagttatcaacccattcttctttccatctctatccttaagacattttaagtcaaatgattaattcatccagaagtctttggcacttaatgtaatcatttcaagatttcactgtgtaccatttgggatagtaaaattttggccagaaatgatttatatagaacaaaggtcttttccttctcatacgtaacactgtagccattcccaccctgggttcagtgagagaatggagccctattattctaaagtatccatactcctgcgcatgtagaatgatattaattgtgtaccaaccttggaagaattaagaaaacaatcaatcaaagcattttcagggttctgcggttcagatgagtaacccaggttgagaaagaccgagatttactccattcaaaatgcccctctagagaggttttccctctaactgtggctaatatctattaatcctgactgcccccttgttattttctcagttcattgcctgctgtagtcaaaaattctgcttctttcctctccttcctctgaagtctctctctccacttccccattctacactcctggccctcaaaagtctatacaagttaaacacagtatggtggaaatcatgcataacctgtttaacttcacatctttttatagtatcatattcccttgagggcaaaaaagggaactttaatatatttctgctagcagctgatgagtcaagattcttgtgcctattataaaacttctccaaagggaagcatagaagcacacctttctttagatgattgggtgaattatttcatgatgcattttccatattttgtggtatacaagcccgtcccttcctaggatttggtaagaactactttaaaaaatttctattgcttacctaaatgttgaaaaagatctcatgaaaataacctcttcctaccagaatacttgatattctaccctgtttctcttcataaaaacaaagcaatggtaagcctgaaccactcaatctaatctcttgcattaaggagctagttttccactgtcgattactgctctacccttcctgatctcattgagatgaggttagacattttgtcatgttcactgatcttttctgcctttgattccataaacaggaaccatctatgagtcaagctgtacaatcttggattaaagcccaggctatcaatgctttttcaaagggtgtgccataatactgctgtcagaatcagtttggataagaatgcttgtttgacagatcaaattctaattctaaatggtatagcatcccctttctcattaacctttatcacagcaacttgataatgttctgagatcaattggaattatgcccacaagctctaccaaattgaaagatgactatcattctttatgtcattgttttattatgaagttgtattaattattgtcataaagagcttagcatagatacactaatgataaaatgcttatattttgtgaatattctctaatatataaataaaaaactgaacctcttcccaaaagtttacttattcatctatatggggggaaggtacattgtgtagagaatttaacttgccaggcttcaggcttctcaggaagaagctgtattcaaaagtagagtgtatgaaggtcatctacctctttcaccatctggggggccaatcagtaatagctgccttttaaatgttatgagttcaaatcatctctttttgcttcatggcacagagcttaatggtttgacagaattgacttgaaatgatttgacagattcaaaatgcagacagctctgcactttggaggtatgtgtggggtgggtgaaggagtccaattcaactacagacatgtctgtagtttatttctgtgcagaagtgagtggggagactctgtctaggaaagaacttgttaggctcctaaatttttgtaacaaagtgaaaactttgcctcctacacatatgaactctaaagcgtgtgtgtctaactttgtaaacaataccagagaatactggcacaggaggcaattctcaaaattcactgcaacgttttccgtttgcacctgccaagtgtgcacttgaaacaacttgcgtttgaaagccactgtctaaggatctaagaatggctggtgcatctatgctccaatctgtgttgagataaatgaatgctttccaaaaatctggtttctacagtgttagcgctacttgaagaaaggtcctatcaccaaataaattgggaaaatactggtttaaacaaaattaattggatttattttctatcaaacttctaagggtctttaatatgctaatatggttttgaatctacaaaagggagattacattttttttttttgcatttccaagacaatttaactcgaacccatttctgatggagtaactattcacatctagcagggttagttttatgaagaacaaaggttgggaaacactgagctagagctccaaaaatcaatatgctcagactctactacctgcatttcctgaagaaattacttccctgcattatgacatcatattgtgcccttggcttttgtagtgagtcaacagagaaagagttttaaaaataactttatatttttgccacaccataattatagtctctaacatacattagataaacattcatagtatatattccttctagaatttgttgccaggtatgattatgtcttcaggttcattaatgggcaatgagatttataaacacagtaagagcttcccctgcctaaccctcaaatgctagagaactaaaatgtgccttaatacaacaagaaacatattctgggttgctgaaaaattttcttcctaaataatattttgtgtcttttatattataattgggtatcttgatatttagcttccttatcattaagctgggttaataaatttcaccttaataattgtggtgaagaatgtaaggtatgaaaatttaattgacataggtacataatatacccagttcagtatctcaattatgataagcatgaaataaatggtagctattgttattagtaatgttaatattacttttaatcgttttgtttttctctttttaatgttaatggtacaggagagtaaaagataaaaagtaaaagttttcttcctccattctttctctccctcattccccttcctcaataggaatttttttttctttttactgcttcagtttccaaacttctgaaaataccagaataaatgttgcaatttcttggcttactaggttttcttttccttttttctttttagacagggtcttgctgtgccacctaggctagagtgcagtggggcgatcactgctcaccagtgtagtctcgatctccctgggtgaagagaacctcccacctcagtctcccaggtaactggcatgcaccaccacatctggctaattttgtaattttgtgtagagacaaggtcttgccatgttgcctgagctggtcttgaactcctgttctcaagcaatactcccatggcagcctcctaaaatgctgaggttacaggcgtgagctaacacaaccaaccaaaataaactttttattacaatatggcatacacaaagaatagtacacaattcaaaaatgaacaactaggtgagttttcagaaagtgaacatacctatataatcacaacttagaataagaaatagcagagctctggtatccccataagtgtgtgtgtcctccctgaagttaaccaccatcctaacttctaccctcatagatagatttggaatggttttgagatctgtcataaatgatatcatacacatttttcctgcttagcttctttgactcaacattatgtttgtgagaatcatgcattttattgcatggcagagtggtgcatagtatgccaataattaccacatgtatttatgcattctactgttaagggatatttgggttgtttccagttttgtgctattacaaacagtgctgctaggaccattcttgtacaagtcttttgagtcacgtagcatgcatttttttgggtataaaactaggagtgggactgctgggccatctgatatgcatacgttctgttgcagatactaccgaacagttttctaaaagtagtagtatcaaattatacttctatgagcagtatatgaaagttccaattgctttaaatctgggccaacttttcatactgtcagtccttttaattgtagttttccttaccatgtcaacttcacatggtattttacaacatattctatgtaagttaacacagttaacagccctatacttccctgcacttgtctttcccccacaaacataaagctagtcaggtatgtaactatctttatactgtaaaaacttatattaataacatttacgttcccttcctagttataatttttatgctttctctgtacagatagaatataaaattttaaatatgaataacaattataaaatgatgattatgtaaatatttttcactggagaatcaaatactatgatggaatccctaaagcaggagatgcattctatgttcctaaatctgtgctactcaatggagaatcttccaagtataaaggtcaagttcatctgccaaaaattttttaaaaacatgacacattttacattgcttcatatttggatttttacctcttgtccagcttttgtcccccttaggatttctatttgcctttcttgttcttgttgacaaaagaaaaattatatctttactttatcattaatttaatacattattaaaattctatcatattataattaatttgtcattattaagaaatccatattcttcatcaggccttctgccttgactctgatgactggttctcatttggattgactgtactctactatataactgctattctgggatatcattctgctgcactcttaaattagatccacagcttctcgactttcacactttcctctttcctagattacttctatatacatttttgcttaagtataatctccagtcattttttttctaagagcatgtgttggatttaaattttctgaatcattgcatacctaaaaatgtatttattttatgctcacccttgatagacatttttaggtttgaagcatttcttctcaaacattgaaaccttttttttttttgatttggtattgataaaaatctgacacgaagttgattctaattcctttataggaaacctatttttatttctcttgagaagttcttaggatcttctcattttccacgatgtcctggaagaggatttgtttatgtctttgtttagtaattttgcttagagctcaaagggccctttcaatctgaaaacatgtttgaatttggagaatttacaccaatcatttccattataatttctttccccttttctcgtctgctctccaaatgctttttaggttgatgttgtacctattcaattgatcttctatgtatctacatttttcaagtatttgccttaactttgtcaactgtttcttttagtgaatattaattttagcagtcatagttttatattctgtgaattctgtatatttctcttttgctcccttgtcattatagctggtcatgctttgtggatgtgataccttcttgaatgcaatattcacttgaatgcttctgaggctactcattagaatttttaaaaatctctcttttgttcctgaatcacctcttctttcttcaggtcagttgttagtccaaaagatgtcaatgatccctagttatcagtttacatttattaataaagaactaggttgcctaatacaagtagctggtgtgagttatagcactatgttttcttaaccactttttccccaggataacagggcatgatcactggcagacttcacccaaggcctcgggtgggagacaggcagcagggtgagcaggcagtacacttgcctattcctcaactccacaccaaaatggggagggctttcttggggggtcatcactacagatccatgaatttcttaagagactggctttctaattttagattagggaacaatagggaaggtgatgaaggtgaaggaggtgtttaactttctcagctgttccatccttcaaaaaatcatcttgttctctgcctccttcctctgcctgatttccaaaaaccacacaagtttgaagcctgtctgtggttccatggccaggaagggtggctcctccctctacttttcttgtatttgctctggattgtaatgtctgcttggtttatccactttccatcttccacaaatttctgaaaatctcttgtttcttgatatccttttctcctatttttagaactgccctttttacttatgctgatatttgggatgtagctgaggcaaaagtttgtggtcagtgtgccttgagtcactaatcctgatatagattttaacatttggaaggcatacatttaaaataaacaagtagcatctatacaaaatatcacaaggaattaatcactcttggaaactatctttactctgatactttctgagtcttcatagcctgtaaaccaaatttatcaacaaaccatttagaaaaacaaaggcaataaacgaaattcatttttgatctgtatgaggtcacctagctttatagattagaaaagactcaattcaatcagaaactctgtggggtcctagatattccccagattgaattcaattgggaattttgtcatgcagaattaacaatagtttgtccttcagcctccagctgcctggtgctgtttctggtcccctgccagtattttcctccagacagccttgagcaggctttgggaggaggaggggaaggaggaaggtatggaacacccctctagttaaataggaaattgggaaatcagcagatgttagaggatactaaagatcctcagaaaaggccgagtgcaggaatagctcacacctgtaatctcagcaccttgggaggccaagatgagaggatagcctgagcccaggagttgaagatcagcctgggcaaacatagggacatagggagacctcatcactatcaaaaagaaaaaaaaataataataataccagcatggtggggtcctagctacttgggggttgggggagtggcagggaggctgccgagacaggaggattgctcgggcctgggaggatgaggctgcagtaagccaagattgcaccactgcactccagctgggcaacagagagaccctgtctcaaaagaaacaaataagcaaaaaataaaaagatcttcagaatattcctggagctttctttccccatgtgatgtgaaaaatcaagaactctgatgaaaagaaaaggcattatctgaaacactccaagcccaaaacaaatgtgtgggattggttaagcccggagatctttaaaaattgacatcatttggccaggcatggtggctcacacctgtaatcccagcactttgggaggccaaggtgggcagatcacttggggtcaggagtttgagaccagccgggccaaaatacaacaaattagccaggtgtggtgatgggtgcctgtaatcccagctactcgggaggctgaggcaagagaatcacttgaacccaggaggcggaggctgcagtgagctgagatcgtgccactgcactgcagcctgggtgacagagtgagactctgtctcaataaataaataaataaataaataaatattaacattatccattcgacagatacttattgggcattttctttgtaccaaatactttgtacttgccagtgacataatggtaagtaaagcatggatactaattttcaaggaattcatagtctgatggttgtatacagataaacaaagaattatcatcaaatgtagaaagcataatgaaagccatctatacaggtttatgaatacacagagcaggagtacctattcagtggtgtgctggtaaatgtttaacaagtggctttgtcggggcatgccttgatttatagcatccatcaatgtctctggtgtaaatactcccactatggccaatttcagtctaccaacttgatgtcattgaatgtggagttgctaagagatgtgtggcacaccattatagagtagctctcccacatagatagagtagacttcaagagcacagaacataaaatgtagtaatgattagaaaatgatgaattgttagtattcattacctccgtttttaatatcatttaattgcaaatttatataattttaaatgattgtgtttacaagctagttcaaaaaattctttaacatttaacaattggctccatagaagatgactttaaccaatgaagtctactcttcattgtgggctagggcaacagactttctgcaccatacaaatgagggtgaactcctttgcatgagtagctatgtccattagcattgaaagaagacaagtaacagaagagaagagggagcaatgagaagagctgagatgctcagaacattgcaccgcatacaaccaaagcagaaaactttataaccctgcctttcaactattttctccatataataaccttccgcataaggggagaagaaagggagagatcagttagcccttaggtccctaaatagtaaggacaaaaaatcacatgaaaattacaatattcatttccatccccatggaacattccttccagtctatgctgatgtggactgccaaggagggcagacttgaagacttaacaaaatgatccactggaaatcctacgttagcagtggcgctcataacttcatacaggactgcaggctcagatttgcaggggtgttcacacagttctgtggaatgagagcaactcaggagtggactcagcaaatggttgagtcaactgtcatttttaaactatgtcttcaaaactctcaccaaaatgtatacacacaaatgcgttataacctgtatcaggcctcttttgattgcaaataacagaaagacctggctctaatgggcttaggtgttaaagacatttaatggctaacttaactgaagaagtctaagggagagctcagagctcccttaaggtagttcttgagcaggggctgaagtgatgacagtcagatatggtgtctctttcttttggatccactgccattttcagacaggctctgccctcaaagtcacaggaaggctatagcagtttcatagcccttatatctgctcagcttctcccttctagcagctgagtaaaattcctgggcttgtctctggctgaaacatatctagtagcatctctatgaagctgccagtacgttaggtccatggctcccaaactcagctaacacagtaaagtcacctggggaatgtgttaaaatgccaaagaacaggccacacttccaggcaattaaatcacaatctctggggttggatccaggcaacattattttcttaaggttacaaggtaattccaatggagagaaaaatttagaaacccctgaattgggtgctcataaaaataggagattttagactcatcttctgatttactaagaaagtcaagtttgattaatttccttaatgtccacctcaaagtctttcttcctatgctttcctgtctctgtgacaagagtgtccctcttgctcactctagctggctgccatctgtctcgtggtctcacactcacactgtcttgcctggttctagagttcatccctcttctagtttgcatcttgaaattttacctccctactggttctatccttttaaaaaatgctcagatttctcccatcctataatagccttccttatcccccatgaccccgccctccacccccacaggctgctgcccatctacagcctaactttcaccttcagacttcttaaaagagtggtctgcccttgttgcctttaatgcagagaatccttataatctggtttggacatcaataccctgtgaaaactgttctctcaaaggtcagcaatgacccacttacaaaacagaagggctgcttctcgcctctccttctctcatctttgctttggtttttagatattacggtatccaaacgctatttctcccactgtttttctctctgccacctctattagcttaagaaagccttggggaaaatgtgtgggacgtgtatcctaaacacatttctcagacaatatgtatcagaagacttgaaagtgaagatacatgaaggcaacaatttaaagcacaaaataaattctttaaagacaattcagtatcatgtattagactgaaaactgggaaacaaactaaagatatattatccacataaggaaatactacagagacagtaacagtttcctatgacaagtgtgtgctaatgtgcacaaatgggcagaatattaggaagaagatgtaagacaaaacatgtattatacatataatttcaacttattaaaaagcataataatttgtaaatcaatttgttttcctccattggtttccattattatgatgacaacatatctttagtgatatttagttttaccttttctcctaattcatctgttttgaaaatgaatagaaatttccttagtacaaatgtaacttattgtattcttcatatattcagctatttaataatgtagttggaattattagtaagaagctctttctcactttctaataccccgagctttgcctgaatttaggtggtcatcattgactgagacatccaagaccactgcttttattgctttttgtaatggcaaggtcaaagtttccttggtttgaagggtgcagtaacatcctttaaggagctacatgtaataaatatctgggtgcattttttttttggatatatgcgatactgaaacaaataattattttaaaaatctgcaaataagattttcttctgtatatttaataaagcagcagttactaattttaaatttaacataattctcatgtatatgggcaaaaaagtggtaagaaactaaaagagagaaaaagatgagtttcaaacactgacggcttgcctatccctagaaactatgtattttgcctcctctcaaatagtgggaagttatcaaattatatattttccgccagaataaagtgaatttactaatataagaatttcaaataaatcaactgtagtagaaaattaaatcattttgttatagctaacatgagtataaaacagttttcacaagtaatttttaatttacagattaagaaactgaaatttagtgggggaaattcagtttttttgtttgtttgtttttgccacacaagtaaaaataggaaagctaggaaaggttgacatatcttctaatttctaagtctattctatttcccctaccataaggaatgctgagagattagtgtggtgttgtcttgattaatttctctttattattctagataggcaggtctatggtttctatccgtttctagaagagaaaaaaaatggcaaaaatgaaacactggggttcctcctgtcctccacttgtgatcttaggaatgattcttaacttctctgaacctcttctttttcatctgtatggtggggataatgacgataatattgcaagatttaaatgagttagtacatgtaaaatgtttagaatagtacctggcagaaagtaagtgctcaataaatgttagctatccttatttccattcttcctcctaaacatttcccaaaagtatataagttaatcgattagaatgcctatcctacattggccctccttttcccagtaatgaaccagatatttcttcctaacctgctacaatcatataagaagggtgtagactccttcttgtttatatggggtcatacaaggcatagccaaaatttcctctggaggatgggtacctcctggaacgaggtaaagtatttctagcatccaattcccatttggaagacaggggagaaataaatgcgccattatgataattctaactagttatataaacgaaaagcttcagtccagtggagagtaaagcggtccaagccactgttcaatgtaaactccctcaaagcatgggctagaagcacagcaagaaatccatcacaatctggaccacgagcagcacttgcgcgagaacaagacctgcctgggacccagctgcagcattctcctgttcaagtggggtctctctatttgcaagagaaatatgccccatgccctagcaatagatgaaactccaataaaacaagacagacttactttgtgaaatatctattaagtgcatattattttaaaaagttgataggctagaaagataaatacgttaaatgcactagctttgatggcatgaaatgaaggggtggaggcaaagcagaaaggacatggttgcaggtgagatttggaaaggggtggaaagttaacgaggtggaggatacagttaagttgttccagatggcaggatctgacagagaaggccagcgagggttagcagaatggatgaggatggggagacaggagaaatgaggtccagcacagagagagagagcattctcaacccagatgatgatcagttctgaatcatatcacagagtggatgaggaatcattagagaagactgctgaaggaaccacaaggctagacacagacagatgggaaagagcaaagtgaccagaacagaaaatccaaggccaccagcaaaggagccatcaggtttggaacactgatactgaactctgtgatggattcagaattccttggattaaaagattctgcagatgagaaaagatgggaaatatttttcctcttccattaagacaaaacatttaaatgtgtttctttaattaagattacacttaggaaatgagtttctaaatagaagaacttttaaacacaggatgagtgtcagagtttaaagggatttagacgtcacctgagtaatccattaaaagtttatcagacaaactgtgagattgttcttgtcagagagaattgagaataagattactggttgtctgagatggttgagtttcagttctctctggaaacaagtcctagacgaatgtctgaccttccctttcaagcataatgattccatgattggggtaagtgtaaggaacaatgactgaaaaaatgagagtgagtgtgatcacaacccagccttttaatcttgctcagtgccagtggagagagcaatacccatacatgcccagacagcagaaaaggagaaaagatactgaggttgggaggagaaatcaggaagaagagagggagagagaaagaaagtagaatgcacagcagggagcagttccctgccagccacagatgtctcacttagacaccccattgggatgaaggtcaacggggctgcttatagtttgttagtgggaaagggacagggagagttaattctattttaggccatatgtgtatttgggaagagagagaaagtgaagataagtagaaaataaaatgacacgtaggccagctatgatgaaaaatgttgaagtctatactaaagtgaaggcaaaggtttccgacatgagctttgagccagtagagaaaagacagagagagagggtgggtggcagcaaaacaatgaaaggtgcccagagccgtgctccctgtggaatgtcagtaaatattaattggctgatgttggcattggtaggcagagtgaagcttgtgaaagaaaaatgccattgccagtggagcacgaaagttcagatctcggagctcaaaatggcagcacctgagcaagcagcagagtcacatcccatatcaccagagaaagtgattctctgcatatgaggccaaactgtctcaaggaaaagtaatcacacaatcatgacaagagaaaaagaacaaagtctgtgggagccatgaaaatatctccccttctctgagaacatactcccttcccctgaggtatggtagcccctagctgagaaaccagggctgtcccaggtaaacagctgtgaaggtaggtgccaagaagcctagatttacccactccagaaaacccttttgtcagatgtctctggaaacctcacaaaatgttattttgggatttggctctaaggttgggtaattggtagactctcattctggaggaagaaaagaacggcattgcttctttagatttcaatattagatgggaaacggaatgcttttgacggtgcttggtgttttcatgaaccaaagttcctctcataatggcaggcatgggccttttgggtaaaggttattttcttgctcttgttctacattggtaggtacctgataaggcaaaatgattgaaacagtggcttgaaacattaataagaaaatgactcaattcccaagtcagagaagtgctaagtttacctgaaatatattctactataatactgtggatcagtgtctatgtggagtgatccaaggacttgtctagaaatacatgttttatacatcttttaaaattacatctgacctaaagaaaaaatatttattgttcaataatatattcattttaaaaatgctttttacacctataaattgtcccagcccagaattctaagtgcaaaaatgtcagtgtctggcacatagtaggtacttaatcgatatttgttaagtatgtattagatatatgaagaatgtaagaatcaagtaaaaatatcaagaatgtgggtgtttgtagaaaattgtttcccttttattccatcattttctccttaagaaaattaagaagaaattgcaattgccatattgctttttcttgtgggtgatatcaaccacaaatagcaaggtagttttggagtcatgaagcaaacttccccctgctaagatctgggtaaggttttagccacaagaggcctaataaagctcttgaagcatttcctaagagctcacagaagatttaaatgccctactactttcaactagacaaatccaattcattttaacaaacagttttgaagtgcctactaagtgtaatgccttgtgctaaatgtctggaagagtgagtgttaggtggagccctcaatgggtataaagaaatatgtatgtttgggagttgagggtgagggtgtgggagttgtgtgagtagggagaatgggacaagaaagaaacttcaagtgtatatccacccctgtccccaaatacactcctgaccctaaaagaaaggtcattttaatattgtaattacatatgtttcctggttttatcattacagcttaagaaaacagcaccacaagtatgggtggggtgctagaactcaatgaatccactttggaacaagaagcatgggtggaacttgaacgttgttggacaagactgaagcagatggcaaggcaaggtaccgtgttactcaggtgcattcttgtaagtatttggacagccagttaaacacaaagaagaacccaattatggcaaattgattctgcaaagagattttattttaatcatcaactgacagtcttaagttaaataccaaatagagcagacataaagattttggaaaaaagtgtgaggtagcaactccaaagcagttatcaatactttcctcaattatctagatttttagcgactatcttagtaaacacttaaatctcctttcaatgcaggagatcaatgcttccataaaattcagaaaactgagaaagttaaaaatatttgtaagaactataaattgcttgggttcactctcttccttgtatgtagtacttataaaagaactgatacagatgaatagaaaatactgattgtttcatgtttatgatgtaagaagaccatcaacttctcaacatcaagataagtaaatgccaaaatcaggtcagaaaagaacttttcagaataagggcctgcctttaaaagtctcagccaaaaccgtaacagaaaggatagtctcttagtcatgatttataaacagaaattgtacgtctgtaccaattgtagaggataaagtcaaaacagaatttacagcctcctgctaatagcctaatttaaaatgtataatcttccctacatttcccccaaagtaccttttaaaggactcactctgctatccaaacaacttgcaaatgcattcggtaagttggtctacagtatttattctctttcctgttattgactcaagatctatttctcatgatttgctttgtgctcattcttctgccagataaaatattaattgcatttttagctgcactgctggtgatcaaagaattctgatatgtcaagctaaactgacagaaatagcatccattaacatatttataggttcagagcttctagaacataattatatccattaattactcaacagtactctatattacaggctgaaaaagaaaggcatttgcaactaaatacttttactcagaatgaagtttttttttaaataataaattttctctaaggaaggttctatctaaaggaaataaggcaagagagctcacatatctatatggacacaaggcaggatttttaaggcatccatttactaactttgcaatagaatgctcacaaagtaaacgagatggcacatccagaatggtttcaaataaaataataccttaaatattacagagaaatttaattactattttagagttctaagagtgacaatctgaagctggtaattcttgatgataagattccgagcaatgatttttactttcaaataaacttctagtattacataggaccaaagcatttggaattacatacttttctgaacatgcaattctaacacataaagaaattaaagctgtccagggaaaaagctcttaagatgttggaaagtcatagaacaaacaattattctgtggatccaccagctgtgcgagtcctgaatctgccagctgcatttagtatatgtatcatagaaaggacagtaacacacacttgactccttttggccagttaatcagcatgcaaaatgacggtttcccacaataacttcagcaccggacccaaacacattctcttttcagcaaagaatgaagtcattaaaaaaaaaatcacacaagctgctttcataatttcagcacgaacacaaccgagatgtaaggacagaaagcaaagccgagtctacctgtacatatgtatctatacatatttcactgagttctttgttgcctgacaataaattgcaaaggcagtcatatttgaaagtaaaaaccattaaactgtgtttataggatactgcaacagactcgctgagggaataacaaggaaagcacgatacctttagtaagtcgcctcagaatttgacaacggcatttaaaagagacagctatcattcttgctcactgctttctgtggcaaagtgtactcaaggctctctgctctggtggctgcagcagcagcagcatatgaattccttgcgcacataccaggagaaaggtagtcccagtggggagtgacaaagcttaattcctcttggctgatgcagaggtccgctacatgtcatctggcaaatctgtgtcattcactactactaccacccctgcctgccacagcctcctcccccttcacaatcac

SEQ ID NO: 276 - DNA, 331715 bp, Homo sapiens; identical to SEQ ID NO: 275

SEQ ID NO: 277 - DNA, 228336 bp, Homo sapiens
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacaggtatgttagctggaaggcgaggtctgggacgcgagcgggttcgggtttaccgctgcagtttccgagttgaattcgcttatttcaaagcatgttaactttcagaatggaaaaagggtgtgttgcggggggggggggggaggaaataatgttttattctggaaaggattcttaaaatacaggaagccttttaaaaatgcagaagcaagtagcttttgtcattgaatagaaatcaaatagcccgctaatcacatggcactttttaaggactgtatatgcaatagatgagttcgcagaagaatgaggtgaatcatttgtggttgaatagattgactactcccgcttttggcatcctctgatatgtgtctttttggtgccatttatctgtttgctgttataatgatgcctacccaaaaataacatacagcctttagaatgagaggatacatctatgagttttaatcagtgtggtttcgttattgaaaatcgagaggaaaaatctgagattttatcgttacaagacatgagctttgcaaatgagagtaatttagatgaaaagacagcagtataggtgaatataatattttacagattaattcaatgttctttgtatttgttgcataattaggagactgttttaacagtttaaactttaaacttggtaattcctggaaagatgccaaaagcatttccattttttcaccataggtttacatatttttgttttttttttaaaagggattgaaatcattagcaaatgagtttacatctttatatagtattggaaaagctacctgttgtacatcaccaagaaacttaataagtatagttactattattgagcatttatgaagtgcaaaacattttacacatactgtctcagatcctcacaagaacggtgtttggctggtgccattaacctctagagatgagaaatctaggcatatagaggtaacacagcttcacatgtctagttaagtggtagttctgggatttgattagatttttgagttttcagtgctgtgttctgcacgactaactggtaagtatagtggttttaagtaggagagtaagagcgtacaccctaggttttctgaatttttggattagtgatatgctttacactgggagccaatatgttggagacaaaagtttcttgtccttaatgcatttgatgcattcttctctcttcttttctgttctcttccttcacttcttgtctgtcttctcttcgaaataatctccaagctactacattggttttatgacgtgttgaacactgatctgtaatgttccaatgacacaatactttgcttcttgatttggcttcagaggccacttctgtggtcaaccacttgaaaaagttctgttatgccttttgttttctcagtttactaccagtgataatagatagtactttaggaaaatgtgtgtcgggagaaaaattgttttgagaggatttattatggaacaaagtggtatcaactattttcatagaatggaattaattgaattttgaccaaatgtgaacaaattgcattttttaacactggaaaattgttttagcagtttcatcacttttgtgggcaattttcctgaacttaacagttacagtttaacatattttaattgtaatttgttggtgcggtaattctgtctgtcctcttgtaagtggaaaatttctaggcttcttaatcctagtgtggtgctctttccatcacagcatagctatatatgtatatagctataccaggtagcttcaattattgtttatattagaggaaaatacaatttgtgcttctaaagagggtgtaatttcttagtgcagaaaacccttattcacattctacttctaataggaacatttttgcacacttaaagtatatgtgaatagttcagggtttatacatgcctacctaatattctgtctacaaaataattctattttgacattactagaaaagggtatttttaacttagcagatactatcataacaagaatgtttatttatgcttgttccagaagtctaacagtggatttgtgctttttgtttgcatgtatattatgttaaatatattgagaggaaatcagtacttttatggaagtaaaagatcaggagattttctgattttcaaagtgttgtatatgacaatggtaaaaacacttgcttgtttcagaaggtgaaggaagatgaaaagattttagatgggacctgacataggagaaaatgtcctggattcatagacagaggattgaggagtcttggcttaactgtttaattttggaaaagtctgtgaacctttctgaatcttagtatcctgtcaaattaagggatcctagtagatgaattctgtaatatcttctaattctaaaattaaattatataataccttctaattctaaaattaaattcttttagtttacacttttggtaaggtagaaattaaaataaaataagatgtcacaaactagtagttcttgaagttttacttaaatgttgaatgttgaccttgctaacctatactttccaaggtataataattgaaaaagatgagcaaatatcctgtatattttggataggactttaaaaaagtatatgggggttcatttgtaggatggtaacaaaattattacatgttcatttccttaagaatttaaacatttttattaacctctttgaaagccacttaaacttctatcaatagaaatgtttttaattgtagaataatagatttaaagtagtttttaacttttgggatgttatattactgtgttgaaaaataatggcatgtttgtaaaacatttgattttataattagatttataatatttgatttaaatgctatatatgtatcagttcagttcttaactaaggtttttttttttttttggcaaagcatttagagatttgaagcccaaatctaggtgctgttaatggtgttctgctttggtgggttaatggaaagaagcactgagtttgtagtcttatctgccaagaatcagcagaaactaataggaagtttaaaaaaatcagtcgtctgcatagaagctttaatcagaattaaacaagctacatttctatgccattttaattgcatattctacagtgcaattttcagcttttcaatgagatcactttgtgtttgactaggtaaatacaaggttttgaaaggcataagttagtgtgtgagatatttttctatacctttagtgctaagtgctttctaaatggttaggtaaatatttaaaaattccgtggccctaatgcccataaatattacttaaagttttaattttatttgaaaaaggtatacatatgtagtgtgagagcctaaaaaagagagttttttttaaagtgtggttatttactcacctaaggaatttgcaaggcataattccctgttaatttctttaagaatactgtagtatttgtgaaatttattttatggcttcagtgagtgagtgttttattccaatttcatgttactattttgtggtaaaatatcagcctacataataattttatactttattttgtaaatatagtatgtactctgccatgagtattatttttcaaaaacacagatttgatagagtcactctgttttaaaaatctcttatggcttttcattgtccacaggatactgttcatgcccttgacccttgcttgcaaagtccttcataatctgcactctgccattttttgttttatttttttaaaaagcattttattactaatgggacactccctctccacatgcattctagctatttgagggctgcttcttgttattgacattgttgtgggtttttctcttttgattttaacatctccacttgttgaaatctcctttaaggaacaaataagattaggaagactttaggcagtgcactgatactcaaatttatgtataagctgagaacaaattatagcagaatgggccatatttaaaaataaaagttgacaaaccatatgaaacagtgctgatgagtatttccattatagtgcattagatagtcacatctccataatttgtttttatacacttagtagaaggtaaccataagtaaaagcataaagtttgtttttcattgtcatcagactctgtcctcctcagtggcaggcccttctctcattctttctcttttccctttcaattaccaagtcagcttatttccctagcacactcttctaagccttctgtaccccattcaaagcaaaaatttattcttgccgaaaaagcctatttcagtataaatgttggtatagatatataaaatataggacaggttcagagtttatctaatctaattgaaatctgctcattatatattgtacaaggaaaataaattgaactccagagagataaaaatactggctgagggttattctgtgagatatttggaaaacggggactagaacctaggtctttactcctagtccacttttactttccacaaggagcatatatacttcccatcatagccttccaaggctgtacttaattttgccaggtatctccaattatgtgaaaaaaggcagtgtctctggttaaaggaggtaggcaagaagtgagagagagtcagttaagagggactcttgaaaatcctatagtttgtaatgaccttgatgacaaacttctgatacagttatttcagagtaatttgtaaggatgcagctggtcgcaaactcatgtacctacataacatttattttatatgttgaagacagaggggagggtcaaaaggagagtaggaagaatggaagtgaactgactattgcctgcttcgcttaaaggcattcagtttaaacaaaagaaactgaaaaactgttagctaaacaacattttggaagaactgggttctgtctgtgggtggttcctgacagtttataacattgacttgttgttcatcttgttatttacaagctgatctgcacttatttaggttgttgttataagcctgttcttagaacttggggcagaagagtgtatctcccacttttttttttttcttttacaaccaacaactttccttctggcattgatttacctagcagataactttacagatttctcctcctccatctgctacagcacgttctttggccacctcttccttacatttcatacaacttgcattcagcaatgttttttttttttttttttgagacagggtctcactctgttgcccaggctagggtgcagtgatgtgcaatcttgcctcactgcaaactctgccttgcaggctcaagtaatcctcccacctcagcctcctgactaggtgggactgcagtgcgtgccatcatgcccagctaatttttgtatcttttttttgtagagaaggggtttcgctgtgttgcccaggcatgtctcaaactcctgggctctagccatctgcccaccttggccaaagatgtccacatttgagaatatgttaccttatgtggcaaaatggactttggagatgggtttaaggattttgagatgaagatattatccaggattatctgagtgggtgcagtgtaatcatgagggtccttaaaaagtagaagagagaggcagaagagattagagaagatttgacagtggaagcagggttggagtaatacagtgtgatacacatccacccttgggaggctgaggccggagaatggcttgaacccgggaggcggagcttgcagtgagccgagattactcaacccatctttgctagctttggtgatgaaagaaggggaccctgagccaaggaaagcaggcagcctctaagaagatgaaaaaggtaaggaagtagattttttccctagagctcccagaaagtattgaagccccaccagcaccttggtttagcttagtgagacctatatcagacttctgacttgcagacctacgagatacatttgtgttattttatgcctttgaatttgcgataatttgttacaggagcatactagtttgctagggctgccatgacaaagtagcacaaactaggtggcttgaacagcagaaatgaattgtctcaagttctggaggccagaagtccaagatcaagttatctccagggttggttccttttgaaggctgtgagggagaatctgttccatgtctttctcctagcttctggtggtttactggcaatctttggcttgcagatgcatcacgctgatctcattcttcatcttcgcatggcattctccctgtatgttcacatagtctttccctgtacctgtctttgtttccaaattttctaatcttctaaggatccaggtcatattggattggggtccaccctgattatccccgtagagaccttatttcctaataagattacattctgaggtactgaggattaggactcaacatatttttttggggcgatacaattcagcccatgtaggtagaaacagaaaactaaagctacgtaaaattgaattgtttttcaaaatggatgctgaatataaattgatacatttatatttttgctatcagtgagtaagaatgcccctggatccacattcttatcaaccagtgcttcctatttactgacttttaagtttggctagtctagtgggtatgaaatggcatttctttgtgattgtaatctgcatttttctaatttctagatttatatgtatgttgtgatgtagagattcaatctcattttttatccaaatggatatccagtcatgccaacacactatattgaaaagtttatttattctccattcatcagtgctgcctctgtcctatatcaaatttcaatatatgtatgactgtatctgggctctattatgtttgatttgttagtttatgcatcttgtgttaataccacactatcttagttataatagctttctaataagacttaatatcctgtattgatagtgtccattgatgtgcaaaagttttcaattttgatgaagtttatctactttttcttttgttgcctatgattttggtgtcatatcaaataaatcactgcaaattcaatgtaatgaagctctcattctgtgttttctttgaggagttttataaaagttttagttctaatatttaggtctttgattcattttgagttaatttttgtatacaaaattttgtataattacagtgtaaggtaatggtccaactttattcttttgcctgtggatgttacatttttctaagaccatttgttgaaaaaaactgttaataacctttcaacaaagtgttggcttctttgttgaaaattatttgacagtacatgtgaggatttattgctaggctctctgttctatgtcataggtctatacgtctgtgtttctgtcagtaccacactgttttgattattgtatcttttagtaagttttgaaatcatgaagtttgagacctcaaactttgttctttttcaagattattttggctatttgagtgtcctttgagattccaatatgaattttaggatgaatttttctgtttctgcaaaaaatgtcattggggtttattttttattgtggtaaaaaccataaaatttactctgttctttatttttaagtgtacagttcagtggtgttaagtatattcacattgttgtgaaacagatctccctatcttttccatcttgcagaactgacactctatactcattaaataacaactacccttccgctgtcccctgataatcaccgtttgactttatgtttcaatgaatttgaggactttagatacctcatataagtggaatcatacagtatttttttgtgacttgcttatttcacttagtataatcatctttgggattttgatagagattgccttgaatctgtagattgcttttagtagcactggcatcttaacaataataggttttctaatccatgaaaatgggatatcttttgatttatttgtatattaatttatttcagcaatatttcatagttttcagtgtatgagtctttcacctccatggttaagtttattcctgagcattttattcttttcaatgctgttgcagatagaactgttttcttaatttcctttttgaattatttatagtatataactctatgcaactgatttgtatgtgttgatttttatatactgcagctttgctgaatttgtttgttctaatggttttttttggtggaatcttcagggtcttaacttagtttttgatccctaaaattagtgctgcatatgtagactcagaaacctcacgtaaaaatttaaattggcctcaggttggcaatgttccaaggcaatggttagaagcaaattcagattctccaaggcctcaaataattcctacagataaaatcccaaggaaattcagcagtgcctagtcaaaaatccacaaatcaggcaaggtaataaggcactatgaataagaacctaagaaaaagtacacaacaaaaacacatccgccctcgggaggctgaggcaggagaatggcttgaacccgggaggcaaagcttgcagtgagccgacatcatgccactacactccagcctgggcgacagagcaagactccgtctcaaaaaaaaaccaaaaaaaccaacaaaaaaaccacacccaccaaagcttcggattatataagaaatataaaaacacgtttattatgatgaaagaaataaaatagaaacctgaaaaaaatgattgggggacaggtgattaaaaaaactgtcgctggccgagtgtggtggttcatgcttgtaatctcagcactttgggaggccgaggtgggtggatggcttgaatccagaagttcgagaccagcctgggcaacatggcaaaaccctgtctctacaagatacaaaatattagctaggcatggtggcgaatgcctatagtcgcagctacctgggaggctaatgtgggagcatcacctgagctggggaggtcgaggctgcagtgagctctgattgtaccactgcactgctgcctgagtgacagagtgagactctgtctcaagaaaaatcccccaaaaccccaaaacacacacacacaaagttatataggtcagaagagttggagaataagaagtaaagtataacttggacttaattgaagttcgaaaaggggataataaaatggagaggaagaaatattagaaaaaaatgtctgtaaaatagcattttaaagaactgatgaaaaatgccaagtttttgtccagaaagctcactgaatctcaagcagaataaattaaaagaaacccatacattattgcaaaattacagaaccttaaataaaaagataactactaaaagaactcagaaaagagaaatggccttcaaaagaatgaatggcagttttactgaaaggtgacttattagtagccacagtggaatccataaagcagtggaatatcatccgacaggtgctgagagaaaataagtgtcaaactagaaatcagtgccccgcaaaactatctccctaggaaaagtgcaagctaaaacaattttagaaaaggaaaaattgagggagtttttaccactgaaagtacatactcaggcagaagaaatgaatgagatcaagaaggtatactaatgataaatataggtaaaactaaacaaacactgttattataagacattattaacaatgtcttctaagagaacagactagaactaaagtgctagaaaacaatagcatttacattggaaagaagaaattagaagagtatgttaaaaagttatatttcaaggggagggctaagagtttgactttaaatcttgtttatatatacacagcagctgtctacacacacacacacacacacacacacacacacacacacacacacagagctagtgcaactgctgaaagagtagatattgtgtgaatggcttccaaacaaatagaggtgacaaaagaattgagggaaaaaaggagaccaaataattaatatcagagaaaaaaggaggtcaaaaaaggaaacctaggcgaacaggacaaatacttaaagcatgtaaaaagatgatagaaataaatctagatactaccacgaatcacaataaatatagaagcaaaaactttgttaaaagaatataaagattgtccacttggattttctgactgtatactctttgcaaacataagaatttatcaaggttggaaataaaagaatggaaaaaggacacaagacactataataaaactggtaatattaatatcagaaaaactgggaaaacactttgctagagaaaaagatgatcattatgtaattataaaagactgaattcaccaagaagataaaatttaaaattgtagatacctaataacataaatgtctatgtctatatatatacatacacatatatacacacacatataattatttccaaattcacctacagtagaaagcattccttttgtatattttatttatacctttaattcattcctatcacattaatatactcttcttatactgtcttaattacctttcagttattagcccccttttttgagcatctcagtgtgctaggtgctgtgggggaaatataaagatcaataagatatggttctatccctaaggagtttatatctagtagactcagatgtgcagactagctcaccatgagacacaattgtgtaactgctgtgttccagtcgagcacctcattgtggaaggcaaatagtgatcagtttttcgggggagtgtattggaagtctttatagaggaggcatttgaaggacatattatataagacttgattaagtagagacaggcgttgagactggtaaaccatgtgatggtaaaattcatgacattgttgtggaaatcagaatggaaagctagtaaagtgaggagtgtagagttagtgtgggaatgttactggaaaagactggaagattggttgagagtaatgtatggaagatattgaatgccatcctaaactttttgatttattcagtggaagatgttggaagattttcagaagagaagagacattttctttatttagtttagagagattattgacaatgggaaaagtagatcagagaatgaaaatattgggagcagggagcccgttataatcatttatatgagagactgagaacagtgggagtggaaaagccctggtgattggaaaaaaggaggtatgaagatgcttaaagtcttagtgactgaaagtttactggtgtcattagctaatgtagggaacattggaagatgagctggtttgggagaaatgctaaagagcttgactattgattaatgcatgttccagttttcacatgtgaatggttgatacctcttttacatctctaaatgggatgtaaactccctgagtgtaagaactaagcatttctgttttgtatttatcatttacattttggagttcacaatggatatctgttattatatttatacttattgtcatttcttataatgtttccatgttaacctttagtgaagaaaagaactgtgggtggagatggatcccaatttcctactgtctttggtattttccttaatagacagttattgcacagtggtgaagctagactgcttgagtttaaatgtcatctctaccacttacagaatgttggacaagttgtttaacttctctgtaccccagtttctctgtgtataaattaggggtaatcacagtacctatcttattgatgtgaaatagatgtgatatgaaatgttgtgaggattaataacctgtaagttcttggaacagtgtctggcacctggcaagttttcaacagattagttgttatggctgttactattaatagttgaaattctcatccttgaattatttaatagtttatgccaagtttctctaaatcaatggtaaaacgaattgaaatttagatctatgagacaatccgtttttattgtctcgatacttctcttgggactggtattaagcaaaaaagcaaatcctttccataagggattatataggggaaattctttcaacagtggtcagtatttaggacaacaaagaaaagatacaaggagtaatttaaaaagtgattaaaaggggggtaatttggatttattttcttttaaagtttcagagttaaagattaagaacctttggtcttccagaagaaaaatgtgtcagctgctacagtcataatttactgtcccataagctttttgttccagtttgtcactttggagttgggagtacactgggaagtcaaacaaatgtctttacccataattcttccttcacagttcactgtctgttaagcatgttgataactatgcagcacctccccaggaatggtaagagggagataagagatacggaaacagaaagaagagaaactgtatgtaaaaaagtgactcttccaaccctctttttcactccagtcagtattagtcactttactttactgcttcaatgtaacactttgttccacttttcagaaaaagtctcctgaagagcttctaccagttagatagtaatcgttaaaagcagacaaaaataaatatggataggaatttttaccaatatatgggaaaatatttttctttacgggaaaatacttacatacacattactaaataccagtgtttatcattatgtaagtcattttttgtttgtttttgttgtaaaaatatgcaccatctacaaataactttaatacctgaaaactcatttcttcagcagcattactgggcattctgctaggagctataaaggctatgaaaaagaatcacataatgtcattattcttaggagtttaatgtaagataaaaagtgaagattatattttaaataataaaacaggcagtgcaattaatattgtagtgtttgagaggtctcaaaaaataacacccaaattccctgcccaaattttgagaagagagtgacagatgagatatcagaatactacctgtattcctgataaagctgttattcgaaggcatggcttgtatcagtagatagttttgctttctaataccaaaccccagagttaaacagacttccctggtcattagcagaataggaccaggaacattttccctgtttgcctggagagcctatccatggagaagcattggagaacttctgcttccatctagtgggtaggcttccaagagcaaaaaaaggggtagaattatgcttacatgattctttagtctaaacttaccagtcaggtaagtcactatcctccttctaggggataaataagtgaaagggtagagagagtccaaaaatatttagcaacagttcttcctcatagaagccataggattgagaaaaaggcattgcctctctcaacacgataatagaaaaagctatttgaaattctgacatcttttagacaacatatattttaatttttgcttgtcgcctttcttttttttttgagatggagtcctgctcttgtcgcccaggctgaagtgcaatggcactatctcggctcactgcaacctccgtctcctgggttcaaggattctcctgcctcaccctcccaagtagctgggattacaggcatgcgccaacactcccagctaatttttgtatttttagtagagacgggggttttgccatgttggccaggctggtcttgaactcttgacctcgtgatccgcccgcctcggcctcccaaagtgctgagattacaggcatgagccaccgcgccagatgtcacctttcttgtaactatagtgtctatatagttgcatggaatgtacataatttaaaaactgagcctagattctgcctttgttcatttgtttctttcttgacaaaatcaagtcacttatttctgtgcatttattgttgcacttaatattctctatcatatttgggttgataggcctttcctgtctctacattttatgtcctttaaattcagggacagtatcttatttatttatgtgaccctggtgcttggcatatatcaaatagtttattgagttggattattggattaaatactgtttttttaaatcacttcgcaggacatttttttcctagttgatacataatactcataatttcatcactgaaagtaacttgaagaacaggatgcctaaggaataagttcttgatgtcacaaaacccagcaaaaatcttcttcagcaggggaagcttacttaggtgaatgcctcagtttataggtgaagcttggaagaatgttgcaagttgggagaatggaaactaatgcaggacattgtgtgcaggagttgcctctaaaataaaggaggagcatggaatgataatttgaggtgaggtcatagtgaggcagtagggttataaacagttttgacattactttttcagatatggcttgcagagttaaaaattcctagatgtttcaatggttctcagttaacaagtgttgatagaacattttcagtgcttagactgcacttttgatttctagggagaacttcatttttaacataaatttactaattttagtagttcaccaaggaagaagatggtagtaaaatactggtcataattatttagcaaactctggaaatgtgattttttaaaaaaacttttctttaagttcaggggtacatgtgcaggtttgtaaaggtaaacttgtgtcatgggagtttgttgtacagattatttcaccacccaggtattaagcctagtacccattagttatttttcctcatcctgtccctcctcccactccggtaggccccagtgtgtgctgttcctccctacgtggtcatgtgttctcatcaagtacatttttgtcaggtaactgaagtttatctttttacaagtaatatctttttaattcaaacacatttttgctgtgactatttctattatgtttacccctatttctgcttaccctgaatagatcttgatgaaaataatatatttctctgaaaagtaaggattgtcattttaaaaattagtaaacatgtatttgacaaaattattagcaggcacagcagaagcagttcatacaatctgtttggtaaactgagtgatctcccagttctgtgttcccccaaatagttcacccacacattccataaaaggttctctttaggcagatgcaacaataccctgaaggcataattgttagctttatagtcagcattaggcaattaaaatcctccgaaattaattccagacttggctgtaaccctaagagccattctggaagacagaggatgtagagtttacgagatcttatgccctgtttataagggaggggaatatccccaaaatatttaggagagttcacacatactgaatgccactaatttcaacgacaagagcttatttctaatattccttatattattgcttctaatattctttttttttttttttgaggtggggtctcgccctgttgcccaggctggagtgcaatggcatgatctcggctcactgcaacctctgcctcccaggctcaagcgatcctcccacttcagcctctggagtagctggggctacaggcacgtgccaccattcctggctattttttttttgtattttgtagagatgaggttttgctgtgttgcccacgctggtcttgaactcctgagctctagtcatctgcccaccttggcctcccagagtgctgggattgcaggcatgagccactattcctggccccttctaatattctaatactagaatattccttatattattctttctaatatttcttatatttctaatatgccttacattagtctttagggctaataggaatagcttctgaagtgcttataatagctgcttcgggagtgtggcctttctgattaaatgctagctgatcacccttagaatataaattcttgttaaataacatatttacatttaaatagcaagaaaggagaatgtaagcatcctgaagataagaatttttgcctgttttgacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactataagtagttcaaccattgtagaagacagtgtgacgattcctcagggatctagaactagaaataccatttgacccagccatcccattactgggtatgtacccaaaggattataaatcatgctgctataaagacacatgcacacatatgtttattgtggcagtattcacaatagcaaagacttggaaccaagccaaatgtccaacaatgatagactggattaagaaaatgtggcggttaagaggaggatagtcgagatggccgaataggaacagctccggtctacagcttccagcgtgagcgacgcaaaagacggttgatttctgcatttccatctgaggtactgggttcatctcactagggagtgccagacagtgggcgtaggacagtgggtgcagcgcaccgtgcacgagccgaagcagggtgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacaagattatatcccgcacctggctcggagggtcctagcccacggagtctcactgattgctagcacagcagtctgagatcaaactgcaaggcggcagttaggctggggaaggggcgcctgccatttccgaggcttgcttaggtaaacaaagcagcaggtaagctcgaactgggtggaacccaccacggttcaaggaggcctgcctgcttctgtaggctccacctctgggggcagggcacagacaaacaaaaagacgcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcacccccaagtaggggcagactgacacttcacacggccgggtactcctctgagacaaaacttccagaggaacgatcagacagcaacattcacggttcacaaaaatccgctgttctgcagccaccgctgctgttacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccagaagtagataaaaccacaaagatggggaaaaaacagagcagaaaaactggaaactctaaaaagcagaacgcctctcctcctccaaaggaactcagctcctcactagcaatggaacaaagctggacggagaatgactttgacgagttgagagaagaaggcttcagacaatgaaactactctgagctacaggaagaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagccttaggagctgatgcgatcaactggaagaaagggtatcagtgatggaagatgaaatgaatgaactgaagcgagaagggaagtttagagaaaagagaataacaagaaacgaacaaagcctccaagaaatatgggactatgtgaaaagaccaaatctgcgtctgattggtgtacctgaaagtgacggggagaatggaaccaagttggaaaacactctgcaggatattatctaggagaacttccccaatctagcaaggtaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccatccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagcccctgcaaaatcatgccaaattgtaaagaccatcaaggctaggaagaaactgcatcaactaacgagcaaaataaccagctaacatcataatgacaggatcaaattcacacataacaatattaactttaaatgtaaatgggctaaatgctccaattaaaagacactcctcacttcaaaaaacctgtctcacgtgcagagacacacataggctcaaaataaaaggaaggaggaagatctaccaagccaatggaaaacaaaaaaaggcaggggttgcaatcctagtctctgataaaacagactttaaaccaacaaagatcaaaagagacaaagaaggccattacataagggtaaagggatcaattcaacaagaagagctaactatcctaaatatatatgcacccaatacaggagcacccagattcagaaagcaagtcctgagtaacctacaaagagacttagactcccacacaataataatgggagactttaacaccccactgtcaacattagatcaacaagacagaaagttaacaaggatacccaggaattgaactcatctctgcaccaagcggacctaatagacatctacagaactctccaccccaaatcaacagaatatacatttttttcagcaccacaccacacctattccaaaattgaccacatagttggaagtaaagctctcctcagcaaatgtaaacaagcagaaattataacaagctgtctctcagaccacagtgcaatcaaactagagctcaggattaagaatctcactcaaaaccgctcaactatatggaaactgaacaacctgctcctgaacgactactgggtaaataatgaaatgaaggcagaaataaagatgttctttgaaaccaacgagaacaaagacacaacatatcagaatctctgggacacattcaaagcagtgtgtagagggaaatttatagcagtaaatgcccacaagagaaagtaggaaagatccaaaattgacaccctaatatcacaattaaaagaactagaaaagcaagagcaaacacattcaaaagctagcagaaggcaagaaataactaaaatcagagcagaactgaaggaaatagagtcacaaaaaacacttcaaaaaatcaatgaatccaggagctggttttttgaaaggatcaagaaaattgatagaccgctaacaagactaataaagaagaaaagagagaagaatcaaatagacacaataaaaaatgataaaggggatatcaccaccaatcccacagaaatacaaactaccgtcagaggatactacaaacagctctaagcaaataaactagaaaatctagaagaaagggataaattcctcgacacatacaccctcccaagactaaaccaggaagaagttgactctctgaatagaccaataacaggctctgaaattgtggcaataatcaatagcttaccaaccaaaaagagtccaggaccagatggattcacagccgaattataccagaggtacaaggaggagctggtaccattcctcctgaaactattccaatcaatagaaaaagagggaatcctccctaactcattttatgagaccagcatcatcctgataccaaagccgggcagagacacaacaaaaaaagagaattttagaccaatatccttgatgaacattgatgcaaaaatcctcaataaaatactggcaatccgaatccagcagcacatcaaaaagcttatccaacatgatcaagtgggcttcatccctgggatgcaaggctggttcaatatccgcaaatcaataaatgtaatccagcatataaacagaaccaaagacaaaaaccacatgattatctcaatagatgcagaaaagtcctttgacaaaattcaacaacccttcatgctaaaagctctcaataaattaagtattgatgggacatatctcaaaataataagagctatctatgacagacccacagccaatatcatactgaatgggcaaaaactggaagcattccctttgaaaactggcacaagacagggatgctgtctctcaccactcctattccacatactgttggaagttctagccagggcaattaggcaggagaaggaaataaagggtattcaattaggaaaagaggaagtcaaattgtccctgtttgcagatgacatgattgtatacctagaaaaccccattgtctcagcccaaaatctccttaagctgataagcaacttcagcaaagtctcaggatacaaagtcaatgtacaaaaatcacaagcattcttatacaccaataacagacaaacagagagccaaatcatgagtgaactcccattcacaattgcttcattcacaatttgattcctggaataaaatacctaggaatccaacttacaaaggacatgaaggatctcttcaaggagaactacaaaccactgctcaatgaaataaaagaggatacaaataaatggaagaacattccatgctcatgggtaggaagaatcaatatcgtgaaaatggccatactgcccaaggtaatttatagattcaatgccatccccatcaagctaccaatgactttcttcacagaattggaaaaagctactttaaagttcatatggaatgaaaaaagagcccgcatcgccaagtcaatccaacaccaaaagaacaaagctggaggcatcacactacctgacttcaaactatactacaaggctacactaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccgttcaggacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacacacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatgacaatcattaaaaagtcaggaaaccacaggtgctggagaggatgtggagaaataggaacacttttacactgttggtgggactgtaaactagttcgaccattgtggaagacagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggatgaagaaaatatggcacatatacaccatggaatactatgcagccgtaaaaaatgaggagttcatgtcctttgtagggacatggatgaaattggaaatcatcattcccagtaaactatcgcaaggacaaaaaaccaaacaccacatattctcactcataggtgggaattgaacaatgagaacacatggacacaggaaggggaacatcacactctggggactgttgtggggtggggggagtggggagggatagcattaggagatacacctaatgctaaatgacgagttaatgagtgcagcacaccagcatggcacatgtatacacatgtaactaacctgcacattgtgcacatgtaccctaaaacttaaagtataataataataataaaattaaattaaattaaaaaaaagaaaatgtggcacacatacaccatggaatactatgcagccataaaaaaggatgagttcatggccttcgtagggacatggatgaagctggaaaccatcattctcagcaaactgtcgcaaggacaaaaaaccaaacactgcatgttctcactgataggtgggaattgaacaatgagaacacatggacacaggaaggggaacatgacacaacggggactgttgtggggttgggggagggtggagggatagcattaggagatatacctaatgctaaatgacaagttaatgggtgcagcacagcaacatggcacatatatacatatgtaacaaacttgcacgttgtgcacatgtaccctaaaacttaaagtataataataataataataataataataaaagaatttttgtctgttttgttcactgccatgtccaaaataatgcctggtaagagctcaaatagctattgaatgggtaaatatcacactgactttgctgaagtatttaaataattttcagacattataaaaagaaatacattttggccaaaagcttaattaatgcaagagtaaaaaaaaaaaaggtttgaagcatacaatcctatttcagggggctcaagagtttaaaaggaagaaagggggagacatccaggtaagaggacacgtatgctgtctttccaatattggacattatctactttttctgagacagtatcgacgctttgagcatgacacatctttttgtaacagagtcctacttaagctcaatatttaattggtacttagagccaagaaatacatgtgggcctacatttttttgcatgtattttgtgttatagcctctatacaatctaaggacacttggttctttctctcaaaatcctttcctcacttttgagtaatttacttttgaatttataaatacctcaccttattattcatcatattatttgcattatgttaaaccctggtcaacccttaaaatgttaaaggaaagacattactatattttttaatgaatacactaaacttttaagtacaaatatatttgtcatcagcctctgcaaagccatcagatgtttgaaaaaaaattttaagcatgaagcaaagagtctagttttaagaacttagctgtgaatggatgatatcctacccatttaatagagttctccaaatgaacagaaagtatacaatgaaaggaaggtcccttagacatttgaagtttttctgcagcacaatcctgtctgtctgctttattcaagaatttgtagtcattttcagaattcattccagaaaccagcttattcgtttagatatcagcacactggtcttggcaaaagataacacaaaagtaaacactactatgtcaaaaaggatgaaaagccagcgatccaaccagtagaattgttttggaagctgtttgtctcggactgagatcacacattaagccttggctgttgccttccattcttgcacaagcctccctgctcctggggaccctctgtaagagtgagcgtcctaatgaaaatagatggcacactcaaatggctaaagtagggagagtttatgaaggaatgatttataaaagagtgggaagtgttaagagaacatggtatgagtatctgatgagcaacagcagatagccgttatcacctttagacatacaagggcagaatagggagctgttaagactcagagagtagctgtatagagattcatttgaaagaagccgtggctctggtagtagaggagcatcactaaccagaggtgattttacatgagagcaggggtggaggtgggtgggagagtgggggagaataactaccccaggctcacttcctgtctttctgtcttctgctcttgtattccattggttgactccaccccaaagacagagggcaaggggggctttggatataaacaagagtctcctggggcactgaacagggtggaggagaatgaagaatggatctggaggggcaaatgaaatattcgtaacactacctttttttaaattatacttttaagttctagggtacaagtgcacaacgtgcaggtttgttacatatgtatacatgtgccatgttgggtgtgctgcacgcattaactcgtcatttacattaagtattcctcatgctatccctcccccctcccctcaccccacgacaggccccattgtgtgatgttccccaccctgtgtccaagtgttctcactatccaattcccacctatgagtgagaatatgcggtgtttggttttctgtccttgcgatagcactaccatttttttaaggacacagtatctgcagtatcggaggaaggtccttttaggaagaatcatgtaaacaaagggtagaggagtattgaaataaagagtatgttgagaaaatggaaaatatttcagatagtttggagtgtgtgcttaagaagaataggcataaaaatgaaagcataggttagtatttgtagacaaatgttaatctttatattgcatatcctcttatttattactaagtcttgtattataaatgtttttataaatacctgagaatcaatagtgccttcatcattaggtgggagatagttggtcgagttttgtgccttagcatagttatctgggtgatttacacatagcggcttagtgcaaatagtacaaagatcagaagtcatttagagagtggggctttcagttaagaatataggctctggatttgcaccatctgtgtttaatttctgactccagcactttccagcttgatgaccttaggcaagttatctaataccggctcagttttctcattttcaaaataggtacagtcataatagttttattttagagtagttgtgaggattgagtaattcacatatttagcccagagcctagcagatactgttaataaatgttacctattttttgttttttagtttaggagggtattataggtatctttgaatatttgaaaggctgccccatgaaatagggattaaacttgtcttcatgagaacctccagtatcagaatcaggagtaatgtgtataagtaacaggcaaacagatttgggattaatacgagaaaatcttttaatagttatagagttgcttgaattagaataggttagctcatgagataatgatttacataccaagggaagttttcaggaaaacatcaaggggatgttttaaagtattaatgtctcaaaatgagaaaattagataaaagctttaggatatcttccaaccataatagtctattactttatcctaaaaaatttgtgaaaatcaaattttacgtaagaggaaatgtgtttgatttccttttccacatctctgtctgttcctgttgacaatttctgttcctaactaccttccaacaatccagcttacatgtcatctatctttgtttaatgatacgtataatttttttttttttcaagagacagagtctcaccatgttccccagactgggcgcaaactcctgggtaggtaatactcttgcatcagtctcctgagcagttggtactacaagtgcacaccaccatgcccagcatatttaacaatatttattgagcacatacaaatgtgccaggtattgcgctggatactgtgattagtacagtgaacaagacacatcagtctcctgccctaatggagctttaagaaattttagcagagggaaatagaaagtaaaaacacagtgaaataaatttcaggtagttttaagtactgtgatgcatgaagaaaataaaacagaataatagtataaagggatactagggctttggatggtggaggtgaagatggtgctttaggtatggtaggaagggaaagcctctctgaagaggtgacattttaaccagcatataaatgttgagaaggagctggttgtgctgagggaagcacactctaggcagaagaaccagcaaaggccctgtggtgggaaagatcttgacatgcttgttagaaagcaaactgggtggctagagagtggtgggagtggtaagaacagtgtggatcacataaggccttatacaccttgttaacatttacatttcactccaattgcattctaatggcaagtcatgagacaattttatggtataatttatgtttaaaaaagattattcttgcttgtttatgggctattgacggaatagctagagtggaagcaggaagataggaggctgttggagttatccaagtgagacataatagtgacttggactatctcagatgactttctcccccatttatccctggatagaatgtcctttaaaaaatattttataggccaggcatggtggctcatccctgtaatcctagctctttgggaggccgagatgggaggattgcatgaggccaggagtttgagaccagtttgggcaacatagcaagactctgtttttacaaataattaaaaaattagccaggcatggtagtgtgtgcctgtgttcctagctacttagggggctgaggtgggaggctaggaatttgaggctgcagtgagctgtgattgtggtactgtactccagcctgggtgacagagtgagaccttgtcttgaaaaaaaaaaaatatatatatatatatacatatatatatgtatatatatattttatagtgtttaccagatactagtgttaaagtatctttatattatattttaattaggtatacaattggctttctcattagattctgagtttcttaagcacaaggacaatgtcttatcccttttcttattattttaggtagcattatagcactgttattaattttgcacttaatgcattgctattaagtgaattcatgaaacttctatctgaacacagggctttttatagctattacaaatggcacagttaaatacgtaagtgcaataaggtaagctagatttgagatggaattaaaaaaatactttcccatactttacacacagaatgtagtttgtatacagtttaggaaaacctactaagaagggaaaatcacaatgttttattaggggtgaaacacaaatcagaaaggcttagggaaataaaaccaagaactagttttgttggtctatttgttatgataaaggctaaactaatgttaacaagagacaaatatagtggctcaagtaagaaagaagtttatttatcatataacaacaggtcacacattcaggctgctgggtctttcacgggctccttcctttatgttgctctgccacctcttagggtcttgtcttaatctgcacggtcaagctaggacattgtcacacttatcttccagtcagtggggaaggggaaagagagagtccacagagtccagataaataattttattttaaacaagtgaggtgaaagttgcatgtatcatcttgctcatattccactggtacttagtcatatggtcttactcagctactagagagatggagaaatgtagtttttagctggggagtcatagcaaaaactttactttttttttttttttgaaatttaaagaaaaaatctattgaagatctgaaaaacaattcctaaaagatagacttttccagaaaacactagctacacaatgtattgtgtctatcatgttaaaacatgcattagacacaaatacaaaaaccatgaaacaagccaccattcttcaacaatttgagcaaagataaaatgcctaagtaacaacatggatgacttgcaaaggatgggctctttactttaagcaccataaaaaaaaaaagcacaaatggatgagtgtgttcagttatatacactgaattgaacctttggcactaggaatcagagtattttgtcatatagcattaacatgtattataaaagtgcgtagtgtcaaaggaatagaaccaccaacattcaaaagcagctttgtcaactaggcagtaaaacactctacagcatatcctctgttgtccatcattgaatacactggtagtgactttgaaattaaaaaaaaaaagaaaaaggatctattaccccttttattttctttgtttaaaacaaaacagaaaaaaacatcagttgttacacactaacatcttcaaagcacatcgtttgtacaagagatagactaagaacaaaaatgtgtttacagagatccaaacataagtgagtgagagcgcctctcacatggctctcaggacggttctcaggaggagccacttcataatctctggcactaaacaaagttgtagaattctttgccaggtacttcaggaaatcatgaagataattcagtaattaagcaaggctcttctcatccagaggtgtataggccaacattgctccaattcgtacaagtaatctcaggagatgtggcactccatacacctgggacatgggtgccttggggtgatctgcaagaatttcggcatactgtggtctctcaaatttgtagagtagttgggtgcccaacattacgttgaagtattcttttatccctgccacaacttcattaaccgcatactccttattatctgtgtttccaccagatttcttgtaatttgcgtaatcctcaagaatggaatccacatttcttcttggcaggaagttaaaagagctgttttcgtctggtaattaagtcccagtcatcaacaagccacagttttagctcttcaggaagctttactttaacttcaactctgttcatgaatgtttcctcattttcaacagtaggatctacccgggtccttttcttccgaggaggccaaggagtctcactggtactgccaccatctccatttccaggggttttctgtttgttcttttttgttttcacttcaacatttttctgttggagaccagatgtcttctttcctggggcagcccctatcgtcttcccctctgcatactgctcctgattggctttttgaagttcttattctttctgcaaattagtgtccttgtatttgagtactctgctctctggaacccactcatcccaatttttattccaaccactgtaatgtataaagtatttcacttgtttgtccttaatggcaacctttacacactttgtttcatgaagaagaggcccatgaaagcacagcactcactcaacctcctggaatttaggctttgggtcctgttttgaagccatttataagtgatttgctgtctcctccttctcctaccacccccaactaaaactttactaactttgattttcagctaacaatcttctaaagttgctgttatttgaactacttaaagtgaatatgagggtaacaactaattaatttctgcttcttaccctcataggaaaaatattgaacttctatgtagcacttacacttagggagagacatcttgatcctgattgcaactgggatggaaaactgattttattactattctaagaaaagtttttatttgtatttttattaaaaatgaagttatgttcaaatgaaagagagtatgtatgagtcttgaaaattgttactttaggtaaggcaggactactaatttttttattatttttataaagaaacaactcttgctcaccaaagggcttgtagaaatggtgggctggttgccctcatggcaggtataaaggatacggatgtataatatttctattaaggcagtttgggataagggattacttattgcttttaatgtatatcttccttgttatcacatattaggttgatataattcttcatcaggtagaactgaagttctcagagttggagttgaggatgaaaagctgctttagaaccttttaggccttaagtcagtgtttctgttttcaggactgtctcctaaagagaggtaacttttttttctgttggatggtaaattatcacctatttctctatttcttaagagcagacataatctttggggtcgttcctttataatcttgattcagtattttttctttcttatcaatattgttattcattttattttttgcttatttaaaaaaaattcagataatttacatataataaaatgcatgggcctaaatgttgagttgaagttttgatggttatatacacttatgtaatcatgaaccaaaacaagatacagaatctttccttgaacttctttccggtctgttccatccagctcctcagagacagccacttactgatttctattgccatgtatttgttttaactgttttttaacctctttaaataaaattatacagtatgcattcttttgtgttgagcatctttcacttcatatactgtcctgtaatgcattcatattgttttgtatatcagtcgtgaatatattcaatgaatatgttccctgaatgaatatattttatgaatacatcacaatttatttattattctgtcacaatttgtttatacattcttatgttgatgaatatttaggtttccagtttttgccttatgaattaggctgctctgagcattcttgtgcaagtcttttttgtggagacatgtattcatttctgttgggtaaatacctaagagtgaaattaagtcagagtagatgtgtatttaacattaaaagaaactgacatacactttttcaaagtggttgtaccatttacactcctaccagcaatatatgagagttccagttgccctacatcctcactaacatttgatgttgccattcttttattttagccatatagtacctgtgatgttgaatgcctttttatgttcttattgaccatttatgtatcttcttttgtgaaatgttcaagtcttttgctaattttaaaattggattgttcattttcaaaaaattactggtttgtagttgttttagacagtcatgcgttgcttaacagtgaggatatgttctgagaaatgtgttaggtgatttcgtcattgtgcaaacatcacagagtacttacacaaacctagatgttacagcctactccacacctaggctatatgttatagcctattgcttctaagatacaaacctgtacagcatgttactgtactgaatgctgtaggcagttgtaacacaatgctaagtatttgtatatctaagcatatttaaacatagaaaaagtacggtaaaaatatgtacacctgtatagggcacttaccatgaatggagcttgcaggactggaaattgcatttggtaagtcagtgagtgagaggtgagtgaatggaaggtctaggacattactgtacactattatggactttataaacactgaacacttaggctttttagttttccaattactttataaaaaagtaaccgcgtcacaatgtcatgacagctgcaactgaaagttcattatgtggcatgtcactatattatggatgtgagtcctttgccatatgtatgtgttatgaatattttctctcaatctgttgcttacctcttcattttccaaatgtctttggataagcagacattttaattttgtttaagtctaatgcactaatttttttcctttacatttagtgctttttttataccttaagaaatttttgcttaagcatctctaaggtactctgttttcttctagaagttttatggtgtatgatctaacttgaagtaattttttgggtatgaggtaaggtagggggtcaaagtttgctttttccatgtagataaccagttgttccagcactgttttgttgaaaagacttgacacccttgtctaaaataaattggtagtatatttgttggcttacatataggaagctagccttagtttttaattttttttctgatttaaattctaaaaaaaatgaaaaccagggatagaacctataatgggtaagatggcacttatcttgttgtattttagagttttctggtggtgtcattttcagaatacattttgtgttcctcagaataaaggaaatgaagcttatttcttttattctcaagccaaatcactctctgaggattgaggaagtaatccagggtttgatatggggctcatggcataaggttaggtagcctgttatctttaactttctagattacttcataaaaataacttgcgtatatgtaatgatatctttctatgttttagatgttgttcaaagcactgaattgtaaacatattctcaatatttccctcgaatcttaagtatttaccttttattttttttaatttaaaataaaaaattaacagagtaaaatagatgttttttggtgtatggttctatgaattttaccatgagtatagattttgtatatccactacaacattcaggacatagagttgtcccattacttccagaagttcccttgtgctttctatccctttgtagttatatcttccttctatccctaatccctggtaactactagtctcttttccttcactgtagttttatcttcttgatgtcataagtgaaatcacacagcatgtaaccttttgagactggctacttttatttagcataatgcctttgagattcatccgagttgttgcatgaaccagtttatattttattgttaagtagtagtccattgattggatgtacctgtttatccattcattcatcctttttatttggggggacagagttttggtctgttgcccaggcttgagtgagtgcggtgacacgatctcggctcactgcaacctccgcctcccaggttcaagtgattctcatgccacagcctccggagtagctgggattacaggcatgcaccaccacgcctggctgatttttgtatttttagtagagatggggctttgccatgttggctaggctggttttgaactggcctcaagttattcacttgtcttagcctcccggactgctgggattataggcatgagccactgcacctggcctatccattcattctttgaagaatatttaggttttttttttctagttgtgttgattaggaatagaactgctgtaaacattcacgtacaagtttttgtgtgaacattagtttttattcctctagtgtaatacctgagagtgggattgctgggtcatttgttaagtgtatgtttaactttataagaaattgccactgttttccagagtgtttatgccattttgcagttttactggcagtgtatgaaaattctagtagttccacatcctgaccagcacttggtattgttagtatttttaatttttgtcattctaggtgtgtagtggtattgcatcatgatttaaatttgcatttcgttaatgggtaatgattttgagcatctgttttttatgggtttatttacattatatatcatctttggttaagtggatataagtcttttgttggatttgtgatttgcaaatattttcttccagtttgtagcttgtttcttcattctatgaacaatgtctttcagagaaccgaagattttaattgtaatgaagttcagtttttcaattttttgttttataagttcttttgatgtaatatttaagaactttttaaccacaggacatgtatattttttcttatgttttcttataaatcttataaaaatttagtagctttatgttttaccttaagacctgtgatgcattttgagttgatttttgtataaagtgttaagtttaggtttattttctcctacatacagaatttccaattctaacatcatttgttgtgtactctcctttgtttatcgaatggctttggcacctttgtcaagaattaatttgctatatttatgcagatttatttccgggttattgattctgtcacattgatcaatgtgtcattccctctgccaataccacactgtcttgattactagaaaattgtgtagtgtgaatcttcttatcttttttttttcaatattgtttgacctttgcagaaacattttagaatcagcttgtttatatctatgaaaaatttggctgggatttccattataatcacattaaattagtagaatcaatttgggtagaattgacattttttaggctcttgagcccctatgtgtgggcccactcccactctgtggagtgtactttcattttcaataaatctccacctttgttgcttcattcttttcttgctttgtttgtgcattttgtccaattctttgttcaagacaccaagaacctagacgccctccaccggtaacatattttggcaagccagccaggatgtaaaataagtttgggatttatttttttccttttcctttctgctccacgcagtggaatctcttcttcactcgggacccttggtgggcagcgcctaaacacagaggcaactgcagatttctggctgggatcactctgaaggactctcttctgtcttttctgcttgtggttcctgatccctacatgtggagcagctcagggcgaactcacatgtgtttcaggcaacttaaatcttcttttcttacactaaatttttcccttactctactcgactggctaaggacaaaagaaacccacctagcctccagttcctatcactacagttcacggaatggagcaaagtccactttgctccatcactctagtggaacaggaagcatgctgttccactagagtgggaccaaatgctcctcctttgctccatcactgtagtggaccaggaagcatgggaaaagatggccttatcaaattttaaggattctgaaagtcagggattatacctaggaaccaaagggaagctcatagtagtaggccattgcctctggagggaaaacatgcaaagcggcactggtgcccacgtaacgtcagagacgtctgatactcttaagactggaccccaaagagggatgccccaggggatcctttggacctcaacctctctgaagggaacacccttggcagaggtcctaaggcctagtactaagccctccttagaattttatctcacagttgcaatactgtttggccccagtattgtttggaatcaagtgtgttgttgaatgggaaagtgagatggagttgcatgtatccaggctttgatgctgctgttccaagcagggtcaggcctggttatatgtgatgttctcctttggtgctgtttggccccagtgttctttggagtctggggaggtttgacctttacaaattaaactgccatggaaactgctttacctgaaattttggttcactgccttcattggattaactactggggcaaacaaaagtagaaccggcaagtttgtattgctgtctcatggctagagttccaaggtaaaagctattgaatcttcatttgtatgtgtatatacatgtctagatgtgtttatttgtatgtacacttattgttatacattctgtctacaaaactgacatacacgtaaaagagtactcataaataagtctaagtacttttcaagttcatgtgacttaagtataactttactaaacaagctggttttaaaatgattggtaaaataaaaatagaaatgacttcaaaaaaaaaaaaggaatggacattttttactgttgagtcttccaatccatggacatgatatatctctttatttacttaggtcttctttgattttattcatcagtgtttcgtaatttttagcatataaaccctgttgactttttgtttgatttacatgtaagtacagatcctcctcaacttatgatgatggggttatgtatccagataaacccatcgtaagttgaaaatattgtaagccaaaaacatatttttggcttacagtattctcaccagtcaaaaccagactttcaatttatggtattttcaccagtgaaaagcacacttttgacttaatattttcaaaccagtgaaaagcacatttttgacttaatatttttatcagttgaaagcacactttcaaattgtgatattttcaacttatagtgcatttatctagacataacctcattgtaagtcgaggagcatactgaatgtatattgcttttgtaccactgtgatacggtttggctgtgttcccacccaaatctcatcttgaatggtggctcccacaattcccatgtgtcattacttccagtgggaagtaattgaattgtgggggagggtctttcctgtgctgttctcgtgatagtgaataagtctcatgagatctgatggttttgtaagggagagtttccctgtacaaattctctcttgccatgagtgtgaggacttccctgccatgtggaactgtgagtcaattaaacctctttcctttataaattacccagtctcaggtatgtctttattagcagcgtgagaacagactaatatacattgtaaagctgaaaaattgtaagttgtaccatcataggttgaggactgtctgtatttatttcttagagctgttgtaaatggtatttaacaagaattggtttccagttgctctttgctagtatatagaaatacaattgagttttgtgtgttggctttgtattctgtgatgttgctgaattcacttattagttctagaagcatttttcatagagttcttgagatttttctatgtacagttgacccttgaataatgcagcaaggtggaagttaggggtgctgacccctgaagcagttgaaaatctacaaataacttttgactcccccaaacctaactactgatagcctgctgttgactggaagccttaccatcaacataaacagtcaattagcacatatttttatgttatatatgttatatactatattcttacaataaagtaagctagagaaaagaaaatgttattaagagaatcacaaggaagagaaaatatgtttactgtttaattcatggaagtggattatcataaaggtcttcatcctcactgtcttcacattgagtaggttggggaggcggaggaagaggaacagttagtctgtctcaggggtggcagaggcagaggaaaatccacatataagtggacctgtgcagttcaaacctgtgttcaagggtcgactgtaaatgataacgttgtctgtcaataggacagtttgatttctttctttctaatctgtatactttttatttgttattttcctgctttattgtactggctaggacttccagtaccatgatgaataagagagatgtgatattatattttttccttggttccaatctaggaaaccattaaatatgatgttggctgtagttttgtttaaatgccctttattatgttggggaggttcctttcagttcttagtttgctgagagtttttatcatgaatgaatgttgaatgctgtcaaatgcctttttttgcatcaatatgatcatgtgggtttgtttttaaactgttaatatgatggattatattggtcaatttaaaaaatattgaacagctttgcattcctagtataaatcccacttgattgtgatatattcttatacattgctggatttgatttgttgatattttattaaggatttttgttgttgctatgttcatgagggacataggcctgtagttttttgttgttttttttttaataccttttttggtattggggtaatggtgactctcaaaacgaattgggaagttttccctcctctattttcagaaatgagtgtatagacctggttttatttcttcttttttaaatatttttcttttattgatacatagtattgattttttttttttttgagacggagtttggctcttgttgtccaggctggagtgcaatggcatgatctcagctcaccacaacctccgcctcccaggttcaagtgattctcctgcctcagcctcccaagtagctgggattacaggcatgcgccacaacgcctggctaatttttttctgtttttagtagagacagggtttctccatgttgatcaggctggtcttgaactcctgacctcaggtgatccgcctgccttggcctcccagagtgctgggattacaggcgtgagccaccgtgcctggcctgatttttttcttttaatgttgggttgaatttgctagtgaaaccatctgggtctcaattttttttttctttttgtttttttggaaagctttaaactatgtgttgaacttatttaatagttatagaattactcagaatatctatctcatcattggtgagctttggtagtttgaatttttcaagtaatcgattcatttcatctaagttactgaatttatgtgtaaagtgttatttgtagtgttattttattatccttttaatatctatggagtctataatgatattcctcttttattcttgttattggtaatttatgtctatctttttttctttatcagttttgtttgaggtttataaatttttaaatcttttcaaagaacaagatttggtttcattaattttctctattatttttctgttatcactcttattgatggggagctgatcattatttcttttttttctgcttgctttaggtttattttgttcttcttttcctaatttgttaagataaaagcttagatgattgattttagagttttattcttttctaatataagcattagcttctttgagtttccctctaagcactatgctagctgtgtgccataaattttgatacattgcattttagtttttatttggttcagactatcttctaatttctcattaaacttcctctttgaatgctggcttatttagaagttatttaatttctagtgtttggagtatttctgccatctttttgttacctatttctggttcaatttcattatgatcagagaacatactttgtatgatttcaattctctgcatatatttgatgtctagatatgagattttatctgtggtacttatcctggatagatttactaggttgtagattatgtcagtcttcagttttgctagaaaatgccaaattgtttttcaaagtttgaaagtatcaggggaacccaccccccgtatttcaacgtaggttctttatattttctgtaagtgtcggccagttgagaaataaagagaaagtacaaagagaggaattttacagctgggcctctggggatgacatcacgtatcggtaggaccatgatgcctacctgagccttaaagccagcaggttgtattaagatttcaaaaggagagggggtacaagaacagggagtaggtcacaagatcacatgcttcaaagggcaaaaaggagaacaaagatcacatgcttctgaggaaacagtacaagggcaaattcagaactactgattagggtctttgttcagctgtgcacgtattatcttgataaacatcttaaacaacagaaaacagggttgaagagcagagaactggtctgacctcaaattcaccagggtggggtttttccccaccctagtaagcctgagggtactgtagggaaccagggcatatttcagtccttatctcaaccgcataagacacttgcagagcagcgtttatagacctccccccagggatgcattcctttcccagagtcttcattattaatattccttgctaggaaaataatttagtgatatcttccctacttgcacatctgtttataggctctctgcaggaagaaaaatatggctctattctgcctgaacttgcaggcagtcagaccttatggttgtcttcccatgttccctaaaattgctgttactctgtttttttttcaaggtgcactgatttcatactgttcaaacacacatgttttataatcaatttgtacagttaacacaatagtggtcctgaggtgacgtacatcctcagcttacgaagatgacaggattaagagattaaagtaagacaggcataagaaattataaaagtattaattttgggaactgataaatgtccatattaaaatgaaatcttcacaatttatgttcagagattgcagtaaagacaggcgtaagaaattataaaagtattaattttgggaactgatatatgtccatattaaaatgaaatcttcacaatttatgttcctctgccgcagctccagccggtccctccgttcagtgtccctgacttcccgcaacatgaaagtagttgtacgaatctattgcaccactccccctgccccagaatgggatatgaatgttctatatcctccctaaacctactatgtatttgatttattcattattctagtcttggaagacaattaatcactaagggaacatttttctcatctttttttttttttttttttttttttttaagacagagtcttgctctgttacctgggctggagtgcagtggcacaatctcggctccctgaaacctccatctcctgggttcaagtgctttttctccctcagcttcccaagtagctgggattacagacgtgcaccaccatgcctggctaatttttgtatttttagtagagacagggtttcaccatgttggctaggctggtcttgaactcctgacctcaggtgatccacgcgccttgacctcccaaagtgctaggattacaggcatgagccactgcacctggcctcatctttcgtgagttaagttttatatcatccttgataatttagggtatcacagtaagcatactgaagttgaaaactcaagtaggttttggttatcattccaaacgacttgaagtttctcattggtcatggagttttggctgtgaaacaggacctggggctgcctctagccagagtgattctacctatgccacaggtggacaggtaagcccttttatggttgctgaaataagtccatatcctagagatgagattagattttcaccaatatctacttccagtcttcatgctttaaatgttgaagttcttcagttttgtacaggtaaaagaaattcttcacctaattctaagtttttacctaacttcttcaaccagtcttttcattgcctgatggaattctgcctgggttttaaattcttttaaatttaaaaatttttttacgttcttcctatctgacaaagacacaagtcttccattcgaattctacaaatctcttatacctttatctgagtctatattttcaacccttatgtgctaatgacaaatatttaattccatccttaaaggatagttgattgtgggcatctactgtatttcataacctttgtaatacaagttatataatttttagtgcttaaactatactttaaagaaaataataacagtgattagtagaacttagccttgaattaatttgagactgttgaaatagtggtgaacttttaagacgcagaggaaagtttttcctttggggataagttattttaacctgagacattttaaatgacaggaaaacatctagctttctttttttatgagtgattaaaatttaaagaggaaagtaaagactgaattggctttatacttactttaaattttaaattaccttaccatctatttaacttaaaaataagccacttttattattcagttaacaaactgaatatcattctttgtttttatttttattttttttaaagacagagtctcgctgtgtcgcccaagctggagtgcagtggcatgatcttagctcactgcaagctctgcctcctgggttcatgccattctcctgtctcagcatccctagtagctgggactacaggcgcccgccaccatggctggctaattttttgtatttttattagagacggtgtttcaccgtgttagccaggatggtctggatctcctgaccttgtgatccacctgcctcggccttccaaagtgctgggattacaggcgtgagccaccacgcctggccattcttttattaaaatattttttatagtaaaaatgcaggtgtattatgttatatttattcgttttggtaatatggttttattaaacttgacgaaaatgccttccaactatccatgtgttactcagaggtatgagaatgaattagccgaacaatttgaacaaaagttaagataatagacatttagaatgcttcttgctagaatgaagttctgatttgtgaagaatattactttatcaggtagggaagatatataaaggcagaaaaattattaaattgtgacttcctaaatgtctacttaaaaacatttatggtaaatttataatgttatattgaattgatttgaattatttgaatcttaaaatatagtgtgggagcttttttctaaagtatatattattaaaagctgagaaatatttaagtggttgaaagccagtgggaaatatgaagcaaactgctaatgcaactggggagacaatagaactatgtttatttaatattaagcattaaacttatgaagattttactggaaatttgattggtttttctgtcacccaagggtattttaagcctgttttatgcattatacctgggctgtaccaagagcagatggcaagttcccaggggaactttccaactgacccataatttgagataagatgatagtttacagagctacaaaaatagtcttggggtttgccactgtttttgttttagttgcctatcagatcttttgtcaccttttctctcacagatcatatggatgacatacagttctgtttatttgtcaatatctaattgattagcataaagttataagattataattcaagaggtgaaatggatgctaattggaactcctattaggaatttgctcatcaacatacaatttctttttttgaataatcaaaatatatacttttcattatatagattcagaaaggttctgaaaacataggagatattttcttttaaagctgcactcagaattttatttctgtgatactcaggtgaaagtatgtagtttcccttttcatttaattttattaaaattgaattaaaattttctttctttttctttctttctttctctctctctctctttctctctctctctctctctctctctctctccctccctccctccatccctctctctctctctccctctccccctctccctcttctctctctcggagagaacatgagtattttcaggaaattagagatttgaatttgaaatattttttgtatatcaagaaatccatcaatctttgtttaactatggaatcttcagaacatcagagttgcatgtttttaagcttagagaaaaatggacacactgaatcttagcaactgaaagcaaatagacatacgtcagtatctgtgtatagtgctgacacttatgtcagcactttatcctatttgcttgggaactcttgtttagtagtgtgtttacaatgaggcctttcagtggagagggctacatgactgaatgtgtgtgtactctgtattgtctgagtacattctatgtgtaaactttaagatatgtttatagacatatttgttattgacatttagtcttgtatttattttatttctcagaagtattttatttgttcatttttgataactagcactcagccattcactttttatttctaattttggtgtctttgtgtaggtcactgagtgtgattccagataagttattacagctagatctatgtggctcatcagccacatatttggtttttttgttgttgttgttgtttgtttgttttgagacagtcttctctgtcacctaggctgcagtgcagtggcatgatcttggctcactgcaacctctgcctcctgggttcacgcgattcttctgccttagcctccccagtagctgagattataggtgcccaccaccatgcctggctaatttttgtatttttagtagaggtgaagtttcgccatgctggccaggctggtctcgaactcctgacctcaggtgatccaccatcctcggcctcccaaagtgctgggattacaggcctgagccactgtatgcgtcccacatatttgttttagagagggaagttcgtgcaattaaaggtggaataatctggatttgtcataagtcctatgatttcattgtgctttagttttctgaacagatacgatgaaaattatctactaagagtttaaaatatatcgctgagggttaaaataaagttcaaagtactcccaagtattatgggaatttgtctgtttcttgggaagcagggtagacgttatctaggtggaaaagacgagtgggcaatttgaaatgttagactaggagcttggaaagagagaataaggctagagttatactctagaagttactcagtatattttattgaaggcctaatatatgtcctttaagattgaagccctggaattcatgcagaccacaagactagcatctcctttgcttgtggaattgatagtctagttactagattctagagggaggattatttgctttgaaggtcataggtgaagcttgggaatggatgagactgaaaaaaaagagtgtagatatgattaaaacaattaaggacacagtgactttgggaaatacattatgtaggtttttaggagaaagacaaggactgtgggggaagtacctatgtttggtgattggcatgatgaagagtcagtgaagaaaagaggttcagagtgtcagggatttgggggatttatcattaagctaattaaatttaagctccaggtttgtcacttacataaaatcctttcaagtctgtaggaggaaggttttcacatgggcatatgtttctgtaggatttccaaaagtaaggcatttcaatattgccatttctttcattctgacttaccctcatgtcatatggcattagagtggctgcaggcatttttgggatccagctaaggggaagttgaataggatttacatttagtttgggaggcatgtatttatgtggtcatgtcacttctgaatatagactagctgttctggtataggaaggatatcaaggaatactggtgttactcactgtgttaacacttagtgttatgacacaaagatggaaggctagagatcacctggtgatatggacgtgtcctataatgcatcacattagaagtacgtggtaggataagagaaacaaaatttgaaatacacggggccagaagctagtctgggaaaaattcttccaaatcgaatggtttataaatgaaagaaaatatatgagtttctctaaatttgacaatactaaaagtttatgacattaccagtagtagtttgtgaacagtttgtgaagactattttgtaaaatataaataacaatttagtcttttgaaaattaaaaagatatttatagaaaaccttacatataattgccatatgaagaggtgataacaaaagttatgcaaaaaatatgtagaagtatactagaagtgtgtcagggagtttattgataacattattgttattttttctggattcttgtgatgtttatgatgctgtgacttttttttctcattctcagtaagtattcacctttgtatctaattttgtatttgtaattttgcttccttttttttttttttttaaagaaggccccctaaattctagaaggttcaggcccaacaatacctgggaggcacagaatcatggaagttaagaggagacaaatcacggatggagaatatgtactcttttaaatgatgcattggggtagctaaggaaggcagttgcatttggcaattcagggattattgataatcttcactaatgagtatgaatttgggagtgggaagtggaggttgtgtactttttaaagaaagtggcagtagagtccaagaacagtagcttttgaggaaagcaaggtccagggaagtttttttgtatgtgtgcatgcttcaaaggtaggtggacatctaaatacgttaaaggaagggaaaacatgcaaatagcacagaaggaaaaattaaaggcaatagcaagagaggttaaagcagtgtagaaatagtgacgagagcagggaggaaaaaggaaatgaggtcaagacataggagtgttctaaatagtagaattcagtaaaggtgatttaattgttactgtattagcactgtgctagtgctgagtgcaataattgattttcataatgctgtaatttttctgcaaatcaacattttatgcttagttcattaagatttattatacaatttataaagacttacaatcacataatttataaagattttcatttggatgtttaaaatgaaatgtttcatgacatagttggaagataattatcttaattatctaattagttgaatatgttaaaattaatcttccagaattttttgacttattaagtgattgccccaaatcagcttagagatattatcaagtattttgctagtaagttatgtaaactaattaatagaaaatacatgaaataatcttattttctcttagttttatagatggtatggaaaaaggtacagaattgtcaggtaggatatttattattattttttccatttaactcatcaaaatgtattgaatgtttattatatgccaggagcaggtctaggtgctggagatagagcagtgaacaacacaaaatttctgccttcatggaatttacattttagtggaagagacagaatataagcaaataagcatgtacgtatatattgtcagatagtaatgtgtgttacaaagaaaaataagggagagtaaggcgacagagagttgtataggatgatatttcagatagtgtggtaaggaaagccaggtaggacacttatatgttgctttttgtcagtgtatttagaaaactattttatgcaagtcaaattgtgtttactaagatcaaatcatttacaatttaataggagcaacatctgcttacctgagttttcccttctgaaattattgatttataatagtaccaggctaggtgtggtggctcatgcctgtaatcccagtactttgggaggctgaggtgggagaattgcttgggtgcaggagtttgagaccagcctgggcaagatgctgagacccccatctctacaaaaataaataattaaaaatcagccaggcatggtggcatgtatctgtagtcccaactacttgagaggctgaggcaggaggatcctttgagcccaggaatttgaggctgcagtaagctatgaccatgccattgcactccagcctgggtgacaaagcaagaccctatctctaaaaatgatatatataataataatagtatctacaccataggtttgttgcatggtttaaataagattttgtatgactgttttggtgcagtgctcttactcttcactttatatgaagtatgcctgtaaaagggaataaaacttagtatgtttcgcagatactgtgtttttcacaaattggaggtttgtggcagcgctgtgttgagcaagtctgttggcaccatttttcttacagcatatgctcactttgtatcttcgtatcacattttggtaattcttgcgaaaaatttttaattttttattagtatatctattatgactatttgtgatcagcgatctttgatgttactactgtaattgttttggggcaacacgaatcactgcacccagagaagagagctaacttaattgataaatgtgtgggttctgactgctctaccagctggctcttcccctatctttctcccctgtccttggacctccctattccctgagacactgcaataatgaaaatgggccgattaataatcctacagtggcctctcagtgctcaagagaaagcaatagttgcacatttcttaccttaaatagaaagccagaatgattggaccttagtgaggaaggcatgtggaaagctgacatacaccaaaatgctaggcttcttgagccaaacagttagtcaagctgtgaatgcaaaggaaaagttcttgaaggaaattaaaagcgcttctccagtgaacacaaaaatggaagtgaccagctttactgctgatacggagaagttcgagtggtctggatagaaaatcaaaccagtcagaacatttccttaaaccaaagcctatcccagatccaggccctaactctcttcaattctgtgaaggctgagagaagtaaggaagctgcaggagaaaagtttgaagctagcggaggttagttcatgaggttttagcaactatctccataacataaaagtgcaaggtgaagcagcaagtgctgatggagaagctgcagcaagttatctagaacatctagctaaggtaagtggaaggtggctgcactaaacaacagattttcaacgtaggtaaatcagccttctattggaagaagatgctaggactttctagctagagagaagaggtcaatgcctggtttcaaagctttgaagcctaggctgactgtcttgttagagactaatgcagctgataactttaagttgatgccagtgctcatttcccattctgaaaatcctagggcccttaagaattatggtaaatctactctacttgagccctgtaagcagaacaacaaagcctagatgacagcacatctgttggtagcatagtttactgaatattttaagtccactgttgagatctactgctcaaaaaaatatattcctttcaaaatattactgctcattgacagtgcagctagtcgtcgtccaagagctctgatggagatgtacaaggagataaatgttgttttcatgcctgcaaacataacatccattctgcagcccatggatcaaggagtaattttgactttcaaatcttattatttcagaattacatcttataaggctatagctgccatagattgatggatgtgtgcaaagtaattgaaaaacctggaaaggattgaccattctagatgcccttaagaacatttgtgattcatgggaggagatcagaatattgacattaacaggaatttggaagaagttgattccagccctcatgagtgactttgaggggttcaagatgttagtggaggaagtaactgcagatgtgatggaaatagcaagggaataaatagagcctgaagatgtgactgaattacttcagtgtcatgaaaaaacttgaacatatgagtagttactttttatggatgagcaaagaaagtggattcttgagatggaatctacttctgataaagatgctgtgaacattgttgaaatgacaacaatgggtttacataaacttagtggataaagcagtggcagcatttgagaaaattgactccaattttaaaagaagttctagtatggataaaatgaagcattggatgctccagagaagttcttcccgaaaggaagagtcaattgatgtggcacacttcactgttgtcttgttttaagaaattgccacaggccaccctgccttcagcaaccaccaccctgataagtcagcagccatcagtattgaggcaagacctcccaccagcaaaagaactacagtttgctgaaggcttagatgatcattaacattttttagcaatagagtatttttagattaaggtatgtacattgttctttaagacataatgctacttagcactttactacagtatagtgtaaatatacttacagtatagtgtaaatatactttttatgcactgggaaaccaaaaaattcatgtgacatgctttattctgatactcactttatttcagtggtccagaaccacatttacagtatctccaaggtatgcttgcatttcttgtctgcttttatgtgaaccaaataagttataatcctctattaaatacctttcttttctgtagatacctccaaattacagaatgaagcttctgtgttttttcaacttggagattaaataatggttttaaattgaggcacatgcatatactgtaaggtatattagtctcagatatactactcagtgaatattttcttagatacatacctatatagtcgccacacagatccaagtatgccgtattcccagcacaccagaagaaatctttgttcaccctttgagtcattactaccttctgtaggtatccactgttctgacttccatttccatcaatttgttttctcgtttttcaatttcatatttctgacttctatttccatttctattttatgaaaattcaaaaaaggcaaaacaattttatttatttatggtttgttatcttttttatctggcttcatttgctgaaaacaactcctacaaaattcatccacattgttacgttatcaccagtttgttgggtttcagttctgtgtagtgttccatagtttgaatggaccacaatttatttattcattttctagtttatggacgtttggattatttttattttgagggagtagttatggataaagcttgtgtgagcatttttatacatcattttggtagacatatgtactaattttgttggctatatacaaggagtgggtttactgagtcatagggtaggtatatgtatttttaaaataattattttattttttttaagttctggggtacatgttcaggatgtgcaggttacatagataaacatgtgccatggtagtttactggacctgttaacccatcacctaggtattaagcccagcatgttttagctcttttccctaatgctctgcttccccaccctcccccaacaggccccagcaagtattgttcccctccctgtgtccatgtgttctcactgtttggctcccacttataagtaagaacatgcagtgtttggttttctcttcctgcgttagtttgctagaataatggcttccagcttcatccatgtccctacaaaggacatgatctcattccttttaatggctgcatactattccatcatgtgtatgcaccattttctttatccagtctatcattgatgggcatttgggttgattccatgtctttgctattgtgaatcgtgctgcagtgaacatatgtgtgcatgtataatatactgatttatattcctttgagtatatactaagtaatgggattgctgggtcaaatggtatttccggttctaaatcttggcggaattgccacgctgtcttccacaatggttgaactaatttacattctcatcaaccatgtaaaagtgttcctgtttctccacaaccttgccagcatttgttgtttcttgactttttaaataaccaccattctgtctggcgtgagatggtatctcattgtggttttgatttgcatttctctaatgatcagtgatgttgagctgtttttcgtatgtctgttggctacatgtatgtctttttttgagaagtgtctgttcatatcctttgtagggtaggtatacgtttaacttcagtagaaactccaagcagtttcccaagttgtaccagtgtattcacccaaaagcattaggtgagagtttcatttgcttcacattctcaagaacacttccagtgagtgaagtctttcgccattctgggaggtgtatatttgtgtatcattgtcattttaatttgcatttctatggtgctgatgatgcgcgagtgcttctatatatgttgactggccatttggatattgatattctcttttgtgaaatttctctttagatctttacccctttaaaaaattggattgtttgccttatttattattgatttatagtaattctttatattatgtattttatatacaaaacttttgtgggatatatgtattgggaatatcttctcctggtctgtggcttatctcttactgttttaatcttaatggtgtcttttagagaacaaaagttcctagttttcatgaagtccaacttatttttttctttagtagtttagtgcttttgaatattaatttacaaaatctttgcctacaggaagatcacaaagatattgtcctacattttgttctagaagttttatagatttatctttcactttttttttaggcagggtcttgctctgtcactcaggttggagtgcagtggtgcaaatatagctcagtgcaaccttgacctcctgggctcaagtgagcctcctgcctccgcctcccttgtaattgggaccactgtgcatgccaccatgtccagcaattttttgatttatttttatagaggtagggtcttaccatgttgcccagcctggcctcacactcctgggctcaaaggatcctcccgccttgaccttccaaggtgcagagtctatagctgtgagccaccacacctggctacctttcacttttagatatgtgatctagaattaatttttgttcatggtgtgcaattgggattaaggtttttgtttgtttgtttgttttactggtttacagtgctctagcaccattaattgaaaagattgtcttttcccttcagactttcagtggtctttttcataaactaagtgactgtttatatgtggatctgtttttggactctgttccattggtctatttatgcattctttggttgttgtcagactctccaatataataaattttgaagtctggtagtgtcagttctcaactttgttcttaaagattgccttggctagtctaggacctttgcatttgtatgtaatttttaggatccttaggtcaatttccacaaaaaaacttaatggaattttgatttggtttgcattgtatctatagattaatttggggaggattggcatcatagcaatattgagtcttttgaaccatgagcatgatatatttctccatttatttacatcttaaaatttttttctcaatttttagttttcagttgtagatgtctttattcattggtattttattttcttatgttattgtataagtggtgtttcataaatttcatgtttgattgttgttgttagaaatagaaatagaaaaatcttgagcttgtattaaacaaccttactaaatttgcttattcgttgtagttggtatataatcatgttacctgttttctttttgatctttatactttcccacccttttattgcctgttttcctgactataacctttagtataatgttgaatagaagtgatgatagtggacaatcttcttttctctttaacctttggggaagtattgaacattttaccaatctaataaatagattggtattagtggtaggtttgtgtgtatgtgtgtgtatattattattactattatttttggtaatagctaccttttatcagattaaggaagttcccttccattcctaggttaccaagagctttttttaaaaaaacgataaatgaatgttaaattctatcaaatactttttctgcatctattgagatgatcctagaatttctctgcttaattttgttaatgtagtgaattactttttaaaaaaattttaatttctttttaaagatgggtctcacttcactgtgcctggatattacttaggtttatttttgaatgttgaaccaacactgtattcttggaataaaccccacttgattatgtatattatgtatattatccttatatattgctgggttttctttgctaaattatcatttttatttttaaaagttttcatctgtgttcatgagagatgttagcctataattttcttttcttgtgtccatatcatgtatgcatattattaggcttatgctggcctcacacagtgcttaggaagtgttttcttctctttctattggctagaaaaatagtacaagattgatttctgttatttttaatctgtatgataatctctttttctctttttaaaatttgtgaaatagtcatcaaaatagagtatggttgtcttcttttgcagctgaagaaactgaagcttatagaatttaagtactattagatagctggtggttactgctctgtattgaaaaccagttctgttttacttcaaagcctttgctatacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataaggtgagttttaagatgaatctagtaccttattttcccacaagtccaaacattattacttttttatataagaaaaatgtttagctgttgtttcatgtggaaacatcttttcttcctttaagtgatatagaatacttgaaaaactattccttgttttcgttaccaaagaatttaggttttctaacaattgtttcctaatgacttctcattctgtagctatttacatttttttcttgaagattttattggaaatgtttggcgtctttatgagttttcagcaagttttgatgtcgtttaatcactaaagtttatactatgccagtgatgttattttatttgcttaatatgaaaaacctcaataagtttgtctcatttccagttaacttaattagaacatttggctccctctgaaactgcttctcatttttaaagcagaaggtgttatttagtgaaacctacaaaagaataatgttagagaaaattgtactttttagctgaaaaatgttctgtgttaataaattttagagctagaaactttttcgagagctcagttaatccttctgggacttttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtaccttgctaggattattgattttgttcattatgagcagatctgagtgcctatcatgtacataatatttctgtgaccagttcattcattgtgctcaagtgataataaccaattttaatattaattctgtaaaacatatagcgcttaatattcctcacatatggagcttaatcttcccccacaaattttattttgtatattttaattgcaaaaataaaggatttattcatattgtagctagtttgcatcagcatgaattaataagtttcactatttttcttgttagcatttttaagttttattgaattagatgggtaaatgaatagtaattatattatctgcagtgtaattatctttgatttcagttattcacaccatctctttacaagtgataatcaaaaattatttcaaagtttgaaaatttttaacataaaatttctgctcaatttttatactttttaaatttccttcaagtaatatatgcacatagttaacaataagatagtaccaaaagacttaaggtgaaaaatagcagtcttctttctatttctgttccactctacagtcctgcactccaaaagcaattactcctaattttttccccatttcttaaggtatttacctacataatttaaaataatatggctcttctactaattttttggcttaagcagttttcttatgataattgaagagttagctcttttattatgcctctctccattctttctccattctcttgctatagttatgtcatgaatttaaaatctatttttggtatttatattacttgattatggaaatactgtttatttgtgaactaagtagttcactttttttttttaaagcatccagtgttactattaataagtagaaagccattctgatttctctctggaagcgttcaagatttcctttacccctggtgctcacaagttttgtgatgctgtgctttgataagtgtctttttttcaacctttgtgctgatatttgatgggtctttttactttttaatttttggggaaaaattcatgtgtgtgtttttttttctcttccctttttttgattctttctgggcttcctgttagttgaaaattctgttccctaggttaatttgcctaatttttaaagtgtttttctcctatagtttatctcttaggctttttgtcttatttttctagttgtccttcacttcatctttctgtccgtctactgaattataaaaattgtattatcatagttttaatttcttagaggggttccttattctctgttcccattttaatattatgtctttgattcatgggtacaacatctattcttatttttctgagattattaataagagtttattgatgtcattcctcctacttcctaatttcttttggcacattttggtctttgcttttctgttgcaagcttttgtcagattcttcaagtcttagttcttgcaaaagcagaatctaaaataccctatctttggtttatttggaaggtgattccaggaattataatgagagaataaggaggtgagacagggaagagaagaagtccagtaaaaggtgtattgattttgtgggttatcgtttggagcagctggagctcaatactgctggagactttcagagagactgtgtagaactgcactgtctaatactaatcactagctacatatggctattaaaattaaaattaaaatgaatgaaattaagtaaaattagagattcagtttgcattcacaccagccacactttaagtgcagatgtagaacattagacagtgcagatatagaacactccaattcagtccagtccagtgcagatataggacatttccatcatggtttataacataccttagaattgtaccatggaggttcaggaaaactgacctatttatctaccatcatctgtcccttattgattaagagttgctcctagagttactgactccctgtcacttatggcctgcgccacacaggggctgtgtcatttctgctaccttactcatttccactgggtacctagtaacaccaaatgcagagtttctctagttcatttttttctagagatccaaatcctggtcttctgtcagtctgaggcaagtagtcacttgactgaatgtggtggagggaagatagtcttttataagtatgcagatttttaaccaaattgctcatatttttttggggaaatcttaccccagtatcccatggcaactgttacattcgagttccaagcctttggaggattccatggagtaaattgacttcttattcttgtcctttaccacaggcattctgattgcagttttccctgatctgcaaattactaccactctgtagcttaagaaaaattatgatatatagtatttcaaacatgtggagaagtataaagaaaaaatatgcttgcaattcatatagtgctgggataaattcaactaagccctgtagggttgtctttttttttttaataccaggaatcttttgtttaaattttaggagacttgtcaccactcagtgatatcaaggctgctggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccctttgctggtgacagtgcaagttgaatttgtacactgatctagattcagattagtataataaatttttaaaaatatcaagttgaatgaagaaggaaaattaaaattatacagtacctgaaactaaaaggctaaataaatggattcatcttttaaaaaaagttacattttctgagcatctataattcagttaagaaggtgactgaaaattgcagtttactggatgatcttgggaaaattactcactgtgtttctcagttttctcatttgtaagacaacaataatatgttgaaaggattaaatgaggtaatgtatttaaagtgcgggcacatagtaactactcaataattatttgcctgtcatcatcatggtcatattcaaagtgaaatttcttccacatctgaccttggctattttaatatatgtgttactaagcaatataatgtattttaaagaaaaatacggtgatatgccactttcaaagaaacaaaaaagatgtgcattataaattttagatcataggtgaaattgtacttattatcaattcattaggtgcatacaatacacatttagataggagcattgttaattcatttttagagtttttgaccactttcatacatttcaaaatggctttgaagacataactgcagttttcatatttttcatactttagcattttggtacatgccatattagaatgtatcttagacatctgataagtgtcaagatttcccccttactctgttatctagcaaatattgagtacctggtatgtaccaggtgctggggatataacagtgaagacaatctagatgcctctgtcatggaacttagatttcattgtttggggagatactggggaggaaagattggacaagacaacacataaaataacaagataacttcagatagtaataagtgatgagaagaagaaaatgggatgatggggtagaacatgcctggaaggactaatttgggttgtgtggttatagaaagcctttgtgagatgacatttgagcgaagacctgagatgaagagtcctgaaaatctggggatggattttctagtcagtggggacaggagttcaactgcatcttagacctgatgaacttggtatatttgaattcttacaaaagatgaatattgctaaaggatggtaattaggtagaagactaataaagtagaggagggtggaaagatagccaggacctatctttcacagatagccttgggcatcatttcttactgagtctgtgaagcttgatgccgtaagcaaagagaaatatggaaaataagtggttggtattaacggtgtggcttttaggaaacaggcaaaatatcctggaagatttttattggggatttggaagtataataaaataaataatcattaactttgtatgccgtggggagaaaccaggtctgattattgacttctctttagggaaacatcagtttgtaaaatgtgttttgaaagcagcagaggaggtaatatgggcatactactctttccctcccattaattctttagacttcttctttgatattttactgagagtgtggggttttccccctgtatatatgatatttgtgatgaagaaaggcaaataatttagctagagttcaacactttgtttcctactctttggtcaaaacataaatagtatttggataccttatagtaacatacaaggagaagtgactagagagagcttgtttggttaagatcactcatttaagtagattagaaaagtatacctatggagaagcatcccttggaaggtaagactaggttattttatttagccttcttcttggttgcaatggtttggatgcttgtcctcttcaaacctcatgttgaaatttgatcttcagtgttagaggaagggcctaaagggagatatttgggtcatagggatgagtccctcacaaatagattaatgacttccattgggggtgagtgagttctccattaattcctggaggagcttgttgttaaaaagagcctggtacttccttccatctctctcttgcttctttttttgtcatgtggtctatgcacactggcttcccttcaccttaccccatgagaggaaacaacctgaggccctccctagatgcagatgtccattcttgaactttccagtcatcagaatcatgagccaaataaatcctttttctttataaactacccagcctcaggtattcctttatagcaacaaaaaatggaataagacattggctaagtcctattataaatatatataagtatttaaatgtgttttttacatatggggacagcttagagtctcaaatattagacgtacctaaatgtaatacatggcttctagactggattctataagcagtactataaagaatgttattggatcagctgacaaaattgtactagtacagtaaatctgatgcaggtatttagtgatgttgatttttctggagtcgataactatagtgtggttatgtaagagaatattcctcatcttaggaaatttacattgaagaatttaggactaaaaagcatgatgtaagcaacttactctaaaaaagttcaggggtgaattatatatatatatagagagagagaatgtaggtgtatgttaataataaaacaaataggacaaaattttaacaatagatggatctggataaaggacatataggagttctatgcactaatcttatttttgcacctcttctgtaagtttaaaattatgtctaaataaaatactaaaaatgggttaaagttattttttgtttaaaaataatttcaaaatgtagctatatctcattgtcagaaatactatcaattctatgttgagtttatcaagcaaaattccaatgttagtacaatgatcaagtgttaaatattgggttacaaactaatattttttgaatctagaggtagaaaagattagtgtggattggatgttagaactgtgaaaaaaaagtgcagagtggtgaggtagttaagagaaactggaaagaatgagctggttgagaattcagaattggagaaggtaaatttagtagttacccatgtaaatgctaccattgtagagcaatgttttgtagtcttttgcagtcttcctgaggatacttaccatgttttattgaattttaacgtgcacattttttttcacattaaaaaaatctctgaaatcagggtgtaccttataatcagtggcatctgataatcacatcggtgtggattaaagtcagtttttccatataagatttgtggttttgcctgtaacctgggggcactaccagtaacctggaggcactaccacttttcttctgccagtaacctggggacagtaccaacctgaaactattttaaattatcttttgtgtttgagtacttggaccaccctagtgtgaattcggattacagatttgtgtgtgttctggctggtggttcaaatttggagaggagatagcacctctctcccccgcaccactagtgccaagattgagaagacaaattcctgtgctgttgctttccttgtaataggtttatttcccctttactcttatacgttttttgtcacagtcttcttatgagggttcctgttagactattggatattttttgttgttttcagttatatatgaaaataatggtgataaaaatactttttttcctgcttaactttggtgtccttgctttttggatatatgttcttaattgtattattcctattcatggtttcacagatatctttaatctcaccctatccaaaggaattctaaaggtaaaataacaccctacattgatagcttggtccattaagtcatttgtcttggggaaaagttgtagcataaagtcatagtcagtttttggttaggaggaccttatagaagagatgaatgagcatacatacaccctggagttagtccaagttttggattctctgaagcttacctctgtaacttaatctttctgaactttagtttcctcatctagagaatggtttgtgatattactgctctgttaatgttattgtgctccttcaatgagatagtgtatataaaggtctagtgtgggctctggcagagatgtggtgctgaatagatgatttatttttttgattgattgtgattgccattatttttggtttcctaggacatcctcttccacccagtccctcttcttatggaaatatatcttgtccaaccatcccctcccaccaaccacgagagaggtgggcacattattcatcctggccaatttagattaatcctctaaatataatggtaggttcacgtctgagtgggcatgtgaccaaagtccatcagagtcttttcccatcaggattgatatacagggaatgggggaagaaaacctctctaccggaattacaaaggttggatttagatccaaagccactggcaactaccatctaattccatatggagaagtctgcttaaataatgaagctaaggagaagctatcaaggataagagatggaggttgagggttggggagggcgaaaaagagagggaggagagagacagagactgagggagatccagttccatttttttaggctatccttcctatagctcttctttcagagatatgccagtctcctttccagctttgtgaactagtaaatgctttttttaaaaaaatgtggtttaagttggatttctgtcacttgcagtgaagagttctgatgaatatgataatggtgttatttgcccaaagaacttttcttgctcaaagaactgcctatattgctttcttgctaacttgttaaagactagtatataataggctattacatagaggatgaatgcctggaaaaagaaataaaaattatgatttttttaaggaagatctctgagtttaagattttttccatgtcacattattatttctagtgatgctatagggataccgtattgcaagtaaacatctatagatgtacaaagaaaatttgcagtcttaattttaattagaaaccatttaccacatttagaagctctgattaaagatataatggataaaagggataaaattacatttgcagttatttgtttttaatctttaatgtcccttcttatatgactctcagatagagtgagcagggcccaacttgtctgaagcttaagaggtgacccagaatataattgagaggactagaaaggtatattagactattcttgcattgctataaagaaatatctgagatggagtaatttataagaaaagaagtttaattggcttacagttctgcaggctgtacaggaagcatagtgctggcatctgcttctggggaggcctcaggaagttttactcatggcggaaggtgaagtgggagcaggcacatcatatggccagagcaggagcaagagagtctggtgcgggaggtgccggactttgcaacaatcatatctcaagagaactcactcattattgcaaggatagcaccaagccatgaggaacccgcccccatgacctaaacccctcccaccaggtcccacctccaacattggggattacaattcaacatgagatttgtaggggacatccaaactatatcaaagggcaatggatcagtgtcagcattcactgctggtaaaaacagtatttgtattcttaatttggttagtctggataggagccaaagattcacagcatggccgtattcacttggaagtttgcaatttgattaaggtttgagaacatgtcagggaaggaaagaatttcctttaaaatcatcctgcacactgaatacctaaagtagtacaaataatttgttatggcctgagaagctaagaaaaaatttagtcattcttctaagtccaagaatggctgtaggggatagtacatgagtgactatcctgtctacttctgttttctgttttattttgtatattttttagaaacaggatctttctctgtcccccacactggagtgcggtaatgcgatcatagctcactgtaacctccaactcctgggctcaagctgtcctcctgcctcagcctcccaagtagctaggactacagacgtgtgccaccacacctagctaattttttattttttgtagagacagggtcttactatattggctaggctgctcttgaactcctggcctcaagcaattctcttgtcttgggctcccaaagcactgagattataggagtgagccaccacgcccaatcctgttttcttttttgaggtgcgttaaatatttacattttacctggagtttggaaaagtagtttatttggacgtacaagcttgttttttttttttttttttttttttttgagatggagtcttgtcctgttgcctgtgctggagtgcagtggcatgatcttggctcactacagtctccgcctcgcaggttcaagtgattctcctgcctcagcctcccgagtagctcggcttacaggtgcacagcaccacacccagctaatttttgtatttttaatagtgacagggtttaactatgttgggcaggctggtcttggactcctgacctcaagtgatcctcctgccttggcctcccaaagtgttgggattacaggcatgagccactgcgcctggccaaggtgtgtttttaaagtagaagttaattctgtggattgatttaaccaattttctttgcaagcaattgtataggagaattaaatacaaatcctcctactgatgtcagatttagataatgccttaatatgatgtaatatcttaaatagtgaactgtttggttataccttgtgccatgatttccttaatatatctcataaagttgtacaaagaataagattgagatgctttactgttaggcacatagacatttatgtaacattcattttaaaaaatttgaataccaattatgtgtaaggtactaggataaacacaaaggatacaagaagtctttgccttaggccaatacattctgatagagtgttaaaatagttacacaagtatctgttactcaaagcattaattacataggtgttatatatattaagtatataaacattatgtatattaagtgccttgtgctgagtatcaactaagtgttttaagatcagagtccatttggggtttgtgatggttaattttatgtgtgaacctcactggatcacgggatgaccagatatttggtcaaatattattctgagtttctatgagagtgtttttggatgagatagatggattatgagtagagcaaaaaggcagactctcccacatataagagagaattctttcctacctgactgccttcaaactgggacattggctttttacctgcctttgaacttgaactgaaacattggcccttcctgggtcccaagcttgctggccttcagatggaaactatactgccagctttcttggttcttaatgcttcagacttggactgaaactaaaccattggttctccaacttgctcccacaactctgcacatgttaggtcagcctccacaatcatgtgaactacttccttataataaaaaatctttacacacacacacacacacacacacacacacactcacacacatactattgtttctgtttccctggagaactgtaattaataaagggtgacttggaaaggcatcacagaggaggtggaatttaagccagaggctaaactatcgtataagcaggatttcagtagataaagatggtgaagaaaaacactacaggcagaggaaatagggtatgtgatggaagcagtctcaagtagtataatttggctagagttcaagatgtttctactgtttttttgcatttcagaagagttgtgggagaacaccagttttaccacaacctggctagtacttggtggtagtgtggtagtggcagtggcagtgcgcgtgtgactttttttttaaaaaatgactgtagcaggttgattgatgattggttaaagaggaagtctgctttctcagcattctggttaatctaacctgagatcatttttcattactctatcatgctccagtccaggggaggggagggttatagtcagaaaaaaagaccgtataaatgtgtatatatatgtgtgtgtcttgctatttgtattggttctcatagtttgcaaagtgaatatgatgacattcttcccttggccctatttttagcttgcttttctcttagtggacctaagttatgaaatagcaaaggtttatatagctttgaaattcatgtttttagctgggcgtggtggcagtgcctgtcgtcccagctactcagggtattgaggcaggaggatcatttgagcctgggagctccaggctgcagtgagccatgcctacacctctgcattccagcctgggtgacccagctaaaccctgtctcaaaaaaaaaaaaaaaaaaaagaaatacatgttttataccctcagatttaattgcttattttacatatttgaccatccatttcctgggatgactgatgccccaagatggtgccaatgtggaatggcagtactgtttagtaggactttctccagtgtccagtgtggtatccaccagccacacatagctattgagtccttgacatatggctagtgtggctgaaaaatggaattttaagttttatttaattttaattgatttaaatttaaattgtaacatatagctagtggttactgtatgagacattgcagttctggagcttaagaagttttggcttgtttctagctctctggtgttgagaagggctgaccaagcagtattttcactcatatttaaaatataatatcttaaatattcttaaatattctattggtgattacacagcaaatgaattttgatattgccaattcttcagtaaaattaggtatttattaattaattgtttatgttctgcctcattccaaataaagattgtatgtgaatgataggaaatgatctattaaaggtacaattattaaaataatgataaaagaaaaagagccatgtaacaaatgaagtgagaagagaagcaagaaaaggggaaaaatcaggtagcgtgatgcctccagcttttttcttttggcttaggattgacttggcgatgcgggctcctttttggttccatatgaactttaaagtagttttttccaattctgtgaagaaagtcattggtagcttgatggggatggcattggatctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattgtctttgaagcaattgtgaatggcagttcactcatgatttggctctctgtttgtgtgttattggtgtataagaatgcttgtgtcttttgcacattgattttgtatcctgagactttgctgaagttgcctatcagcttaagattttgggctgagacgatggggttttctaaatatacaatcatgttatctgcaaacagagactatttgacttcctcttttcctaattgaacaccctttatttccttctcctgcctgattgccctggccagaacttccaacgctatgttgaataggagtggtgagagagggcattgcgacactattaacagtagcaaagacttggaaccaagccaaatgtccaacaatgatagactggattaagaaaatgtggcacatagtgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatactgcgcttttcagaccagcttaaaaaacggcgcaccacgagactatatcccacacctggcttggagggtgctacgcccacggaatctcgctgattgctagcacagcagtctgagatcaaactgcaaggcggcagcgaggctgggggaggggagcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgagggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaaccctacaagccagaagagagtgggggccaatattcaacattcttaaagaaaagaattttcaacccagaatttcatatccagccaaagtaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcatgtgcagagacacacataggctgaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcatctctgcaccaagtggacctaatagacatctacagaactctccaccccaaatcaacagaatatacgtttttttcagcaccacaccacacctattccaaaattgaccacatagttggaagtaaagctctcctcagcaaatgtaaaagaacagaaattatagcaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaacacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaagaaaaaaagagaggagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacactctcccaagactaaaccaggaagaagttgaatctctgaatagaccaataacaggagctgaaattgtggcaataatctatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgagaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagagactaccatcagagtgaacaggcaacctacaacctgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcatcatcactggccatcagagaaatgcaaatcaaaacactatgagataccatctcacaccagttagaatggcaatcattaaaaagtcaggaaacagcaggtgctggagaggatgtggagaaataggaacacttttacactgttggtgggactgtaaactagtacaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccgacccaaatgtccaacaatgatagactggatgaagaaaatgtggcacatatacaccatggaatactatgcagccataaaaaaggatgagttcatgtcctttctagggacatggatgaaattggaaaccatcattctcagtaaactatcgcaagaacaaaaaaccaaacaccgcatattctcactcataggtgggaattgaacaatgagatcacatggtcacaggaaggggaatatcacactctgtggactgtggtgcgggtgggggcaggggggaggggtagcattgggagatatacctaatgctagatgacgagttagtgggtgcagcacaccagcatggcacatgtatacatatgtaactaacctgcgcaatgtgcacatgtaccctaaaacttaaagtataattaaaaaaaaaaaaaaagaaaatgtggcacatatacaccatggaatactgtgcagccgtaaaaaatgatgagttcatgtcctttgtagggacatggatgaagctggaaaccagtctcagcaaactatcgccaggacaaaaaacaaaacaccgcatgttctcactcataggtgggaattaaacaatgagaacacatggacacaggaaggggaacatcacacaccagggcctgttgtggaatagggggacgggggagggaatagcattaggagatatgcctaatgttaaatgacgagttaatgggtgcagcacaccaacatggcacatgtatacatatgtaacaaacctgcacgttgtgcacatgtaccttaaaacttaaagtataattaaaaaaaaaagaaaaggggaaaaatctaggaaagtctagtcgagggtagcaaaaaatccatctgtgtcaactggcagatagagtaaaaaaaataaatccaataaaaaaataacatttttatgtaatgagacatgccattgagtcaagagagaaactttttccaaagacgaaacaaggagaaatttattccgttttgtaagatttgttgagtagtatagtggacggcatcgtttaatagcaattttacaaataatagagacatttttatcatatatttacatcaaatcttggtaaaaagttttttgaagagctaaagcctgccaataaccatgtgagcgagctgagaagcagattctgcagagctagtttagtcttgagatgactgcagtcctggctgacagtttgattataacctcatgagagaacttgaaccagaggcactcagctaagccactttcagattcttgacccacagaaactgagataaaaaatgtttgttgttttaagctgcttagttttggggtaatttttttatgtagaagaagctaactatgttatgatattttttttagaatggaggtgcttggtgttaaatgataaatagatacagctttctaaaccttcaaatcttatttatgaaagtacatttatagccttatatgtttgagggtgtaaatatagttaggaaaaatgttgaaattaagtattttcactagccatcctaaatggcatctggccatttgaatgaatgaaaaatagctaataacaatagataacatgtattgaactctttctctgtttcagaaactatcctaagcatgttatggacattgtatcatttagtccttacagaattgtattgagtacttcagactttaaaaccaaatcactttgactccaatttagccattgtactaaccatactgtgatcaggtaacttctgaggtatagaaattcatgtgttaaacatctgagggattcttaaattttgatggatgctggagatatagtggtgagcaaagggagacagaacctcagatctcatgccacttacaacattttgaagtacatagacattaatacaataaatacatatttacagactgaggtcagtactatgaagatgagttctgagatcctttaataaaagcaagtttctggtccaggcacagtggctcatgcctgtaattctagcaattttggaggctaaggtgggaggatcgcctgaggccaggagtttgagaccagcctgggcaatatagtgagaccctgctgctacacaaatttaaaaaaaaacccattagctgggaatgatgatgcacacctctagtcctagctactcaggaggctgaggcaggaggatcgtttgggcccaggagtttaaggctacaagtgagctatgattgggccactgtactccagcctgggcaatagagtgagactccatctcaaaaaaaaaaacaaaaaccagtaaaagcaagtttttattgttgaagagcaatggtatgcttacaaactgaaagaagggcaacaaggttatagcacagaaaacaaaaagaagagtggtgtgagattaggctggaaagatatgcatgggccagactagcaaggccttggaaggtgatgttttattctacttcctaagggaagctatcgaaaagtttttaacagatattatgttaaggttttctttttggaaatatcattgtagttaaaatatggacattgtagacatgccatagtggctatggggagactcttaggaagctgttgaaataaccaaacaaaaaagatggactaaggtattggcaaaagttttttcagaaatggagagaaatagacttgaaagatggttacaggataaaatcaacaggacttggtgagaaaattgattaccagggggttggggagaaggcattgttaagaatggtgaaaagatttcctacttgcctatctgtgtgtatgatgatgctatttattaagggtacagaacattaataggaagggggacacatttggtggtaaaactcattagttagcttttgccgaatttgagatatgtttgagacatccaagtttggaatgttgagaaagatgtacaggttgaacatccctaatctgaaaatccaaaatcagaaatgctccaaaatctgaagctttttgaatgcctataagatgcttgaaggtcatgctcaaaggaaatgctcatttggagcatttcagattttggatatttggattagcgttgctcagccagtgtaatggaattatgttattctaaattctgaaatatgaaacacttctgatctcaagcatttcagatcaggatactcaacctgtattagattggatcacacagaactccaggccagagataagaatgttcaaggaatgggcaaatatatggtaattgatgtaatggttaagaatgccttgtgagagggagtgagaagagaagaaggcctagaagttgaggaactccaatattaactggccaaactgaagaggataacctacaaaggatatagtagaaggattctttcactcatttatttatttattcaacagatatttatcaagtgcctattatataccaggcacaaatatggaatccagggatatagcagggataagatagtcaagatctttgctgtcatggaacctaaactgtagtagaaagtacgtaaataaacataaatactttagataggtacaggtactaaaaggaaatagaaaaggattatgtgactgaggaagggaagactagaagaggaacaaggcttttgaggaaaatcaagaacttccttctttttagccatgctacttttgaggtatctatatccaaatccaagtgattaataggggctgctgcatgctagtaaatagcaccaccattcacccaaattggcaggctcaaacttccagcagcttttttctttctttcgttctttctttctctttctttttctttctttctttttctttctttctttctttctctttctttctttctttctttttctttctttctttctttcttctttctcctctctctttctcctttcttccttccttccttccttgcttccttctttctctttttcttttcccttccttccttccttccctccctccacccctccctcctttcctccctctgtccccctttccctttccctccccctcccccttcccttccccctccttctccccttcccttcccctcccctcccctctccctcctcctgcctattctctcccctctccctccctcccccttccctcccctcccctctcctgttctctcctctcctttcctttcctttttctctctctctttcttatactccatattcagtccattagcagctcctgactactccatctttaacatttgtgctcaatatgattacttcaattatatgcactatttctttactctaagccaccattttctcttgcctagactattggagtaacctctgttctgatctcccagcttccaatcttgtccccatataatctggtattcacattgcagcccgaatgatcttttaaaaaccaaaattctttgatcatatgctccagttgtttcctataatatcgacacagtttaccatggcaataatgctctatatgatctagtcacttttttgactgcattttggaatgctctttccctctacttcagcttcactggccaagactccgctattccttgaagatatcagtattattccagacttcagggcatttgcatttgctgttttttcacttggaatgctcttcccccatattttcacttagcttgctccctcacttcataccagtctctgttcagctgtgatcttatgaaagaggttttccctgaccaccctatataaataagccttctttgacacctgcctatcattctgtattcccttagcccatttttatttttcttcatttcacttatcatctaatatgttcttgtttattattttttctttccctctagaatgcaaagaccttgtctgtcttattaatgtctgcatcccaacagccaagaataatgcctggtatataatatgtgggttccataaacatttttttttagtgaatgaatgaatgaatatataagtctggagctcagaggagatttcagtgctgaaatgtaaatttagtagtcaatagcatataaatggtcatttacactgtaggactggatgaaattatcaagagatagtatggagccaaaccagaaaagggacccagattcaagcctttcgctgatttttcatttataaatcagattagaaggacccaacaagttaggaggaaaaccaggagagacatatcattgaaactaagagaggaaatgttctaaggacacagctttgttggataatgcttacaggctggattaagatgtgtttgtaaattaaccattggatttgcaaagatgaagattgttttgtggcttttaagagttatttcagtggagtggttggggtagaaatcagactggagtatgacaggtgaggtagggagagtgaagtagactcctttgagaagtcttgctgtgaagaacagagaattgaatgatcattgaacggaggaaatgtaatcaaggaaggacttaagtattcccccagagttttctgaatttgcaattcattcatcttgattatctccccttgaggtctagctgtcatcagttaactggaggattgattcataatccctttttgcaaggtggcaaagcttacctttctcctcaaacctatctaccaaagttctctttcttctttaatttcattagagtccttggtaaatgattcacatttctttttgttataactcttcagtaaattaagcctttgcctttcttgctgattttaccgtattatataactatcatagatgatttcaaatgttaatagtgatagaaactgtaataatataatactaacatgtattgatatttactatgtggggtcttttgaagaaatttacatttttttaacttaatattcaaaacaaccatgggaggcaggtgctattattatcctcagtagaggatctaaggatctgaggttcagagggcttaggtaatttcctcaagatcatatagttcataagtggctacaggtatgattgtagagcttttgctgttagccaccatgctattctgtctttaagttaacaaagtaaatgtttcatcttctaattatgttaaactaatatgcctttggtgaattgttttggtaaagttaatacttctttttctccacttttatatctgttatgtgaatttatgtcttagactggattattggtaactctattatttttacaataatcaaatgttagggctagatgggacatttaattacataatgaatggaataaaaatctgctaatcagatagatctgttttctaaactgcattttttctcctttgtcttttttggcctaccctgttggctgtgaactttattttaaaattcatttgtgcttataacaataataagcactatttattccttgagtggttttacaaaccttacaaggcttaccatttccagagtgtcagagtagctatagcaggtttacacttaaatatactcttggttttatgacattccattttgacagtgatgaagagcatgcttataggcatcgttgaaaaggaatgttagaactgtttatgtgatagttctacaagtttcttacatttatctattatagaaagatctatcatacatgcttacttttcacagagtttataatatatgcatatgttttaatggtttgttataaataatatgattagctggcaaaagcttttagcaatttaaattttggggttattttaaattatgaatttaaacaagctctttcatttcaggtggttggctaaacccactgtggctgatagtgttatataaagttgttttctagttttgaaaagctaaaagtttatgtttttatgctttctgtgaaagtcactaatacttgtaacctaatgaaaatgtttctactgctacaattgtggagaaattttgaaaacctagatttagtcagtatttttcatgctaacattgtaaagaatgtcagaggccatggagaggatctaagggaatcagagaaaaggaagaggaagtaacatttttagagtacattttatgttctaggcaactcagtaatagggcagtatatcatttcattctcacagaagtctttcgaggtattataatttcccttttacagatgaggaaactgaggttgcagaggttaattatgttgataaagatcatatagataagtagaactaggattgaaatctagatctacttgatacttaagcttcctcttacacttgttttatggagttgttcttgggccttcttaaacaggtaattattctatgtcatagcagaattcttgatagaattatgatatttaaatttttatttactcagctatcataaacataaaaatactatactactatataagcttgcaggtcttttgaatataaaaactaaactgcatgttgactcatttatcagagttctgtagaataattaaaagtaattataggaggtcttttttaagtgtatgtagtcatttgtattatttgaaagcttagacagcttttatagcagtttgcttccagaccatgctcattgatgcattgaagagatacccgtgaaccaccttgtctactcccatacagctgatttatctttgtagcagtccctgagttagagaatcttccctactacctctgctatagttttcagtaaattgggcaagatcaaatgtttcctggagataatttccttagctcttgtattagatcccaacagtaaatacattattgactgatgtgaacacagaaagcatctcaaactttttgttgatcagagcatagctcagttgttttaggaattccagataaaatgacagtaatgtattgtgattatttccttcttttgaaatgaacttgaatatacttttatgtttatttgtaaaataacatttcaaagatcacattgtgcttatttttacagtggcctctggctgaaagcaataaagttctgtcctgggtggaactaggctagttgcagtttctcaaatttcttcaatgagatgctttgcttttgtgaaaataagtcatattgtccactgccacctttgtttacttctccattttatcccctcttggttacagaaattagctactacaaataaaatgccaagattttataattttctatgtttaaatttgcaagtaaaaagttctgttgaaacatttgtaagatcaaactaatgtgagataaatatgactgatattcagaagttgattaatctaactttcagtactgtacctattacataaagtatgattaatctctatgtgcaagtatataaacaaattttgagtataaaatcataatctaaaattttgttttatatttaatggagtgttcaaatactttgtaataaaaacaatggatgactaaaatgattgaataagttatcaaatagagctttgtaaactagggttcatagttgcaaataatagaaatcaactctggatattttaagaactaaaaaaaaaattgaaacgttactgagaagcttacagaatcactgagagggttgtagaactaggctcaataaaaggatcagaataggagaggttaggcagcaaataggaccacaaccaaaatcacagcacatcagtctggtgaatacatgcatggctaccaccaaaaatgaacactcacttgcccctcacgttagccaatgaatgctgtctcttccactgctatctaagaacctcgatgttgctaccatcagtttccagaatggattctctgatactcccctctgcatcattatctcccagtttaaagatgggtgtttctgagtagctgacctaaggtcacatactaatactgtaactacaagaatagttgggaaagtgaggattggatattttcagattgtgtggagaactaagctctgtggtctatcaacactcctcaggtaggtaatttctaagtgtaggaaagttcagatgttgggtggccaaaaatgtacagatatccactacatttccttgtgatagcatctaagttctttccatttcattcttttataaattcttttaacattattgttgcataagagaaaaaggcataaattattttaaaattttagattcagagacttggttggacacatgatattactctggatgttcttagacgtttcaggccatttcaaccttattttagttattactttaacaagtttctgcaaagttgtggttgtattaatagcaaacatactaatagtgctatttgagcattatcagatatcataaacatagtattctatcccttcttctgaaagatatatcaacatttccctagatatatccttatctttgtactcactttggagaatgagctctaaaagtataatggaaggaacaaaaactttagagccagatttgggatcagatgtgacctctgtcactctgtcatcatcatttggtatctaacattagcagttattctcattttagatatgataaaactgaatcatagagaggttaagtagctcaagacttttaaattaaacatgaacgattaaacattaaaaagtatccagaaaaattaacttactttttttctaaatgtagtataaatatttttagtgcatctcaagtatgcagtgacttagatacccatattccaattacagatgtctaattttttaacttacatacaggaacaggtaatcatgttagatcagtttgtctcagttccttgtgttttatgtttagaatgttggggatattttgttcatattctaaataactatttgttatacccttccaccatcatttaatatgttaaagttttaaagcattttactttgatttttttttttttttttttttgagacagagtcttgctctgttgcccaggctggagtgcagtggcactatctcggctcactgcaagttccgcgtcccgagttcacgccattctcctgcctcagcctcccgagtagctgggactgcaggtgcccgccaccacacccggctacttttttgtatttttagtagagacggggtttcatcgtgttagccaggatggtctcgatctcctgacctcgtgatctgcccacttcagcctcccaaagtgctgagattacaggtgtgagccaccacgcctggcctttactttgattttttaaccttacaacaccccttgtacttgtataatgtcatttttacagatgtgggaaattaggaatatagattaaaaatgacatagttataaggctatagtttagttctcacagagaaactcagtcatataagttaagcgtttttgttcccaaatgatagtcatagtagtaaaagaaatttttaaatttcacttatttattcagaaagtgcttactgagcgcctagtgtgttctgtgcactgacttaagtgctggagatacctaagtaaatcagacgatttctgctgtcatggagcttatacacttatagagggaagtagaaaataaatgtaaaaaatattttcaccttttgataagtaagtgctgtggaggaaaattaagcaaggaagggtaaaggggaattctaggggttaggaaaggggagttataattttaaacagaattattgaggaagacatcactaggaaggtgacatctgagcaacaaaagacctaaaggaggtatgggaaggagacatgcggatgtcttggagaagaacattataggtagagagaagagcgaaagtccaaggccctgagaatgcagcatgtctgacacgttcaaggtgaggcaaggtgcaggtggggggcagtatgttgaaagcaaggtaagcaaagggaagagtaaaaggaaatgagatgaaaataatgaaaaagcatacgaaagcaagtgattttttcttgggtctagatttcatactggtacctaactttgcttaatttttctgttgttaataggagctgttaatgcccagtcaatatatcagagaatggagtttgagcaactatagtttaatgaggcaattaaattgagaaccgtggctttagactagttcaatatgaagaacagattaaatgtactctgaggaactgccttttaattatagatttttgagattcattttagtgtcatttttttcatggttaaacaacatggagaggaaagtaatgatcttataaaatagaagtgttcaagataacttactaggatggatcatctgtgtttgccaaatcaaacagggcaatttaaaatacagttgttccttggtatacatgggagattggttccaggactcttgagtatatccaaatctgcacatactcaggtcctacattagaccctgcagaacccacgtatacaagtttcacatcctgaacttactgtattttcagcccgtgtttggttgaagaaaagccatgtatataagtggacttctacagttcaaacctgtgttgttcaagagtcaactgtgtatcaggttagcatataaacctgttttgttttgcctaccataaaacactgatctttagattgatacaattgctgttttattcattggttcatatacacctaatgagattgctattttaattttcattgttaagacacacttaaattcctaatacttaaaaacgtatatgaaaaatttattttcacaaatcgatatacctattttttgaacagtagtatgcatattgctttacaaaatgacagtgtaaaaatggcattcagattcccgtttctaagatgcttgaacattttgatttttactcattagaagtttaattgttattagtcaacaaggagaaacaatgaggaacttacagaggagtgtcagttgtattgaaagattaggagtgaatgttttatcttgtaaaaagatatctcagcccctaggatggtctacagaaatgacaataagctccgattcttattttaattttttattttttctgtttctctgtctcctgtcttttcctgcgcattctctcttttactcccaacctctcttgtttatttctttggatccgtcaaagttggaaattgaacagtatttctgatatattatgtagtatgagttctgaaatcttggtgaattaaattcatgaatgctaccatagtgattttattaaggtgtggcttttgattacatgttcttcaagctagggttatgggagtcagctagtaggtaggcttagtttgattgtcctactttaacatttgtttttccttcttgaaataactttcatgaagttagatacaggcttttgtacaggatcattttgtgggaaatggtgggtctgaaaagtaagccattggtattgataaaagcagagagaaaatgaaaaagaaaaaaggtaggaaagatgtgccttttagccaataaatagaagtttaaaagacatgaaagaatgagatgtaatttttttaggagctctaatttagccatgaacacagccaccattactctgcagaaagggaaaaaaaggggattctgtttcagaatttgctgtattaaaaactatttgagaaagagaacactttattgaaaattgaaaattattggctaacattcagtgtgagggtatgtcgaagtaccatccgactaaaaacaaattaagtgtagtcgtgagtcaaacatattgtttcttccaaaatttaaattaaattagtttcatatgagtgttttctttttttcttgagacagggtcttgatctgctgcccaggctggagtgcagtggcatgatcacagctcactgtagctttggcctcccaggctcaagtgatcctcccacttcagcctcctgagtagctgttactacaggcatatgccactacacttggctaatttttaatttttttgtacaattgggggtcccactgtgtttcccaggctggtctggaactcctgggctcaagcgcctccagcctccagctcccaaagtgctgggtttacaggcatgagccactgcacccagccaattttatgtgttgataacaatcttgctgaacttactgtttcttataacttataggttgttcttcttgggattaccaagtaaatgtcctttgcagtagtgacactttttctttcttttcaatctaagattttgcttttttctctgattgtgtaaagttagcacttctaaaacaatactctcagcatgtattgcatgattacatactttttcttcttatattaataatatgaagtatattaattgaatgctcaatattgaattaatcttgaacttctggaatatgtcatataattctattcttttaaatgagttattatgaaaaattttaaccatacagaaaagttgaaatttattcggtggaaatctgtatatcctctgtcttaatttaacaattaacattttgctatatctcctctttttttttgttagaccacttgaagctgtttttgagaatacagattccaatacaaccacaaaaaccttaccacatctaagaaaattaatactgattctatcttatgtaatatctgttctttatttaagtttcccgaaatatccccaaaatatcttttatagctttcatttttttccaaaccaggcaaggtttatacattcattgcatgcggttatgtctctttcatctctttcaatctagaatagcccaccccatcatcttttcttctgttggacagttatactaatatgcagagatgatgtcatatttttcactacagaaaaagcactcataaatatgtataaatgtatatcgatcataatgcttgagaaggaatgggcattggacccatacctctgcactctggcttgaaggaagatgaaaagtttctagatacaacagaggaaatgataatatagagaagtccaggaggtacaaagtctgtgtgacaaagatagaaagtagaggaatgtgatacaaagggagaaataaaacctttgaatcttggagctatataataaatgttaagattcttcatactgaggttgtgaagcaggacaatagtgaagaggaatactgaagaaattataggagttttaaaaatgattacaagatatatcctatatagagagaatattacaatttctggtgaaaactatcaaatataaggggatattctccagaacgaaaaggtgaaagaaaacacctcattggcactatgtagaagaaatgggttgtaattatccaccactgcacctgccagccacgaatggctgtttaaacttcagttaaactagttaaaattacataaaataaaaaatctagtccctcagtcacactgaccacatttcaagtgctcaatagctatacatagctagtggctccatattagagtgttttcatcatcgaaaaaagtttaactggccatcactgcaatagattcaatataaaggtatgctggcttttagggtacacattcaaggtttggtagggagcctattaaaactgatcaaaatccttgattgttatttagtctggatgaatcacataggggataatgacagtgaggaagagaacacggaagcatatttagagtcctcacaaaaaatctggatgtgctgggaataataggttgtgtgtgtgtgtgtgtgtgtgtgtgtgtgtgtgtgtgactccttattgttgattgacacagtggaacaatgaaggaagatagtagaagacaagtaatctagttttacctgtgctcttctctcttgcaaggtagaaggctaagcctttgatccaggctggaggccctgaaactgggattgataggatgggcttattactgtggccctgaactgaagcccagttgagggcggcctgggaagcaaggcatgaacacagccttgataaacaaaatgagtaaaggatgcacagttaagagccaaaaagagaatagcctgaacgtgtagaaggaaactaaagctacaagggagttaaaagctggttgaagtgagtgttttgggggttttctgtgaattaataattttgaagaggaaacagccctggtgcgtggggcacattttcgtagagaacacaaagaaaagaaaacctctttggtacatattttctttcagtatttttgggcaaggagaatgatgtactttttactgacaagagtataactaaagttgccattaacagaaataaagcccagttatcataaaggaactgaagtccaagattaaagaagattatagaaaagtacttgattgattgttcataaacatattcaaatatcccaatacagatgaattttgtcctagggtattgagataacttacaaaggagattagcaaacagactatatatttttttaagacactatagagaaggagagaggttctggaatactggagatagatacatgccattctgattttcagaagggagaaatgaaggttccacaaacaataaatcaattggtttgacattgaccttagaaaagattaaaggggtgggttttgatcatctgagagagatagtagtggtcactaagaaaagattaaagaagtgggttctgaacacccaagagaggtagtagtggtcattaggagttagtatgggctcatggtgcataattgtgacagattgacttttcaagtccaccatgtactagctgtgcaacattgagtaatttgcttcatctatctgggtctcagctttcttatctttaaaatgaaaataaaaataatatctattacataggctcgtaataaagaataaatgaatttacatttgtaaaacatttagaacgaaatgtgatacataaaaagcacaatgtcagtgatagataaatagctagagagagaccaacaggctgccttctttttttttttttgagatggaatctcgctctttcacccaggctggactgcagtggtgcaatcttggctcactgcaatctcggcctcccgggttcacgctgttctcctgcctcagcctcctgagtagctgggactacaggcaggcgccctgccactatgcccagctaattttttgtgtttttagtagagacagggtttcactgtgttagccaggatggtctcgatcttctgacctcgtgatccgccagccttggcctcccaaagtgctgggattacaggcgtgagccactgcatccggccacaggctgccttctttaatcaaacttgtagctccgtgaaatgaaacagctaatgtgcaaagattgtagcagctcttctttaaaaaaattgaggtgaaatttgcatagcctaaaattaaccattttttttattattatactttaagttttagggtacacatgcacaatgtgcaggttagttacatatgtatacatgtgccatgctggtgtgctgcacccattaactcctcatttagcattagttatatctcctaatgctatcccttcccccctccccccaccccacaacagtccccagagtgtgatgttccccttcctgtgtccatgtgttctcattgttcaattcccatctatgagtgagaacatgcggtgtttggttttttgtccttggggtagtttactgagaatgatgatttccaatttcatccatgtgcctgcaaaggacatgaactcatcattttttaaggctgcatagtattccatggtgtatatgtgccacattttcttaatccagtctatcattgttgaacatttgggttggttccaagtctttgctattgtgaatagggccacaataaacatacgtgtgcatgtgtctttatagcagcatgatttatagtcctttgggtatatacccagtagtgggatggctgggtcaaatggtatttctagttctagatccctgaggaatcgccacactgacttccacaatggttgaactaatttatactcccaccaacagtgtaaaagtgttcctatttctacacatcctctgcagcatctgttgtttcctgactttttagtgatcgccattctaactggcgtgagatggtatctcattgtggttttgatttgcatttctctaatgaccagtgatgatgagctttctgtcatatgtctgttggctgcataaatgtcttcttttgagaagtgtctgttcatatcctttgcccactttttgatgggttgttttttcttgtaaatttgtttaagttctttgtagattctgaatattagccctttgttagatggatagattgcaaaaattttctcccattctctaggttgacttttcacttcttttgctgtgcagaagctcttgagtttaattagatcccatttgtcaattttggcttttgttgccattgctttttgtattttagtcatgaagtctttgcccatgcctatgtcctgaatggtattgcctaggttttcttctagggtttttatggttttaggtcttacgcttaagtctttaatccatcttgagttaatttttgtataaggtgtaagaaaggggtccagtttcagttttctccatatggctagccagttttcccaacaccatttattaaacaggatatcctttccccattgcttgtttttgccaggtttgtcaaagaccagatggttgcagatatatggtattatttctgaggctcctgctctgttccattggtcgatatctctgttttggtactagtaccatgctgttttggttactgtagccttgtaatatagtttgaagtcaggtagtgtgatgcctccagctttgttctttttgcttaggattgacttggctatgcaggcccttttttgggtttcatgtgaaatttaaagtagttttctctaattctgtgaagaaagtcaatggtagcttgatggggatagcactgaatctataaattaccttggacagtatggcccttttcacaatattgattcttcctaaccatgagcgtggaatgtgtttccatttgtttgtgtcctctcttatttccttgagcagtggtttgtagttttccttgaagaggtccttcacatcccttgtaagttggattcctaggtattttattctctttgtaacaattgtgaatggcagttcactcatgatttggctctctgtttgcctcttattggtatataggaatccttgtgatttttgcacactgactttgtatcctgagacttgcagaagttgcttatcagcttaaggagattttgggctgagatgatgggtttttctagatatggaatcatgtcatctacaaacagagacaatttgacttcctttcttcctatttgaataccctctatttctttctcttgcgtgattgccctggccagaacttccaatactttgttgactaggagtgctgagagagggcatccttgtcttgtgctggttttcaaatggaatgcttccagtttttgcccattcagtatgatattggctctgggtttgtcataaatagctcttattattttgagatacgttccatcgacacctagctcattgagagtttttagcatgaaggggtgttgaattttgtcgaaggccttttgtgcatctgttgagataatcatgtggtttttgtcattggttctgcttatgtgatggattacatttattgatttgtgtatgttgaactagccttgcatcccagggttgaagctggcttgattgtggtggataagctttttgatgtcctgctggattcggtttgccagtattttattgagaatttttgcatcgatgttcattaggtatattggccaaattttcttgttttgttgtgtctctgccaggttttggtatctggatgatgctaaactcataaaatgagttagggaggatttcctttttttctattgattggaatagtttcagaaggaatggcaccaactcatctttgtatctctggtagaattgggctgtgaatctgtctggtcctggactttttttggttggtaggctattaattactgcttcaatttcagaacttgttattggtctattcaaggatttgacttcttcctggtttagacttgggagggtgtatgtgtccgggaatttatccatttcttctagattttctagtttatttgcatagagatgtttatagtactctctgatggtagtttgtatttccatgggatcaggggtgatatcccctgtatcattttttattgagtctatttgattcttctctcttttcatctttattagtctggctagcggtctgtctattttggtaatgttttcaaaaaaccagctcctggattcactgattttttgaaagattttttgtgtctctatctccttcagttctgctctgatcttagttatttctggtcttctgctagcatttgaatttgtttgctcttgcttctctagtacttttaattgtgatgttagtgcatcgattgtagatcttttctgctttctcttgtaggcatttagtctgtaaattcctctctaaacactgctttggttctgtgccagagattctgatatgtagtgtctttgttctcattggtttcaaagaatttattcatttctgccttaatttccttatttacacagtagtcattcaggagcaggttgttcagtttccatgtagttgtgcggttttgagtgagtttcttaatcctaagttctaatttgattgcactgtggcctgagaaactgtttgttatgatttccattcttattcattttctgcagagtgttttacttccaattatatggtcaattttagaataaatgcgatgtggtgctgagaagaatgtatattccgttgatttggggtggggagttctgtagatgtgtattaggtctgcttggtccagagctgagttcaagtcttgaatttccttgttgattttctatcgtattgatctgtctaatattgtcagtggggtgttacagtctcccactattactgtgtcggagtctaagtctctttgtaggcctctaagacttggtattatgaatctgggtgctcgtgtattggctgcatatatatttaggatagttagctctttttgttgcattgatctgtttaccattatgtaatgcccttctttgtgtcttttgagctttgttggtttaaagtccgttttatcagagactaggattgcattttttttgctttccatttgcttggtaaatattctgctatctttttttgagcctatgtgtttttgcatatgagatgggtctcctgaatacagcacatcaatgggtcttgactctttattcaatttgccagtccatgtcttttacttggggcatttagcccatttacatttaaggttaatattgttaagtgtgaatttgatcctgtcattatgatgctagctggttgttttgcctgttagttgatgcagtttcttcatagtgtcgatggtctttacaatttggtatgtttttgcagtggctggtactggttgttcctttccatgtttagtgcttcctttaggagctcttgtaaggcaggcctggtgatgacaaaatctctcagcatttgcttgtctgtaaaggattttatttttcctttgtttatcaagctttagtttgactggatatgaaattctgagttgaaaattcttttctttaagaatgttgaatattggcccctactttcttctggcttgtagagtttctgccgagagatccgctgttagtctgatgggcttccctttgtgagtaacccaacctttctctctggctgccttatcattttttccttcatttcagccttggtgaatctgacaattatgtgtcttggggttgtgcttcttgaggagtatctttgtggtgttctctgtatttcctgaatttgaatgttggcctgccttattaggttcaggaagttctcctggataatatcctgaagagtgttttccaacttggttccattctccctgtcactttcaggtgcacaaatcaaacgcaatttggtcttttcacatagtcccatatttcttggaggctttgttcgttccttttcattctgttttctctaatcttcttgctttatttcatcaagttgatcttcaatctctgatatcctttcttccacttgatgagttcagctatcgatacttgtgtatgcttcatgaagttcttgtgctgtgtttttcagctccaccagatcatttatgttcttctctaaactggttattctagttagcaattcatctaaccttttttctaggttcttagcttccttgctttgggttaggacatgctcctttagctcagaatcgtttgttattacccaccttctgaagcctacttctgtctgtcaaactcattctccgtccaattttgttcccttgctggtgaggagttgtgatcctttagaggagaagaggcgttgtgttttttggaattttcagcctttttgtgctggtttctccccatctttgtggatttatctacctttggtctttaatgttggtgacctctggatggggtctttgagtggacatgcgatttctttctgcttgttagttttccttctgacagtcaggcccctatgctgcaggtctgctggagtttgctggaggtccactccagaccctgtttgcctgaatgtcaccaggagaggctgcagaacagtaaagattgctgactgttccttcctctggaagctttgtcccagaggggctctcactagatgccagccagagctctcctgtatgaggtgtctgtcaactcctgctgagagatttctccgagtcaggaggcacgggggtcagggacccacttgaggaggcagtctgtcccttagcagagcttgagcgctgtgttgggagatctgctgttctcttcagacctggcagacaggaacgtttgtttgctgaagttgcacccacagctgccccttcccccaggtggtcccagggagatgggagttgtatctctaagcccctgactggggctgctgcctttatttcagagataccctgcccagagaggtggaatctagagaggaagtctggctatagtggctttgccaagatgaagtgggctccacccagtttgaacttcccagcagctttatttatgctgtgaggggaaaaccgcctactcaagtctcagtaatggcagacaccccttcccccaccaagttggagcatcacaggttgacttcagactgctgtgctggcagcaagaatttcaagccaatggatcccagcttgttgggctccatcagggtgggatccactgagctagaccactgggctccctggcttcaactccctttccagggtagtgaacagttttgtcttgctggtgttccatgtgccactggggtatgaaaagaaactcctgcagctagctcggtgtctgcccaaatggctgcccagttttgtgcttgaaacccaggaccctggtggcgtaggtaccagagggattttcctggtctgcaggttgcaaagactgtgggaaatgcgtactatctgggccgcaatgcaccattcctcacggcacagtccctcatggcttcccttggctaggggagggagttcctcaaccccttgcacttcctgggtgaggagatgccccaccctgcatctgctcgccctctgtgggctggacccactgtctaaccagtcccattgagatgagctgggtacctcagttggaaatacagaaatcactcaccttctgcattgatctctctgggagctgcagaccagagctgttgctattcgaccatcttgccagccactatcaaagagattagttttatattgttgagtgttcttagcacctttgttgaaaatcagttgaccacagatatataggtttatttctcaattctcagttttattccattgatctacatgtctgtctttatgccattaccatgatgttttgattactgtagcttttataatcagttatgcaaccagctatgtgagtcttatactgtttcttttttcctttctattcttttttctttgatttggttattcaatgttcttaaaattctgtatgaattgtaggatcagttttttcatttctgcaaaaaaagtcattgggattttgataggaattgcattgcatttttagtttgctttgggtgatattgccattttcacaatattgtcttccaagtccatgaatgtgaatgtttttccatttagttaggtcttctttactttctttcagcaatgttttgtagttttcattgtcaaagttttgtactgccttgattaagtttattaccaagtattttattatttttgatgccattgtaaattctgttgtaaagatggattatttcatctatatctcccatctcagttctttctcttaagatcccaatgtgcatacacagagaataaaataaattgagtagtagatttagttctaagcatcctgaaaggctggcaaaaaggaaatgagatagggaagcagggtcagtgtatgtgactttctaataaaagagaagaacttttttctggaactcaactctaggagaaaattattatgagaacttttgcattagggacatgaaataacattataaggataattttaatgttttataggaaacatatttttaatattgacaatgaataaaagcccaggggatagggttataatttagctcagtcatatagtataattgttctttaagtgtttatcctttttgttaatttataagctctgtgaaaatagcttttttgtttttttgtttttattttatagagacagggtctctctatgttgcccaggctggtcttgaactcctgagatcaagcgatcctcccacctcggcctcccaaagcactgggattataggcgtgagccactgcaccagccgaaggtagcttttttggagggagactgtgttttgttcttttcacattccctagagcaagtgcctcacaagctgtttacaaaaataatttttttctgaattctgtaattaaatatctgtgaaatttataaactgactttgaaattttagtggttctttaaaatgttatttcttgattcagagaaagaatactgtatctggataatcacttatttttaaggttttggttttttgcttgagtcttgtttgtgatctaactatattgattaagttattatacatacacacacacagcagatctaatatggcatttttttttaaccacgtacttttcttgttcctgttgtggatcaaccattatttctttgtatttagctacataaaaaaaactatcaagaaatatataaaaatgtacttttagaagtattgatttctgctcaccatcatttgtcaactttgatgttagacagctactagttagctggaattcagtgccaaatgaagtcagaggtggataggaatcttttattatgtatattttttttattttccttctccttttatttttcctcctttcctcgctatactttttcccttcaccattttttttccaccctccctgcctgtgcccatctaaagtacatacaaggattgtttagcctgtttgacaggaaaaggaaaagaattaatgtatattggctggattctcttggaattttgtgagatcagggacctgaatctgaatcaggtaacatccatgatagttattccacatccccatttgctatctgattcagattcaggtccctaataacatagcatccatgatagttattccatatccccatgttctatgttatgttgtccagctcttcccttcaggactgaaagatttatttccccagctgctaggaagattgtccactgacaggtctcatcaggaagccctctcataaaattgttgaaatgtctaacgagagcctgtcttggccaggtgccaccgcactcatgcctgtaatcccctcactttgggaggccaaggcggatggatcacttaaggtcaggagttcgtgaccagcctggccaacatggtgaaaccctgtctctactaaaaatacaaaaattagctgggcgtggtggcattcacctgcaattccagctactcgggaggctgaggcacaagaacccaggaggcggaggttgcagtgagccgagatcgcaccagtgcactccagcctgggtgatggagtgacactctatctcaaaataaaataaaataaaaaataataaaataaagctgtctttaaaaagctaatgccctttttctagggcagctcacattaaatgagttgttgatttgatgctgtaaaggcttcaccctctctcaacccaatttaggacaactctgaagggatgtcttagttgcccttttctagttactagactaggatgttttaaaagctgaggatataaacttacctaaatgtttttgtattcttttgctaatgagaaataatctttcactggtgtcatgttttgagatatttgaaagctatccttaggctcatttagctgtcacttaaaatattaagcattacataaggttaaaaaaatggaatagtggcaagagtatgacccagaaagcatgagtgaggctgaaaagaatacgaggatcctttcgatggtaattttggaagatcctatttgaaatagtgatcttaattatgtagaatttcatttccatctctatggctttagtcactgttacaggacatttttgcatcactataaaggaatacctgagactggtaatttataaagaaaagaggtttagttggctcatagttcttcaggctgtacaggaagtgtggtgccagcatctgctcctggcgagtgcctcagtaagcttacaaccatggtggaaggcaaaggcggaggaggtgtgtcatgtggcgagagccagagcaagggttgggggaggtgccatgctcttttaaacaacacaatctttaaaacaacataatcttttaaacaacacagtcatcaccaaggggatgatgctaacccattcatgaaggatccagccccatgatctagtcacctcccagcaggccccaccttcaactttgggaatcacatttcagcatgagatttggagggataaacatccaaaccatatcagtcactctgttttgtttcagagtgaatgatacttacagaatcatagtattgtaaagccctttgatttgccacttttgactagacttacacaacataacacaaatatcaaagcctcaacattgtaaaaaataatataacatgaaagtgagtgagtactaggaagagtaagtgctgtcatgtctttctcccatagagaagacagtcagaagatagcctaaacagaatctgttattcattgtggttgactccaggggatagggacaaagggaagtgtatagttttcattttaagcctttatgtgctgtataaagtttttaaagaagcatatcgtgtgcataatccctaaaaaatcaagcaaccaaaatgtagtggtgatggtgggatgtgtgtgtattgggggagggaaggaggggagaatggcttaaaaattaattcatttaaaatatttcttattttttaacttccatattttgaatcaaatgatttgcaaaaataatggattgttttataaacgcatgtaatatacatatttaagtagcaggtgtttcataaataccttgttatagaagtgcacacatttctgtgtttcagaattcaaaagcccctttgaagaaatagtcactatttgacttaccacatacgtaatgacaagaaatttacaagtataattagatttttagtgattaaattgtgcatataataattttaccaacatagtatagcatttcctttagcatttattatattgtaaatgagtgttataagcgagttataacctaaattctttaatgtaacctagttctttaacataatctaaatggtttaacataggcataggcctataatattagtaagaatagatcatatggtttagaattattttaaaatgttgaggattacttcagatcttattactgtaattccctatttgtgatgggtagccgttctgtgacctattaattgttctcttggatatgtagctgtttatgtttcagattggctgcagctgttttgatttgaggcagatggcctgaagaagcagcattcataaattaaatcacaattttttttctatgtatttttaaatcattctcagaaacctgaagtcttttcagtacagagttaatttcaaattcataatattctttgaattttcacataatatattaacttgatttttgtataacaatattcttttcatttttgtgaaatacataattgctaacttattttaacatagacatgagctaaagagaccctaattatatttttacacaaaccttatacaattatttaaattctgacccaaatagcagaatggttattacactgattctttaatcatttcaaaataggaacaattatttccaatggaattctcactttctaacttatttagttctctttttcattcattatggttttggaaagtatctgagacagctacatttattaactacactatagttaaggtaaaaagataatggtctttctcgtcattgttgaaatacccatactaaaatgatactattaaaaaaagagctaacttccttttaaggagtggtctatagcctttctcttttctttcttttttttttttttttgagacagagtttcgctcttttgcccaggctggagtgcagtggcgcagtcttggctcactgcagcttccgccgcctgggttcatgtgattctcatgcttcagcctcccaagtagctgggattacaggtatgtaccaccatgcctgtctaatttttgtctttttagtagattcggggttttgccatgttgctcaggctggtgtcaaactcttggcctcaagtgatgcacctgcctcggcttcccaaagtgctgggattacaagcgtgagccatccacgcctggccaagaactttctatttttgtataaaactttttttttaaacatagattggtacatatgtaaatgaaaagtaatattcatgtagaaagagaagtgaagatcatctagtctggcctttcagtgcttgaatttccttaaacacattaactaaatagtaagctagcttatgcaggtactgatccaatgatgagtaactctatacctctgaagataatacattccatctttggatagcattgactagtgaaaagcaaatagttatactgaatcaaagtcagcttccttgtctttctttttgtttttaacctgttggccctagattctttggggctacacagaacggtttaagcagtcttccttatgacaatcataaaatatttgaggacagcttttatgactccacaatctctcttaccattcctgaagtttcttctctaaataaatacttttggttccttcagccattcttcatatgtcacaaaggccttctctgttattcagaatatactgcagatggtctctactaggagcagaatccatgaataggattcaggaaacccatggattttgatattagtcagggttgtccagaaaaatagaaccaataggaggatatttacacatgcacatcctcctatatcccataaatatatatatatttatttatatatatttaaaatttatatatttatagatttaaaataaatatatcccatatatatatatatgtatctttgtggaagctgagaagtcccaagatctgcatttagcaagctggagaccttggagagccagtagtgtaagttccaatctgaaagctggtcagcttgagacccaagaagagaggatgtttcagtccagttctaaagctggaaaacaccagtgttgtagctcaagctgtcaggcaggaagaattcctcctattcagccttttggttctatttaattgattgaatgaggtccaccagcagtagggaaagcaatctgctttactcagtgtactgcttcaaatgttaatctcatccagaaataccctcctagatacatacagaatagaataatgtttggccaaatgtatgggcaccttgaaactcagtcaagttaacacataaaattaactatcacaaatatgaaaaatttgtatccttatatttactaacttctgaatgagagtttatgattatttcaaatcataaatttgaaaatttatgattgtaagcaacagaccactatagcaaaactgtggcttcacaacagtagaaatcacagataactttatatccactatagttgttgcagatatttggaaatattgacattcattggttcttaatgtgaatattatatataatttcctaattataagaacatatattattgaatcatgtttattttaataatatttataatgtagatatgatataaattttattgactgattggttttctctgttttcttatgcattaaattttatgcttttaagaatattattttgaaaaggatccataggctttactagactgcaaaaggggtccattgttcaagaagtggttaagaacctttggtctatactttttctaaaagtgtaattttagaaaggaatacattttatgggtgtggcccattaacactgacataggagtagagattattatctccctgcatctacataaaataaaccaagatctcattcattttttttaggcagccagactgatcacactagttggaattagtccatcttttgattctagcctggtcttttcagaatcactctgttagtgtgttccctgttctacgtttctgtcatttacaaatacaataggcatgttgtctatatcacagattaccaaacctggctgctcatcagaatcatctgaggagttttaaaaaatagatttttagttcctccctcacatttagtcagaaacattgtgcacctggtgattatgcaagctgcctggcactgttctgtgaattcatatttggaaatcccattttttatataatttatgtcatttatagtaatatttttaaaaatgttatagaagttagaattttgtagtgttgcacttgctaagtctttccaggttgacctgcagcaccctggaggttccaatgattattactttatatcattactgtaattcattcttttctgttttgaatcagtttgtttcaagaaattgagtgcatctacctaatttctctgatacgccatctaataataaatcttggcaaaaaaggaaattgtcactcatttttctagtgagttgatataaacttatactaatcactacctcttcacctgatttgtcataaattattccttaaaacttgtttgtaatcagttgatatcagccgtattgttttggtttaagtttccctaaaagtcaagcatgaaacaaggacagtagtttatttgggaagtgatcccacaaagtgggaataaggaagtggtcaagagtgagacagggaagaaggaaatgccaatataagactatagtattgtagtggtagttttgacagcagaaactagattctgctgtgacatcctgaaaagtgttcagaaagcttcctagactttctatctgaaagataggcaacgagatttatctatcagctcttgttctttattggtcaaagattccctccatcccttaacctgggaaagttaactcacccatatttccaggctgcccttgctaacaggctgagtgggacattgtagtgccagtgaaaatcctgggacagaaagtggaaagatggtgaatgcatctttgaagtggcagtctgttaatgtgaggtaaatcttttcaggaaggttcaccacaagtatgacaaaaagtggactgagggactgtgacatgggttatcagtggtacttgctacactcatcttctgtattctaagaaatctacttttttatttttataaatcaattacatttgtttgtttctaagagtctttaaaggttaccaataacctcatgtgctagttctctcagtatcctgtgactataattcattctgactaagaacttggagtgacttacctgtcttgggctttagttctggcattacaatgtttgttcagaccttttcagtttctgacagagaaaactgggacaatctaggagttaaagagttttactttctctttagtggtattatactatcttctgaaataaggctttgttgttgttgttgttctatcttggtttaatctatcaaagaaaagaaaaagaaagaaaattccttttgttgtctcttgaactttgcaagccataggtaattttgaggtttgggttttttgagttcactggttaaattctttaatttcttttcccagctctcttctaaagttcctccctccttcaagttttatgctatggagtcatggctgtcttttctgtgagaacgttgaaatgttttattaaattttaaggagatccattgaatatatctagactttttctttatttgtggccatcacaaactctgagctgacatggtcactccttgcattttctccttgattctgataagccctggaatccttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatatttgtgttttgtcaggagtctaggatccctgtttttcccctttgtttccctattcaccatccattggatcataggaaaaattaactgttaatgtaagtgaaaagtaacttagttctttggagggagagatataaaagttttgactcaggtgattttacaattacaagcatattttcagtatagatctttttgagtgccttccatgaaccacatactttattagtcaccgaggataaagaaggccaggaatattgttatcaaagaatctaataaaagagatggagatgtaaacaaatacttgaattttaatgtcgaagttaaattgaatgccctaaatgatggatatatttttttatgaaatatcttctgtaataacatgatgttctgataattcttgggtttataaattgaatcatttggtgtgtgaagttgacatattattctcagatgccaattctgatttctccatgctgaaaattacgatggtaagaatccaatagctttgatttccttaggtaaatattaggctaaacatccagtgctgtatcttcagtattttctaccaggcagaagaattgttatttttatgcctctgtgtttaaatgatagaagtaagatactttaattgaaaagagaataaaaaacaaagtatcccttttagaggatgaaaggggagcaggaactccccaggtttttaaatattttagtacataaaatatacacaacaacttaaaattgttacttttctgggaaaactgaagcacatgcaggagattttaaaaactccacttgatgttagatgattaaatagtgttttgctttggaaattgaaaagcaagacttgttataaaaatagttcattccataccaataaaatcttattggcttgtttatttttattttgtaataagatagagtgaatgtggaagcttgtgttttaagaacttcttgtcctgtttagattatgttaaataacatacaacattttttaaaacagcttttataaacaactaagactttagacaaaggaatatgagtatgtgatgaggcttgacccaattaggtaggcaaaaactttaaaaaatatttcatggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagctctcatgtgtattatctcacttgatgtctcaataacctgagtgtgtagatattattattgctatgttataaacgacattacttaaaagaactctgtagtaaatcctttggaaaaataaatagtgttttggaatgtgagcatgcattcctcaatttatctattttatacatatatacttttgtatatgacaacgttttgttaaatatgctatttctagccaggtgcagtggtgggtgcctttagtcccagctactcaggaggctgaggtgggtggatcgcttgagcccaggagttcaagtccagcctgggcaacattgcaaggctccatctcttttaaaacaaacaaacaaacaaaaacagctatttttaggtctcttcatcctttattatttttatgaatgtcgccattatcttttgtgtctgctcagatttgaactctataggctcttttggctttgctccccttcttctctttcatgccctcttcaaaccaggaagttgcacagtcttggaaggacaatctctgtaatatttctcccattatctgttgtactttttgagctcaggactgagattgaaatttttctgaatgagaagaaccaccctcaaccacgattactgaacactgagtgactttggaagttaacttttgctgcagacttgataaatccatcctaaagttacaaggaataacagtttaaatgcaaaaatcatgttatagtaaaagtcattttgatgacaatgaatgttgtttgagtcacaagtaatgtcaagccactgtatatgtcacatcttgtcaaaagttaaaacaagaagttagatgtccattcccacacaaatttatggcagatacattttctagataaaattatagttctagcagcagttttcaaactaaaatacaagttagggattttccgtatttcaaaatctgtttaactgtgcaatcaaggaacttccaggtaactgtcaactggaaatgattatttacagtgtaatgacctgctaaaagtcaggagaagaatctaatagaattttataaataccttgtaagtgaggaatatacttaaataaaataacgtgcctgtggactggtatcaatatttggcagtgcttgtctgcgtgaaaagacattttcaaaaatgaaatatgtaaaatctcattacagatgaacattaacagataaacgttgattttgatgatagagaacaccagctttgagtcccaattaaaatgaaatactctttccccaaaagaattccattcttctcattggaagacccacattacaaaacattatattcacattattatattttgaattttgtcgataaaaactttatggaaatatatttgtattgtactaggtacctacataataaccttgattttgtctcttgggcattaaagtctaaaatatttactatctgacccttatatacaaagtttgctaactgtgagctaaacaattattcattcttttaagtgagctcatacctatcaaacacagagaaataagtctctactggtagagtttcaactattagtgttgaaaaaataattctacatcattcccagaacagactttagatgattatttactccaacttaacccattttacaattattttacaattaagaatccttattttacaattaagaatccaaggtttaatggaagctaaacattggtataactgaaaatggaactgagatattctcattttccatctagtgttctttctagtgaactttatttatatgcaagtgtttctgctggatactaagaatgataaaaaagaaatatgagaaatggtgtctatatcaagatatattataatctagttggggagtgtatcagtcagggtcccagcaagaataatacactccaatggactagttgagggtcatttaatgacagactatttataaaagggtggagagagttttgggaaataggcttttgccatcgaagcctaaagagacaaggggtggctataggagaggcccctcaagaggagctgtggcttttggtggaggaatccaactactgtcaacccacgctgtccagaaaggaggtgataccccacctacaaataccttgacctcattctcctcctgccctttcatctcctgctggtgcctcccgtagtcctaatcctgccaaaagccacatggcaaataacctttggatggagtccaaaaaggttagtctcctaaggaaaactgcgagttagagagtggatctgaagggacaaatggagaatatccacctcagagagcaggattacttgtatggtaatagcacatggtaacatattctaagtgcatgagcaatctggactacatatacttaatagcatactgacacacaagatatcattttaagtgcttattttttttttttattatactttaagttttagggtgcatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcaatagtttactgagaatgatgatttccagtatcatccatgtccctacaaaggacacgaactcatcattttttatggctgcatagtactccatggtgtatatgtgccacattttcttaatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgctgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccacttgttgatggggttgtgtgtttttttcttgtaaatttgtttgagttcattgtagattctggatattagccctttttcagatgagtaggttgcgaaaattttctcccattttgtagggtgcctgttcactctgatggtagtttcttttgctgtgcagaagctcttgagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccggtttcagctttctacatatggctagccaattttcccagcaccatttattaaatagggaatcctttccccattgcttgtttttgtcaggtttgtcaaagatcagatagttgtagatatgtggcgttatttctgaggactctgttcttttccattgatctatatctctgatttggtaccagtaccatgctgttttggttagtgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttcttcttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatccttctcctgcctaattgtcctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatacgtcccatcaatacctaatttattgagagtttttagcatgaagggttgttgaattttgtcaaaggctttttctgcatctattgagatagtcatgtggtttttgtctttggctctgtttatatgctggattacatttattgatttgcgtatattgaaccagccttgcatcccagggatgaagcccacttgatcatggtggataagctttttgatgtgctgctggattcgttttttccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgactggaatagtttcagaaggaatggtaccagttcctccttgtacctctggtacattttttaaagtacattctttatctgcacaacaagtttaaatctgcaccacattcctttttacactgacatctggaacaaagttcagtctaattgtagttcagtagtagttcagttctaaattggtaggccacttctgctgctgcataaagttgttccactgtctatcagaagtagtttttttttttttttttttgagacagagtcttgctttgtcgcctggttggagtgcagtggcgtggtctcggctcactgaaacctccgcctcctgggttcaagtgattcttctgcctcagcttctagagtagctgggactacaggtgtgtgccaccacgcccagctaatttttgtatttttagtagatacagggtttcaccatgttggcccagatggtctctatcttgtgaccttgtgatctgcccgccttggcctcccaaagtgctgggattacagatgtgagccaccgtgcccggctacagatattgttttaagtggtttagagctcagcttcaggaggaggctaagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatagattttgtagttagagaaaccacagtatgattctggctctgctactgccttgccctgtaagtctgggcaagttgcttagacttgctcagccacagtttatttaaaagtgaggacagccacaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctataatcaaagtaggaacaaatcagacctcgacctcctggagactgaaggtgcataatttgcatctgatttatattaataattgatgaattagtaaacagttcctgtactgacatatgtgctgccagcctaatgggttacttagttatcctcattgaccatcagcataccaaaaagactaggatagtttaaaattgtttttcttcaaaatcaagtttaatggggttcttatttaatatttcaaagtacataatatattcacatggttcaaaatgcaaaaagtggaaacagtcataagttgacaattctctttcgcattgcttagttctcaacttaccccacaaaagtaaccactgttctcagtgtgtatacatattcttttggaacattaaaaaaattgacatcacagttgtacatatttctgtggtacatgtgatattttaatacttgtatacattgtgtaacaatcaaatcagggtaattgggatatccatcacctccaacatttatcttttctttgtgttgggaacattacagttcttctctctagctattttgaaatatacaataaattgttcttaactgtaattttcctgttatcctatactagaacttattccttctaggatttttttttagttgtcttgtgttcaagaattagcacaatttatcattgtgctagactctttaatcacagtaaaacactagacttgtgtatttgcttcctaataaacgagcagcgctattaatatagaaaaaagaccgttgaattaaaaatagaagtctttaaaaattctagtagtacattcatcattgaaagactttaattatcatctgattttcctttctatgccatttggaattataaatggtaattttttctttgtgtggcactaccaaaaagtgcaatgtttgggaaaataagttatttcacattgaacagtagttagacattgtgctcagtttagataggattacttgaagcttggttttgatttgtcagtttctttagcttatacctgccattttgtagtaacagtcaattcagtattatattattctcagattttattattttatgctattttttacatgaacaattagtatttaatggtcctttgtaaagttttttctcaaaatgtagtgttaatttgtctgcatgtttaaagtttattggaaaagttattttgcctattcagagcgtaaaacttttagtacattttgttttataagtataggataccatgatgatccctggggaatctgattttttttaacagacaagaggttcccagttttcatttttaaatcaagttgctatggggctagcatctttgtttgcttaattttaatcacaattaccatgacaaaacttatttatttagctaatgcctaacagtgtcaaatgtatactgctggaaactggactaatttctatctgactaataaaaatcccaaataaaaatggtacatttttattttaaatggaaaaagattagtttctgaatataaattgagtttttaagtttttctttttggttaattaaagtctactctgatgcttttttgttaattttctttaatatccatatctcctaaatttaatatgcagttctaaaataaagacaagtcagctgggtgtggtggttcatgcctgtaatcccagcactttgggaaactgagcctggcagatcgcttgagcccaggagtttaagaccagtttgggcaacatggtgagaccctgtctctacggattttatactttttttttttttgaaatgggatctcactgtattgcccaggctggttttgaactcctgggctcaaatactcctcctgcctggtactacaggcattcaccaccccacccagctgattttgtacttcttgacaggaaaagaaaaatgaacaagaaattccttaatgcatattttaagtgctgctttaaaattttatcagtacagctttagaacatcacgctagataatagtgttgtactgttatttcctttttaatttattaagaaaaaggaagatgcaggggaatgaatctttattgaactttcctggcctgttcaaggaatagtaaataaaccaacttagctggaggggagtggagagggccttgtaggccattgttaaaaccttaggcttttactcaggttgagatgagaagtcactggagagtgttgaacaaagaagtgacattatgtgacttaagctttaagagggttgctttgctctgttgagaatagattctacctgggcaagaaaggaagcaaagaatatttaggaggctttggtaatgatttgggcaagagagcatgatggcttaggctagagtgggagcaatgaagatatgataaatgtttatattctgtacatattatgaaagtagagataacaggattttccagtgtgatgtgtgagaaagaggggagttatatttttggcctaagccaaggtaatgatgggattcccactaactgagatgagggaagactatggggaggaaggtcagttcagttttggacatgttaagttcaaggtatctattagacagccaactggagatgttgagtaggctattggatatataattcttcagctcagagaagaagatacatatacatttgtgagtcattagcttattgaaggtatttacacccacaaagctaagtgaaatagaaaagagaagaggtccaagggcagtgggggtcacagcaatgttaaaacatcaaaatggtaagtaagactcagagaggagactgagaaatagtgtccagtgaattagaaagaaatctggagaatgtaatactccagaagccaagtgagaaaaataatttcagggaggaaagagtgttagattgtgtcaaatgatgatggatcagaagtatgaagagtgagacttgaccattggttttaacaacattagagacctcatcaagaacagatttaatgaaaaagtgccaaaacctgattagagtcaacttaccagagaatgaaaggagaagaactagaaacaaccaataaagacaactcttttgaagaattttacagagaaatgagatagtggccgggtgaaagtatgatcatgataaaggggtgtgtgtgtgtaatgaatgtgagatgtgagaaactgcagcatgtttataatctaattggaatgatttagtagagaaaaaatgatgatgagagagagaattgctgctgaaatatcttcaggtagggaagagggaatcgaatctactacatttatggaaaagtagctgtaggctggagcacagacagttcatctgttgtgacagaatgaaatgccaggtatatggatacagatattagaaggtaatatgatgatttgataaataaaaacaaggtctaggtagatactttccatttttgaaagaaatgtgttataaaaattattaccattttagcatagtggaaaggaatgaaattggagggagataaacctgggtttagattttagctctgccaattactagctgacatgtggcagaacttagttacaatgcccctgtattatttagggacccagcaagaaataaaattcactaaaaagtggttcaaataaaaacactttaatgaagagtctactttgagagaatgaacagagttaaggaatgggcaagatatggtaaggcaactagaaactagcaattatggaaagctgttacctcacctggggctgaagaggcaagagtggacatggtgtttttagtttagtgattgccaaaggtatgaaggaaggaccagctagtaagagctatagttgtggaggaacacagctgttgccagagacaatggtacataggtaaggaagcagcagagaagaaataaccttgatctctctctactcctcaactctatttttctgctattgacctccattggctaaatgtaagcagaaaccagctgcaaggcttcttaggtgttgcagaatatagggttcactctccctagggtccagagaagggcaaaagatggatgtggagacaaatgctgagtaatcagtagaatcactaagcctcaacttctccatatataaaatgaggctaccgcaaagttgctgtgatgttacatgtactgccaagcactgctacattgctagcatatagtactgtttattaaatgacaaatataagatgctacagcataatggttggtccttaaagctttggaattaggcagatctagatttaagttctgtccgtcacttactaatcatgagattttgggaagtctttgttttgtcatctgtaaaatggggaaataaggcttaccacagagaattctaataaagatgaaaagggacagtgtatattaagtgcctaatatagtgctggtacacagcatgcagtttaagttaccatgaccatcataatattatatgactagaaagaatagtaaatgacatcagtttccaagtaatactagtctcctacccctccccctccccccacactttttttttctgcttctcagtttttctgaatagggttatttctttgttacatagggttcaaggttaatatctttgcactttaaacaattaggaaatatagctttagttagtttaactttttggctattcatttattttgtttttgatttatgttcgctaaacacacacaaagagttaagtggatttttttattaggcctaagttggaaggcatagaaaaagttggaaacactgaattcagtcagtttcattagcatagatttatatatgaagctcaagtaaaatgtcatcaagaaatgggagaatataggatgctgtaacagttaattcagagccgtactataataagtattctttttaaatttcacataaatataacagttctgtaagcttgatttgagggcacatacatgtttttctttttggctacatagagaacaatgaaataaagcctcattgacgtaattgaacctgataacatctcctggttgtactgctgatgtttcactgtggttttggtggttttgtagagctccgtagagcgtgttagacttaaaaacatattcaaacagaaacttttatcaggattcaactttttaaccataaagaaaaaatgaatgtaaataaaggtgcagtcttgggtacacctagatcaacttaaaaatgtttaatagtatatattacttagagaaattactgttccttaattagttttgaacaaataaccacagtatgaaaagaaataataatttctggtattgtattatatattagcacagaaggaaagaggtaaatataataatggaagctcctaaaaacagcaagttaaaattttatgctttcattaaatgatgtcttatagtttgatagaactacatgtttaaaacataccatagcactataactttttgttttaaactgggattaaaaatttaattttatttattttatatatatatttataaaattcttatatttaagttatttacaagatctactttggtattgggtttagatgcctaaaactttgctgacttggaaacaatgtgtatcagagcatttactgtctacttggaagtaaaattttaaaagagctacattttattatataggaggaatgagtgcttgaaccagtatttcttaaaagttttaatatacatgtaccgccaactatgcattccgtatgcgtggtagctacccaccaacttaaggtaaatgtataaaaaagaattaatcacaatttttgaaaactaaaaaattaaaatattttatatcagtgtatatttacaatattaaaggtatctctgtttagctcaatgttgagtaaataggctgcttgttgtaggttcattgtatatcgtcatattcttttctcatctctatttctcttaacttggaaaaatccaaccaaaattataatttatgaggacagtcagcaggggttttttggctgttggttctgaatactcaggttaaacatggactccagaattaagagattgctcactgaagactctttcaaggctgagtcacttgctaagttgatggacattatcatacttgaaagtttaagaaatagaggcttttgcattttattgaaaaaagctctttttgctctttatattttatatttacttttaaatattttatttgctcagtttttccaaagcacactgaaaagatgtatactctgtatccaaaaattgagtgcatttacatttatgctatttctttaacattgaactcagcataatgtattttaaccaccagcctctttctgtgaaaacaaacaaacaaacaaaaaaaaaacagggtatatagatttgcagttagtgtagtactcattgcttagcaaggctttttcttgatgtgcagacaactgattttttctctcaggactgatttcatcacatatttcccagtctatatcatagtttacaaaacaaatattaagtaggaaaaaaaatcatgttttgtagtatgaatttttcagaggtaaacacaaaaacttgtctgctattcttcctcaagtgtattacacatataccaagagctgatttggctttgcacttcagtgcatttatcaagcagtaaagtaaaatatctggtttttctttcagcataatatttatcgtttgtgtggctgagagttttataaatctctcagcaatagtctatcttttttatatgcttttgctaggaggagcacagaatctgaatggtgcctgtgtagtttttgtctcttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattagagtcctattcttgatttaggttcaacatttattccgagctatttatgttaccctatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctgggacaatgaggaacaactagtgattgacagatcataatttgataaataatggctaatattctattacaatttcctagtttaaaattttatgtttttaaaaatatcatatatatatttttttcgtgtatacatatatgtaatctaatactacggagacacttagcagtattttcattaagtatttgctctttgcatatttctcactttattctgtcattagttctcccactgttcaggatcattcctatcaagtacaagcatgctttagaacctaccatgttaaaaaaaaaagtattattcccacatttttttctgatgattgcttcatttcattcttgcctttacagcacagtttttcaaaagagttttctctagtcactttgtctacttccttaccttcctaaattcatcttaacttttactaaagctgaacaaatatttatgaaatatgtgtaaagtacagagactaaagaaacagacaccatcaacccaccattactggtgtttttgaacattaccattaacattgaagttccctgtatgtcactcctggatctggttcacttctttttcttttagagataatcaccatcctgaatttctttacagtttaccataagtatttctaataagcatatcgcaatgtgtatttcatgttaaatgagtgaaggtatactgtatgtatctgtctgtgacttgtttttcttgttcaacattatgtttctgagatccatccatatacgatgtagctgtatgtacttcattcattttcactcctatactccattgtatgaatacatcaaaatttttctattttattgttgatgaacatttgggttgtatctagttttttgctaccctaagctgcacagctatgtgcattcttcctgtctccttctgtcaaactgtagcaaaggaccaagcttttgggtttttccctgatctgttgtggattgatgcttttgtaaaatacactaaaaatgtctcaccattgtcaaattgctataaaaatatataaacctttactctgaatttctgtatttatcttattatggaccacactttgaatactgctctaagatgtgtacctagctgtggaattcctgggtcattcatcttctattacttatggagaaaattgttttctcaaaatcactaatgtgctacttgctcaaattacgcagaaggcagtctgctagctctttgtggctttctgtgtatctgctttcaattcctaatatgaaggggatttcacagtaagacctgctgctttagggtaacatagttttcatcctagagaaagtgactgcaaataagattgggctttgcttaagaattgattcaaagccaatctagcaagcacaagtgagagaaaactatgataatgggataaagggccaggaagagtgaatttattgagggagatggtctgtaatattgtaatactacaatattgtaatgtacaatattgagggagatggtctgcaatattgtaaaaatataatattgaaatattgtaatacaaaatgctacagtagagagatctaaagagagcaagcagagaaaaaagaagcattgtacatagtaagatttttagagacctttaagagtccagttaaaatagggcatacattccttctcatattagcagccttccttctgcataggcagcctttaattgtctaaatgcattagagaactttcacaaaatataagctaagatgagattgctcttataagcaagcagcaggactactttttatcagtgtttctccaccgtattttgattacaactccgaatccagggatatatatatatatatatttatattgtatatacatatgtaaaatatatgtacatatattaaatattatatatacatatattatatatatgtttccataatcatctcccccttcatgtaattttcataccaaagatgtacagtatatctgtttgtatactgtagcctttggagggctacgaaccattttaattttcaagattttttttttttttttgccccaagaaccagctaccacttgcttggaagtgatagcaccactgttgagagtatatcacatgaatacaaacatggctcttggcattagagtacaaatatttaaaaaggtaatgtttatttaatcatgtaggtcaatgaagtggggaaggcagactactcaatgttaagaaaccatcctaatgaaaagtatacttgagttagccagaaatcaacttctacttagagttgtgagtcagggaaataaggtatacaagtatttgtctctgtttgatggtattattgtgggaaaagtgtagaaatgtggatcagatgatagtacagttaaaaaagttagcagaccaagaatgccaattagttcattgatgcctatctcataggtgatttttagtgatatatcgtatggctctgttttcactcctgtctattctagacatctattcgtgaacttaagaaaacatcagatttatagatgttatgataatgggaggaatggagaatagggtagttgacattctcaatctccaaagaagctgacaggctaaaataagggcagaagtaaagtattgcagttgggtctaaaaagccatatttataagaatagcatggaggaaaatggatcataacaatatcatgtataaaagaaacttagggattttaggttatgttaatcttaaggagcattttaggaagctattaacatcttaatttgcaataattagtgtctcttgaatctagattatatgctgattaaatcacaacctgaaataattatatcaggaccacatttaggaccatataaaatactgcttaaatttaatgagtctgttatatatatggtatactttgcatgcagttatatcagagccattttgtgggcactggttcacaagtcttctgagtgattgtactgtgtctgaattttctttgggaagaaatagatttttcctcagtggtaagaaagaaattacgttctgcaaggatattgatgaggagatggtgataatgataattgacagttttttgagtgattaaacatgggtgtattatgtaaaatatgagtcagcaaactgtagtccactgaccaaatgctgccagcagactgtttttgtatcacctttgagctaataattttttttgcattttaaagggttataaaacaaaaacaaaaagcaaagaatatgccatagagaccttatgtagccagcaaagcaccaaataagatcttttgcaaccagaaaacttaagcctgaaggacaaaaaacaacacaaatagttcaatatatagaaattatgagattatattacagattaactgggctcatattcaatacaggttcaaagctatgtacaaaatggctattagaatgaattatttaagcaaaagaagacctatttaactcagtaaatgtcaaagaaatttaggattgatgataggtagcagttatagcttcctaaattaaagttaattttatctccttgggcatagtgactactatattgggttgggaagcagccaaaaagcttgttaggaagaagggcaggaaaaaaactagtctgggactaaagttaccattgataagctaggctatcaaggagacagacaggaaaacaatcactaattatgtgcatatcaaaaggggtatgtgctgcttttgataagtctattcttttatacttaatctaaccccaaggacaacaagcttttcaaaatgtttttgacagaagtaccttattggtaggaaaatagcatcacccatcacccatgatgagcctttggagatggtgggtaggcagagaatatctgatgatatgtaatttttcttttattttttgtgacttaatgtgattatggatttatattttcctttttgtggtagtatttgaaggttaatatggcttgttttagttactttattgtgataattctttattcttttgatttctcaattatagattatattaatgaaatattctgtcgagataatttttattttcaccattccaatatctcttccagattttgagctatattagataattataattgaaaatgctgaattttgtctttacatatacttttttgtttatttttggtttgtaaccaagtgaatttttttttctagatgattctttgggattgggacttaaaacaatggtataagcctcattatcaagtaagtataattaatatctgtgatgaatatctaaataatatctgtgatcactaaataatatctgtgatgcaacttttgacacttaaagttacactcacaatatttctgtgccataagattttctttaactaaactaataagttaactagaaccttcattgaggtagattttttaaaaatatattttaattataagggaaaaagaaaatgataaaaacaaaatttatataaattgttatgaaaaatattgctaatataatctgggctcagaatcaactaatatttctatattaaggataagatttttttcttttctgatgtggaccactgttctataaaggggaaaaaatagatggaaggccatatctgagacaaagcaaagcagttggcaacatattttattagggaagtaaagatatccaactttcattttttggtaaactttttatcaaattataacatacatgcaggaaagtgtacagctcaattttcagaagttaaacatcccatgtaactggtactgatatgaagaaatagaatgtttccagtatctcagaagcctcacatatgcccaattccagtcattacctatatccccaaagataaatcctatccgacttctaataactagttttgctaatttttgaactttatatatacacaaatggaataatatgtgtacttttttaggattaattttttgaacacctaagtaatatatgtttatatcagataaaatgaaaatagaagtatttaatataaggagaaaaaaggaaaatcactcataaaacatcaagcaataactgtgttaacttttgatgtctatctttattgatctttcccattatgctaaatttacttaataattctaatagcttatttgaagattctttgagtcttgacgtacacaaaaatgttatctatgaataaagacagatttatttatttatttcaaaacctatgccttttatttctttttctcatgttattgtactttctaggaccttcaacgcagtgttgaatggaagtggtatgagtaggcagccttgtttttcttcatgaactcagggaaaaaatgttcaacatatcaccactaatgttttttgtagataccctttagcagattaaggaagttttattctaattctagtttactaaggactttttttctcttaagttatgagtgggtatataattttatcagatgctttttctgcatctattcaaatgattcgagatttttttctaattattctactaatgtggtgaattacattgtttatgtttgttaaaccatccctgtattcccagaataaagtaaatttgatcaagatgtattttgtttaaatatttatcactagattctatttgttaatgttttgtttagaaattttgaatttgtgtttatgagagagtgttggcctataaattcttacttttcataatgttcttggcattatattggtatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctaccttttgccgtccccagtgcttctcattgcctcctttgtcctcttctccctcccactcctcttctttttcaataaccatttaaaacataaaaactattcttaactttctgttcaacaatcaagattttgctaaatataagtgaatggaaaataggaatttaagttcagcttttaaaattgtggcaaataatttgaatattcaatttgatctgccataagttatcatgtcactctcttgctcatttctctcgtttcacccagtgtaaaagtctttgtcatgtacgtaaaagaacttacacaacatggttccctcccttactctcttgtacttctctgtctttgtcttctactactttctccttcatttactctgttccagctgcactggcctccttgttattccccaaacaagtcagacaggcttctgactcaggtctttgcacttgctagtctctctgcctgggatgcttatttcccacactttgtcatgtctttacataagcatttccttcttagtgaggcataccccaactatcctctctaaaattgcattgcgttctatcacatctttttcccttaacttactttattttctctttttagcagcttgttcaaaatctattatatacgaccctttattactcatattacttagcttggaatccagtgttctcaaaaatttggtcccaacatgtctttccaacctgtttttcattgctttcttatataatctgtacttcaacaatttcatattccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacaggcatgtgccaccacacctggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgttcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataataaaaaaaaaagaaaaaaaaattcagacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtatcttgaaacaaatggaaaaagaaagaaaatattagcaaaagaaatataaattataaagaagaaacaaatggaaagtatagagctgaaaaatacaataatagaaatttaaaattactggatgggatgaataacagtggagatgacagtaggatagaatctgtgagcttaagcatagatcaatagaatttagccaattttacaacatagaggaaacagaaacaaaatcagcaagccttagggacctattgggaagtaacaaagaaccaacatttgtattgctcgtgtttgagaaggagaaagggggtggcattgaaagagtatctgaagaagtaatggctgaaaacttcccagatttagccaaaaacttaatcctacagattcaagaagctttctgaaccccaaatagtatcaaccccctcaaaatctactctcagacatgtcataattaaacttatgaaagctaaagacaaagaaaatatcttaaaaagcatccagagagaaacaacacataacctataggggaacaccaattcaagtaatagcagatttctcatttaaaaccatgaagcccagaaggaagtggcagaacacttttgaagaggtggaagaaaatggctgtaaagtctatatccagcaaaagtattctttaagaatgaaggggaggaggttccaagatggctgaataggaacagctccagtctacagctcccagcatgagtgatgcagaagatgggtgatttctgcatttccaaatgaggtactgggttcatctctctggggcttgtcagacatggatgcaggacagtaggtgcaacccatggactgtgagccaaagcagggtgaggcatcacctcacctgggaagcgcaaggggtcggggaattctttttcctagccaagggaagccatgacagacggcacctggaaaatcgggcaactcccactgcgcttttccacctaatactgcgcttttccaacggtcttagcaaacggcacaccaggagattatgtcctgtgcctggctcggggggttccacacccacggaacctcgctcattgctagcacagcagtctaagatggaactgcaaagcagcagcgaggctgggggaggggtgcccaccattgctgaggcttgagtaggtaaacaaagcagccctgaagctcaaaatgggtggagcccaccacagctcaaggagtcctgccggcctctgtagactccacctctgggggcagggcatagctgaacgaaaggcagcaaaaacttctgcagacttaaatgtccctgtctgacagcgttgaagagaggagtggttctcccagcacggagtttgagatctaagaatggacagactgcctcctcaagagggtccctgacccccgagtagcctaactgggaggcatctcccagtaggggctgactgacgcctcatacggccgggcgcccctctgagacgaagcttccagaggaacgatcaggcagcaacatttgcctttctgcaatatttgcagttctgcagtctgcactggtgatatccaggcaaagagtgtctggagtggacctccagcaaactccaacagacctgcagctgaggttcctgactgttagaaggaaaactaacaaacagaaagaacattcacaccagaaccccgtctgacgtcaccatcatcaaagaccaaaggtagataaaaccacaaagatggggagaaaccagagcagaaaagctgaaaattctaaaaatcagagtgccccttctcctccaaaggaacgcagctcctcgccagcaatggaacaaagctggacggagaatgactttgacgagttgagagaagaaggcttcagatgattggtaataacaaacttctgtgagctgaaggagaatgttcgaacccatcgcaaagaagccaaaaaccttgaaaaaagattagacgaatggctaactaaaataaacagtgtatagaagactttaaatgacctgttggagctgaacaccatggcatgagaactgcgtgacacatgcacaagcttcagtagccgattcgatcaagtagaagaaagggtgtcagtgattgaagatcagatgaatgaaatgaagcgagaagagaaatttagagaaaaaagaaagaaatgagcaaagcctccaagaaatatgggactatatgaaaagaccaaatctacgtctgatgggtgtacctgaaagtgacggggagaatggaaccaagttggaaaacactcttcaggatattatccaggagaacttccccaacctagcaaggaaggccaacattcaaattcaggaaatacagagaacaccacaaagatactcctcgagaagagcaactccaaaacacataattgtcagattcaccaaagttgaaataaaggaaaaaatgttaagggcagccagagagaaaggtcgggttacccacaaagggaagcccatcagactaacagcggatctctcggcagaaactctacaagccaggagagagtggggtccaatattcagtactcttcaacaaaagaattttcaacccagaatttcatatccatcccaactaagcttcataagtgaaggagaaataaaatcctttacagacaagcaaatgctgagagattttgtcaccaccaggcctgccttacaagagctcctgaaggaagcactaaacatggaaaggaacaactgctaccagccactgcaaaaacatgccaaattgtaaagaccatcgatgctaggaagaaactgcaccaagtaacaagcaaaataaccagctaacatcataatgacaggatcaaattcacacataacaatattaaccttaaatgtaaatggattaaatgctccaattaaaagacacagactggcaaattggatagagtaaagacccatcagtgtgctgtattcaggagacccatctcacgtgcagagacacgcataggctcaaaataaagggatggaggaagatctaccaagcaaatggaaaaaaaaaaaaaaagcaggggttgcaatcctagtctctgataaaacagactttaaaccaacaaagatcagaagagacaaggccattatataatggtaaagggatcaattcaacaagaagagctaactatcctaaatatatatgcacccaatataggagcacccagattcataaagcaagtccttagagacctacaaagagacttagactcccacacaataataatgggagactttaacaccccactgtcaacattagacagatcagtgagacagaaagttcacaaggatatccaagaagttaactcagctctgcaccaagcgaacctaatagacatctacagaacactccaccccaaatcaacagaatatacattcttctcagcaccacattgcacttattccaaaattgaccacatagttggaagtaaagcactcctcagcaaatgtaaaagaacagaaattataacaaactgtctctcagaccacagtgcagtcaaactggaactcaggattaagaaactcactaaaaaccactcaagtacatggaaactgaacaacctgctcctgagtgactaatgggtaaataacaaaatgaaggcagaaataaagatggtctgtgaaaccaacgagaacaaagacacaacataccagaatctctgggacacatttaaagtagtgtgtagagggaaatttatagcactaaatgcccacaagagaaagcaggaaagatctaaaattgacaccctaatatcacaattaaaagaacaagagaagcaagagcaaacacattcaaaagctagcagaaggcaagaaataactaagatcagagcagaactgaaggagatagagacacaaaaaacccttcaaaaaatcaatgaatccaggagctggttttctgagaagatcaacaaaattgatagactgctagcaagactaataaagaagaaaagagaagaatcaaatagacgtaatgaaaaatgataaaggggatatcaccaccaatcctacagagatacaaactaccatctgagaatactgtaaacacccctaagcaaataaactagaaaatctagaagaaatggataaattcctcgacacatacaccctcccaagactaaacaggaagaagttgaatttctgaatagactaataacaggctgtgaaattgaggcaataattaagagcctaccaaccaaaaaaagtccaggaccagacggagtcacagctgaattctaccagaggtacaaagaggagctggtactgttccttctgaaactattccaatcaatagaaaaagagggaatcctccctaactgattttatgaggccagcagcatcctgataccaaagcctgccagagacacaacaaaaaataattttagaccagtatccctgatgaacatcgatgcaaaaatcctgaataaaatactggcaaaccgaatccagcagcacatcaaaaagcttatccaccatgatcaagtgcgcttcatccctgggatgcaaggctggttcaacatacacaaatcaataaatgtaatccatgatataaagagaaccaaagacaaaaaccacatgattatctcaatagatgcagaaaaggcctttgacaaaattcagcagcccttcatgctaaaaactctcaataaattaggtattgatgggatgtatctcaaaataataagagctatgtatgacaaacccacagccaatatcatactgaatgggcaaaaactggaagcattccctttgaaaaacagcacaagacaggggtgcctctctctcaccactcctgttcaacatagtgttggaagttctggtcagggcagtcaggcaggagaaagaaataaaaggtattcagttaggaaaagaggaagtcaaattgtccctgtttgcagatgacatgattgtatatctagaaaaccccatcatgtcagccccaaatctccttaagctgataagcaacttcagcaaagtctcaggatacaaaagcaatgtgcagaaatcacaagcattcttatacaccattaacagacaaacagccaaatcatgagtgaactcccattcatgatggcttcaaagagaataaaatacctaggaatccaacttgtgagggatgtgaaggacctcttcaaggagaactacaaaccactgctcaacgaagtaaaagaggacacaaacaagtgacaatactgcccaaagtcatttatagattcaatgccatccccaacaagctagcattgactttcttcacagaattggaaaaaactacttgaaagttcatgtggaaccaaaaaagagcccacattgccaagacaatcctaagccaaaagaacaaagctggaggcatcatgctatctgacttcaaactatactgcaagcctacagtaaccaaaacagcatggtactggtaccaaaacagagatatagaccaatggaacagaacagagtcctcagaaatagtaccacacatccacaaccatccagtctttgacaaacctgataaaaacaagaaatagggaaaggattgcctatttaataaatggtattgagaaaactggctagccatatgtagaaagctttaactggatcccttacttacaccttatacaaaaattaattcaagatggattaaagacttaaacgttagacctaaaaccgtaaaaaccctagaagaaaacctaggcaataccattcaagacataggcatgggcaaggacttcatggctaaaacaccaaaagcaatggcaacaaaagccaaagttgacaaatgggatctaattaaactaaagagcttctgcacagcaaaagaaactaccatcagaatgaacaggcaacctacagaatgggagaaaattttcgcactctatccatctgacaaaagggctaatatccagaatctacaaggaacttaaacaaatttacaagaaaaaaatcaaacaaccccatcaaaaagtgagcaaaggatatgaacagacacttctcgaaagaagacatttatgcagccaacagacacttgaatgctcatcatcactggccatcagagaaatgcaaatcaaaaccacaatgagataccatctcacaccagttagaatggtgatcattaaaaagtcagggaacaacaggtgctggagaggatgtagagaaataggaacacttttacactgttggtgggactgtaaactagttcaaccattgtggaagacagtatggtgattgctgaaggatctggaactagaaataccatttgacccagccatcccattactgggtatatacccaaaggatgataaatcatgctgctataaagacacatgcacatgtatgtttattgcggcactattcacaatagcaaagacttggaaccaacccagatgtccatcagtgatagactggattaagaaaaagtggtacatatacaccatggaatactatgcagccataaaaatggatgagttcatgtcctttgtagggacatggatgaagctggaaaccatcattctgagcaagctatcgcaaggacagaaaaccaaacaccgcatgttcttactcataggtgggaattggatagtgagaacacttggacacaggaaggggaacatcacacaccggggcttgtagtggggtgggggagtggggagggatagctagcattgggagatatacctgatgtaaatgaggagttgatgggtgcagcacaccagcatggcacatgtatacatatgtaacaaacctgcacattgtgcacatgtaccctagaacacaaaatataataataaaaaaaaagaatgaaggggaaaacattgtgaaatgaaggaaaacaaaagaatctgtcagtaagagatttaccttgcaagaaagacaaaaggaagttctttaaaccaggcgtcaccaaccagtaccggtctgtggcctgttaggaactgggccacatagccggagatgagcagtgggcagatgagcattaccacctgagctctgcctcttgtcagatcagccaccacattagattctcataggagcacaaatcctatggtgaactgcacatgcaagggatttggggttgtacgctccttatgagaatctaaggcctgatgatctgtggtgaacagtttcattctgaaaccatctcctcgcacccctacccagtctgtggaaaaattgtgttccacgaaacctgtccctgatgccaaaaaggttagggaacccctgctttaaacagaaaggaaattataaaagaaggactcttgaagtaacaggaaggaagaaagaacaatgaaacaggaagaaatagtgggagaatgcaatagactatccttcttgtgagtttcatgaatcatatttgatgattgcaacaaaaattataacatcatctgatactcaagacaagacaattatacttaaaagtaagcaaggtagagacctaactagtagtaaggttttcacacttcactcaaagtggtaaaatgttgataccagtagacggtgataagtcacatatgtacattgtattgccaagggcaaccgctaagaaaactttatatagtaatacactcagaaactctataaattaatcaagatggaatcataaaaatattctaataaccccagaaaagcaagaaaaaacagaggaacaaggaacagaagaaacaaacacaaaacaaataataaaacagcaaacttatggcctgacagaagtatttaccttaaaaggatacaatatgaagaaaagtaaaaattgaccatgaaaaaaagatttgtctatgaaaatgatttttttttacatgaggtattcctgttgtcattggagatatttatgagtagattctaattaccttgtattgttaaagtgaaagtcacactgtactctcagtaaatttgtgatttgttctttcctaatttcaacagtttttaaacagtattgaggaaaggttacttgcaaacaaaaattgtttttgtgtgtgttccatttgaatatgtaaatattataaggaacatttagaatcacaataatcagagaattcagattaaaacagcaattagaggtttttttgcctatcagatagggattaattaaattcatagttgctaattgtaatgggatatggaaaaataggtgctgttatatacaattagaagtgtagatttgatcaacatattctaaggcagttttagaggaatgaccttattttaacatgttaatttgcattcagcaattcagattatgggaagctgtgtataggaaatatgcttaattgttcacagtaacatatatagacaggtgtttattttagtggtatttgcaggggagaaaggctagaaatagttgggctatgccctggtatcaggaaatgttttaaagtgaaaactaatacatattaacacttcataagaaaaaaaattccgcaaagagcagacattatttagctagcttggtgtaatgttcataatatttctcagttccaaaatgtattggggatactttaataaacagttttgttgtgaactcattaatttgaataattattaattgcaaacatacccaaatgtaagttcaaggtacaacaacaacaacaaaaaacaaaagtaacatttaatttactgttctgattactagtccatttatttctatgggtaatcgagttgaacatcatatgtatgttttttcagagagtaaaaatcatctcatgtttacatcggtgacatatttcttctaaattaaaaaatttttttctaccaattttttaaggccttgcctgatgctaccctgtctgtgaggtttttgttaattattcatctttaagttatcgctatctcttttgaactataacatatttttctttatttttatctcatcattttccataatattaatagtaataatactttttgtgctttaaatcatacattatacactgctttatttgctttacatatattatcagatttctcatattagcccataataaggtagacattactatcctgattttacattgaagaaactaaaatattcagaggttaagtaaattactcaaggtcacacaggtaagattaaagtttaggtttcaaattcaggtatgtttgctacaaaaccttgtcactgtgttagactgcctctaaagtgagtaaggtaaatgaaataaatgctttgtatgtttaaaattttgttataaaggaaaggaaataatgaattaatgaaatgttcaaattacagactttaaagtaaatacagatttcgttttatactagtcataaggtaattcagtgttagtagttaataccattaaatataatgtgataatcagctagcgaaaaagaaaaaaattaaagttcacggttatttgctacatatatatatatataaattttaagttagaattataccatttgttatatcatttatgccatgtacaaatgaatgaaaatttcactttttttctttctagaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaaggtcgaaatacagtaatcatctaaccctatttatcaaatttaatgatattttcaaattaactgctcctttaaattctatatagaatacaattttcgtttcaaggatcagacataatattgagctgcttgggatgttagaggcaattataagctcaaataattatagttgagtattcagtttttattttaaatacattgctgtgattagcacttataacaactatgtattattattcttgttaagaagtagagaacagcaagcaaattttgttccaggcttgtacaacaaactagtagtcagatcacgttattgctctattttattctttagaatctaggaattgttcttgttgagccaagaagaaatggtcattatcatattcattttatgaattacatagaattattttaaaatgatttttaagttttttgaaccctgttttcccccttttacacctactgaagattactgtagcccagtaggcattgatttttatatcattagaatagaggattaatttctctttaaaatataaatatttcaaaataggattttctttagaaaataataaatactgttctaaatgggtatgcattatccttgttcagagtgcttttacttgttttatttgactattatcagtatctttgccaatagctaaaatcataaaactttaaaactagaaacattgtagaaattattttactcaaccactttattccagataaggaaactaaccaagagaagacaaaatttatttcagttaattttgtcaattgtaataatgcttatagaacttagaaataggtaaatatagtttttgtagggattttgatcatcagttaattttatcagttgtcagcattagggtttagaaatgttgaaaagttaagcaaacccagttagaggaaaaggatttcagaagtattgatcacaatctggatcattgttatgtgatacttttatttttttaaagtttatgcagtagcacctacattagtcaaaacccaattaattagtacttagttacatgacttcctttttagcactctatcttataagaaagaggttaatcacaagcattcagagggcatagcaataaaccataaataaaataactctaatgtattcttgagttagttttcactctatatgttactctttctttgcattttctgttgatatttgatactcaggatagtaatttttaaaaatagtaattcttaaaatttttaatcagaaatcatattgatatcagtatttagtgtgtagaaaagtgtactggtacattttaggaatattttaaacataatattaattaaacaggatgcctaaatgcctcatttcctgagcattgtagttaatcaaggaaggttattttgggttctggaatctactgatagagtaagtcatataagaaccaggaagtaacccttattccttttctttgtgttctttaaactcgttattagaactctatatcgaatttgtctctccttttggaaaagcatataaaaagcctgttgttacttcagaaaagggcaaaggcatttattgaaaaaacaataggcaaaagggaaaaggaacagacaacttgatataactatcttatacacattaagaacaaagaaagatcatatgaacctaaatgacactcaacaaggatattaacataaaggactttttcactgcaggtctaattaactattaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaaatggaatattggtaattgaacatttgggttagttgagaatattttttaaaattagggcaaaatattaatgctaaaggtgttctgtatttaactcagtcatttattcaaacccagaatcctgcagtttctcctgattaacagctaagtaaattctatagcactgtactgaaaatataaaaaatttagaatatagggctgatcatccctgatcctaagattgtcctctgaagttgattttcagggtaaatctttcatatccactttttaaattgccgattgtttcttatgaaacaagtagtaaaatgtacaaaagaaaaagaatctagcttaaattatagagttcagacatattttttagtaggaggaagaggaatagaataacaaaatagagtgtgaaatttggagtaaattgacagattttcagaataaaatgtttcttttttctctgtacatgttaaaaatatactttgtattgatactttcatgtgccatcactaatattacatatatagcatattaaagagtgacattttaaaccattgttaaattattcaacagggactaaataggaatagtttgccaactccacagctgaggagaagctcaggaacttcaggattgctacctgttgaacagtcttcaaggtgggatcgtaataatggcaaaagacctcaccaagaatttggcatttcaaggtaaaatctgcagagccttttaagaaacttgaatcaaatgcatctactttgtttctgtcaataatgtttcaaatagttctggaagcagaaaggaatggttgaagtattttaggtataggacaacatgtgtagtaataatatggtaaaatagagaaactgattattaaagagaagctaatgtgtcttgtcctaaaactttgataggctgggtacaaaatgtgctggatccctgagaacatgagatagtttagggaaatcaggatcaactcaggactggatgctggggaagtttttaaatcgatagaagtggccattacagggttagccaccaatccaatgaatagtatccaaaggtaggtctgcagaattactgacttctgaaaagaggagcacgtttccaaggctcatcacaattgttaggtttaaggtaaccagactttcaaatcctgttcctgctggaggttgagacaactaatatattctatattctgttgaggatttacttggaactgaacaatgctaatcttataaatgaaaggcatcagtaactttaagtaaatgaggctgggaaaatgcaggagctgaaatctcccgaatgtaaatatatacatttaccctgataacaaaggatttaataatacagtactttgtcttttgaaagccaggaaggatactgatccttgtgtgagtttgtcataagttttttctttactcagctttctaattatgttaatataatattggaattggcacaaattctgtgttaaccattttctggtattactgagcatgttttatacttttgagctgtatagtttcacatttgaaacagtagatggcaggattggatcatagctatttgttaaagtttatgttaacagataattagatgattataattttctagattcttaggtggtttattaatttgaatcttgtataatatattcaagcaggtgaactccttttttgtaaaagaaaaattgaatgaagtgatgtctaaaacaggaatggattgaagtatgaagagtactgtacaggaaaatgagcattggtccaaaatttgccatggcctgaacatcatagtcttttttttttttttgtaaaggaagcaggatatagggaagtgaatgatgttaggaacagaaaatgtgacagtatttcttaactatgggtagcattatcttgagaatatagttgggttttaaaaggtatgataaaaatgttttatattttaacctttcatactgatgtaacagcaatgcatttgcagttaaagaaacatttgatacattgagttaaggtcatttttatcctgctgcctcagataattgattacaatagaaacatagttcagagaaaactaatctttaactctgaaaagtgtttattatataaagctaaatgtaggtagattctatgtagtgacttaactcattaaaacaaaatttatgcctcataaaatatttagaaatttggagaataaattaattggtggtattatgtacgtctattttaaagagaccaggctagatgtatcttttctagtttgcagaagctggagcctcttggtaataaatgtctatgtgtactttgcacataggtgggttacgatgggaatatatgaaacatttacaaccactattccttttcagattcaaatctctggatcagtgctgtctaatagaaatttttgcaatgatggaaatagtttatatctgcactgtctaatatggtactccctagctacatgtgactgttaatcatttgaaatgtgtctagcatgactaaggaactgacttttaaatgtgatttaattcttattaatttcattcagatataaagagccatatgtgactgttttgtagacatatgtgacatccatattagtgcagctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttccccgcacaatgctgctatcctctagtggagtggttgcttacaaaattgatttacttagagacttggtgttatctttgcatcctgttaccttattctacagataacagttgtcagatatctgtctgcattatcttttactctctattcttctcctttatcactgtgcctatactattttatgctttcattactacttacttgggctattgaattagcctcttaattccagtttccagtatccttcttgactttattaatcttccaccttacactagaaatcttccttaaataaaactgtgattgcagttgtccctggttatccctgggggattggttccaggcccctccccttcccatgggtacaaaaatccatggatgcttgagtcctttatataaaatggtgtagtatttacatattctctctacacatcctttcatgtactttaaatcacctccagattatttataatacctaaggcaatgtaaatgctatgtaaagagttgttatactctattttttacttgtatttttttattactgtgttttttttccttgaatatttttgatttggggttggttaaatctgtggatgtagaaacctcacatacagagagctgactatgtatagtttgtctagtcattgcatttttggactctttaccagtcctatagaataacgcccaaattcctagtgtagaatgtgaaacccaattattacctcatgacagagctgcagcccttacttggaaaaagtaaatgaactaacacagatgagcagtctttcaaataatgagaatagaaaaatgatatggaaagctttctaggtaaaaacagtaggcatgtaacttgtttaagactcttccttgatgttttctggtaattttgttcttggtttaacaccatttgaaaattaagctaaattatgtttcaaaataattaaaatacaaacaatgaaatatatataaggtatttggataaaaagtaataccctatttgtgtaaagaataatacaggatttaattttgcttttattcatgctttgcctagagaaaaaaattaagtattataaccctgggagctatgataaaaataatcagaagaaagaaaaccacagggaagaagagttagtcccccattgaacagcgaccctgttcttattgttaagagtttattattgttcatctgttagaggacttgagattttactaattaaggaggccattcctttacaacaccaaaatatgtttccaacatcaccttcctctagtcttctgaaattctagtcaagctgaactatttgatcttctctctgtccatctgtgcacccttttaatttaaaaagcaatttaactggaatagatctcaacttcagttctgtatatccttagttgggctcataaatcaccttataaggataacacctggaggtccttctcccttctccaaggagaagtactcttttcttcctctgaatttccataacacattctcttacggcgcttttcacatttgactttatgtcagccattactactcctctaaagcctgtttaagttctgtaaagagttcgagattgcattaaaatgaatctttgaagacaaatggctgcttaacaagtgtcctgcagaggtatggtatccatatgagattatgacccttaatcttgccttctgcttaagtttcagatctgggatgagatttctgtggtcagaaagttccaggaaaggttgttttctggatttgctgatgataaaattacccatctctgagttctagttttagtacaggttgaatatcccttatctgaaagtcttgggaccagaagtgtttcagatttcaggttttggaatatttgcctatgcataatgttgtatcttggggatacaacccaatattcatttatatttcatatacacatagcctgaacgtgattttatataatattttaaataattttatgcgtgaaacaaagttttgactatattttaactgtgacccatctcatgtggtcaagtgtggaattttccatttgcagagtcatgtttatactcaagaaattttgaattttggagcattttggatttgggatgctcaacctatacttagagttaaaagaagactgaactgctatttttgaactgagtgatgggacccagccttctctgaggtcaaacagcatatattcagggctcacaggtcactctttttgaacaggttttccctggggaaaaaaataggcaagttgtgttcaattaccctgtgggctatcaattatagttacctcctacactaaagagacttgcttttaaacccatgagtcaccatttatcttcaccgctactgtgtaatgaaatctaataactcgttgcctggcaatagtatgtatgttaaattctgtgccttataatttatcagagacttacaccaaggttatattagcaaacttgaccctatttgaaccccagcaattcaagagggctaattgtgtcatcctactcagcttcttaagagaataactctgtaaatttagacatctacagttatcaagtttatacaactgcattgaaactgagttggtacagaccttgttaaggtaatttgtattgactgtctagaagtcagctcttaaaatatagcttagctcagggaccataacttttgacgtctcttgttcgtttgcttttgacaactcattcccaagtgagtagaaaaagaaaaacaaactcaatttcttccaccatactctgacagcacatttctgataccagatgtgtggggatttctccccaccagcaagcaagcgagcaagcaagcaggcaagcaagcaattctgtagtagacataagctaggtgtcctataattcaattatttctttttcttttctttttttttttttttgagacagagtctcactctgttgcccaggctggagtgcagtggcacgatctctgcccactgcagtctctgcctcctgggatcaagcaattcttcctcaacctcctgagtagttgggactacaggcacatgccaccatgcccagctaatttttgtatttttagtagagacggggtttcaccatgttggccaggctggtctcgaactcctgacctcaggtgatctgcctgcctcggcctcccaaagtgctgggattacaggcatgagacaccatgcccagcctaattccattatttctgacaccatctacctggagatagcgtcagatcatactggttaaggactcagtccgacaagactgatctccacttctgatgccaatagcaagcctcaggttattttgcctgtgcttctgaccaaccagctgtaaatcagggttcccacagccccctccctgggttcaggtaatttgctagagcagctcacagaactcaaggaagcatgtttactggcttattacaaataatattttaaaggatacaaatcaacagccagatgaggagatacaaaggacaggtctggaaggggcctgagtacaggagcttctgcccctgtggagttggagtataccaccttccttgcttgtggacatgttcttgttcactttcctggaagcccccacgtgtttggctattcacaagctcctcagacccagtcctttctggatttttataggagcttcattttataggcatgattgagtaaatcattggccattggtgagcaatttaagctttagtccctctcctctctctggaggttgggtagtggggctgaaaacccccatcatctaatcctgtcttggtctttcaagtgactagcctctatcctgaagctacctagaagctgccagccatcagtcaactcattagcatacaaaaagacactttggagatcctcaggagtttaggagttgtatgctaggaaacagggactggactaaaaccaaatatgtatttcacaatatcacaccaagtctgactttaatcaccttcctgccaactattagtagtcattggaactactcgtctgcttgtcttctgctttcttcgtattgatttatgtaatttcattgaggtgtgtatttatctggtgctgggccaggacatgatgggaagattcgggaactaatctgagaacctatcatttgacctgtaactcttaattctaaatagctaaatgaatgtatgatatactgaaattattgaaagaccctggatcaaggtagaagacagtggagcagtgctgtggtgccattctgaaaggagaaatctctctttgtcttgactattaatcatagaatcagggagtgggctttggtagaatacacagatttttctctttttttgttttctttcttttttattttaaactagaagcttttagagtgtgtttgtatgctgtgaatgatatggacaagaagaatatgagatttaattttgtttgcatgtctaagtgtttgaaagctcaattcattatcttattattattattatcattatactttcagttctggggtacatgtgcagaatgtgcagttttgttacataggtatacacgtgccatggtggttcactgcacccatcaacccgtcacctacattagatatttctcctaatgctatccctcctctagtcccccaccccccgacaggccctggtgtgtgatgttcccctccctttgtccatgtgttctcattgttcaactcccacttatgagtgagaacatgtggtgtttggttttctgttcttgtgatagtttgctgagaatgatggtttccagcttcatccatgtccctgcaaaggacatgaactcttccttttttatggctgcgtagtattccgtggtgtgtatgtgccacattttctttatccagtctatcattgatggacacttcggttggttccaagtcattgctattgtgaatagcaataaatatacatgtgcatgtgtttttataatagaatgcttcataatcctttgggtgtatacccagtaatgggattgctgagtcaaatggtatttcttgtcctagatccttgaagaatcgccacactgtcttccacaatggttgaactaatttacactcaccaacagtgtaaaagtattcttatttctccacatcctctgcagcatctgttgtttcccgactttttaatgatcgccattctaactggcatgagatggtatctcattgtggttttgatttgcatttctgtaaggaccagtgataatgatcatttttcatatgtttgttggctgcataaatgtcttcttttgagaagtgtctgttcatatcttttgcccactttttgatggggttgtatttttcttgtaaatttgtttaagttctttgtagattctggatattagccctttgtcagatggatagagtgtaaaaattttctcctattctgtaggttgcctgttcactctgatggatggtagtttcttttgctgtgcagaagctctttaattagatcgcattggtcaatgttgccttttgttgccattgcttttggtgttttagacatgaagtctttgcccatgcctgtgtcctgaatggtattgcctaggttttcttgtaagatttttgtggttttaggtcttacgtttaagtctttaatccatcttcagttaatttttgtataaggtgtaagaaaggggtccagtttcagttttctgcatatggctagccagttttcccaacaccatttattaaatagggaatcctttccccattgcttgttgtgtcaggtttgtcaaagatcagatggttgtagatgtgtggtgttatttctgaggcctctgttctatcctattggtctatatatcggtttggtaccagtaccagaggaaagaacaggcagtaatgattgctgttctgcagcctctcctggtgatacccaggcaggcaaacagggtgttttggttactgtagccttgcagtatagtttgaagtcaggtagcgtgatgcctccagctttgttctttttgcttaggattgtcttggctatgagggatcttttttggttccatatgaaatttaaagtagttttttctaattctgtgaagaaagtcaatggtagcttgatggggatagcactgaatctatatattactttgggcagtatggccatttttgtgatattgattcttcctatccattagcatggaatgttttttcatttgtttgtcctctcttatttccttgagcagtagtttgtagttctccttgaagaggtccttcacaacccttgtgagttggattcctaggtattttattctctttataacaagtgtgaatgggagttcactcatgatttggctctcttgtttgtctgtttttgttgtataggaatgcttgtgatttttgcatattgattttttatcctgacacttttctgaagttgcttatcagcttaaggagatttggggctgagacaatggggttttataaataattgaatcatgtcatctgcaaacagagacaatttgacttcctctcctcctaattgaataccgcttatttctttctcttgcccgattgccctgaccagaacttccactaccatgatgaataggagtggtgagggagggcatccttgtcttgtgctaattttcagaaggaatgcttccagtttttgcctattcagtatgatattgcttattggtttgtcataaatagctcttattattttgagatacattccattgatacctagttcattgagagtttttagcatgaaggggtgttgaattttgtcaaaggacttttgtgcatctattgagataatcatgcggtttttgtcattggttctgtttatgtgatggattacgtttattgatttgtgtatgttgaaccagccttgcatcgcagggatgaagcctacttgatcgtggtgggtaagctttttgatgtgctgctggattctgtttgccaatattttattgaggattttcatatcgatgttcaccagggatattggcctgaaattttctttttttgttgtgtctcttccaggttttggtatcaggatgatgtcggtgtcataaaatgatttagggaagatttcctttttttctattgagtggagtagtttcagaacgaatggtactagctcctctttgtacctgtcgtagaattcagctgtgaatctgtctggtcctggacttttttttggttggtaggctattaattactgcctccatttcagagcttgttattggtcggttcagggattcgacttcttcctggtttagacttgggagggtgtgtgtgtccacgaatttatccatttcttctagattttttagtttatttgtgtagaggtgtttatagtatcctctgatggtagtttgtatttctgtgggatcagtggtgatatcccctgtatcattttttaatgtgtctatttgattcttttcttattcttccttattagcctggctagtggtcaatatattttgttgatcttttgaaaaaaatagctcctgaattcattgattttttgaagggtttttcgtgtctctatctccttcagttctgttctgatcttagttatttcttgccttctgctagcttttgaatttgtttgctcttgcttctctagttcttttaattgtgatgttagggtgtcaattttagatctttcctgctttctcttatgggcatttagtcctataaatttccttttacgcactgctttaaatgtgtcccagagattctggtatgttttgtctttgttctcattggtttcataaaacatctttatttctgccttcattttgttatgtacccagtagtcattcaggagcaggttgttcagtttccatgtagttgtgcggtttcgagtgagtttcctaatcctgagttctaatttgattgcactgtggtctgagagactgtttgttatgatttctgttcttttgcctttgctgaggagtgttttacttcccattacgtggtcaatcttagaataagtgcagtgaggtgctgagaagaatgtatattctgttgatttggggtggagagttctgtagatgtctcttaggtccacttggtccagagctgagttcaagtcctgaatatccttgttaattttctgtctcgttgatctgtctaatattgacagtagggtgttaaagtctcccactattattgtgtaggagtctaagtctctttgtaggtctctaagaacttgctttatgaatctcggtgctcttatattgggtacatatatatttaggatggttagctcttttgcatttatccgtttaccattatgtaatgcccttctttgtctcttttaatctttgttggtttaaagtctgttttatcagagattaggactgcaactcctgccttttttttttttttttttgctttccattttcttggtaaatattcctccatcactttattttgagcctgatgtgtctttacaggtgagatgggtctcctgaatacagcacactgatgggtcttgactatccaatttgtcagtctgtgtattttaattgaggcatttagcccatttacgtttaaggttaatatgtgtgaatttgatgctgtcattatgatgctagctggttgttttgccctttagttgatgcagtttcttagtagtgttgatggtctttacaatttggtatgtttttgcagtggctggtactggttgttcctttccatgtttagtgcttccttcaggagctcttgttaggcaggcctggtggtgacagaatctctcagcatttgcttgtctgtaaagtattttatttctccttcacttatgaagcttagtttggctggatatgaaattctgggttgaaaattctttttcttttggcggatcacgaggtcaggagttcgattccagcctgaccaacgtggtgaaaccccgtctctaataaacatacaaaagttagctgggcgtggtggtgcgcgcctgtaatcgcaactactcaggaggctgaggcaggagaattgcttgaacctgggaggcggaggtggcagtgagctgagattgcaccactgcattccagcctgggtgacagagagagactccatctcaaaaaagaatactggccctcattctattctggcttatagggtttctgccgagagagatccgctgttagtctgatgggcttccctttgtgagtaacctgagctttctctctgggtgcccttaacattttttccttcatttcaacttcggtgaatctgacagttatgtgtcttggggttgctcttctcaaggaatatcattgtggtattctctgtatttcctgaatttgaatgttggcctgtcttgttaggttggggatgttctcttggataatatcctgaagagtgttttccaacttggctccattccccctgtcactttcaggtacaccaatcaaacgcagatttggtattttcacatagtcccttatttcttggaggctttgttcatttctttttattcttttttctctaatcttcttgctttatttcatcaagttgatcttcaatctctgatatcctttcttccacttgatcaattaggctattgatacttgtgtatgcctcacgaagttctcgtgctgtgtttttcagctccatcaggtcatttattttcttctctacactgattattctagttagcaattcgtctgaccttttttcaaggttcttagcttccttgcattggattagaacatgctcctttagctcggattagtttgttgttacccaccttctgaagcctacttctgtcagttcatcaaactcattctctgtccagttttattcccctgctggtgaggagttgtgattatttggagaagaggcgttgtgttttttggaattttcagcctttttgtgctggtttctccccatctttgtggatttatctacctttggtctttgatgtttgtgaccttcagatggggtctttgagtggacatgctattcctttctgttgttagttttccttctaacagtcaggcccctttgcttccggtctgctgcagtttgctggaggtccactccagaccctgtttgcctggatgtcaccaggagaggctgcagagcagcaatcattactgcctgttctttcctctggaagctttgtcccagagggacacctgccagatgccagccagagctcttctgtatggggtgtctgtccgcccctactgggaggtgtcttccagtcaggatacatgggggtcagggacccacttgaggaggtagtctgacccttagcagagtttgaaaactgtgctgggaggtctgctactctcttcagagccattgggcagggatggttaagtctgctgaagctgcacccgtagccaccccttcccccaggtgctctgtcccagggagattggggttttatctgtaagtccctgactggggctgctgcctttttttcagagatgccctgcccagagtggagaaatctggcagtctggcctcaatggccttgctgagctgcagtggggtccacccagttcaaacttttgggctgctttgtttacactgtgagggcaaaacgcctactcaagcctcagcaatggcagatgcccctccttccaccaagcttgagcatcccaggtggatctcagacagctgctgtgctggcagtgagaatttcaagccagtggatcttagtttgctgggctctgtggcggtgagatctgcagagccagaccacttggctccctggctttagccctctttccgggggagtatagggttctgtcttgctggcgttccaggtgcccctgtggtatggaaaaaacaatacaacaacaaaaaaaactcttgcagctagtttggtgtctgcctaaatggccgcccagttttttgcttgaaacccagggccccggtggggtaggcaccggagggaatctcttggtctgtggattgcgaagactgggaaaagcgtagtatctgggctggaatgcactgttcctcacggcacagttcctcacagcttgccttggataggggagaaaattccccaacctcttgcccttcccaagtgaggtgatgccccaccctgcttcagctcgccgtctttgggctgcatccactgttcaaccagtcccagtgagacgaactgggtacctcagttggaaatgcagaaatcacccaccttctgcgtcaatcttgctgagagctgcagactggagctctttctattcaaccatcttgcctgggaacacacacatttttctatttgaatgttgccccgggtggtactgttactcttcttttccagtctttgccaccccacatgtaggcagttgccggtatgaaataatcaaaaggataagaatccagcttaaaagagtttattcaaacacaaagctgtggatgcccatccaggaaacacagactccaaggaaatagggtcagtgcttcaaagttgaaaagttaagatcatatttgtataggcagaaaacaaagatatttagcagaataacattttccacacaaagttggcttctgagttacagcaatttgattagttacagcttgtttgttttctttttccaatttaaaagaatatatttaacagtccatcttagaaagtgtgtctttgtgtaagagaagaaaaagggaagttaatctataatgaagatcaacagtaaagagggaaggagtcttctttgacatcctttagttatttgcagcatttagcaaagcagtgtaagttaggggggaataaaaggctaatctgtagtcagggaaatcaaggctatgtctgcctaggttacagctgcctgttagtgactgaggtcccaaaatcacattcctttaaggctcagaataaaagttccaaaatttggttttgaattacttattttcacacaatgaaaatatgaagaatgactgagcattgacagggagatgagttcattgggtggtattatttgcttactgcttgttttttgcctacactaataaaagttgtcaatacttgtgaggatagggaacagaaaaaaatgaaaaactatactttagtccagtagttctcagtgaggtcactggatcagaaactccatcatataagaacttgttagaagtgtggattatctggccccacccaagacttagtgaatcagaaaccttggggacgagaccagcagcctatgttttaagaaaccttcaaagtaattgtgataacctatttcaccccagggattggcagtctgcagcctatggacctaatctggtctataacctgtttttttgtaagtaaaattttattgaaacaaaaccatacccatttgttcattttagtttgtggatgcttttgtgctacatcagcagagttgagtagctgcaatagagaacatatagccaaaagtatttaccatcaggttctttacagaaaaagtttgctgactcctgctttaggccttaggcactagaggcgcaaactctgaatttatgaggatatatttgctaattaaattgagaaccatgaggaaaaaaggtgaaacttttcctgtttttaaaaattttaacctgttatttttcccttttagtcaaggatgctatctaaatgggccttttaattcaaatctactgactatcccgaagcaaaggtcatcttctgtatcactgactcaccatgtaggtctcagaagagctggtaagaaatcattctttatgactcaaatatgggggttctcaaagtatatggtagtgtaaacacttttcatcacatatttatagctaattttgaatacaatttcatgtattataagttaacatgacttagcagtttgggttggctactaattgaccgtttgctaattctttcagtaaaaacagttttagaacatctactctgtaccaggtattttgctaagcagtagggattcagagataaaatatataactatttaactaacctgaatggttgcagacccaggacaagggaaaatcttcaagaaagagtatttttttttttcatagaatgataattgtggagaaaaaaattttaggattagaatagaaaaaaccatgacttcatcctggaaaaacattatgataggaattttttttaattaaaagattatagaatgattaaaaactcttggatgcaagatattttaataaatacaacataggaatagcaaagcaatactgatattgtgcttttaaagtacattatggctgatatcacataggtacaattttgtgattgggatatacaattacaaaattcttttatacacaataacctataaagcatgtgaagagatcagaaaatattattgataatcaagaaaagtaggcactagaaaaagatctatatatgatattgatgctgtattttacaatctttaaaataacaatgatgtttaaaaggaaatagaaggaataatggccaaaatgaatggatacttcgaatagagaactagaacacatagaaaagaaatggacagtctagaactgagaaatgcacttgattaaattaaaagcttattcaagggtttaagaatggattggatacaacagaatacaaaagtagtgaacttgaagacagagaaatagaaaatacccaaactgaagcacagagaaggaaaaatacataaataacagaacaaagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcaaggaacaacaataatgatattgacagtgacttgttaacagcaactgtgaactccaaagacaatggcatatttgaaaaagtgtggaaagaataaaacttgacagcatagaattctttatccaatgaagaaatattcttgaaaaattaaataggaataaaaattttttttagtatcctcacttccctgcaacagtaactgtggtgatgggtatgttaattaatttgattgtcataatcatttcacagtaaaaatgtaaatcaagtcattatgttgtacaccttgaatacatgcagtttttgtcaattgtacctcagtaaatctggaaaaaatcttttagtaaatcagatgagaagtagaaaaacgtacatttttttcaaacaaacaaaagctgaaataatttgtagctggcagacctgtgctactaagattcagtaaaggaagtttcttaggcagggggaaaattatccagattgaagcatggaactacaagaacaaaccaaaagcactggtaaggctaaatagatgggtgaggattaaaaagtgttgatgggtcaaaaagttggcaaaggatatgaatagacacttctcaaaagaagacatttatgcagccaacagacataggaaaaaatgctcattatccctggtcatcagagaaatgcaaatcaaaaccacaatgagataatatctcacgccagttagaatggcgatcactaaaaagtcaggaaacaacagatgctggagaggaggtggagaaataggaaggcttttacacagttggtgggactgtaaattagttcaaccagtgtggaagacagtgtggcgattcctcaaggatctagaacaagaaataccatttgacccagcaatcccattactgggtatatacccaaaggattgtaaatcatgtggctgggcgtggtggtgcacgcctgtaatcccagcactttgggaggccaaggcaggcggatcatgaggtcaggagatcgagaccatggtgaaaccccgtctctactaaaaatacaaaaaaaaaaaaaatcagctgggcgtggtggcaggcacctgtagttgcagctactcgggaggctgaggcaggagaatggcatgaacctggaaggcagagcttgctgtgagccgagatcgtgccactgcactccagcctgggtgacagagcaagactctgtctcaaaaaaaaaaaaatcatgctactataaagacacatgcacacgtatgtttattgtggcagtgttcacaatagcaaagacttggaaccaacccaaatgtccatcaataatagactgaataaagaaaatgtgaggccgggcgcggtggctcatgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctatttgggaggctgaggcaggagaatggcatgaacccgggaggcggagcttgcagtgagccgagatcccaccactgcactccagcctgggcgacagagtgagactccgtctcaaaaaaaaaaaaaaaaaaaaaagaaaaaaaagaaaatgtggcacatatacaccatggaatactatgcagccataaaaaaggatgagttcatgtcctttgcagggacgtggatgaagctggaaaccatcattagcaaaccatcacaagaacagaaaactaaacaccgcatgttctcactcataagtgggagttgaaaaatgagaacacatggacacagggaggggaacatcacacactgggaccaatctgaggctggggggctgggggagggatagcgttaagagaaatacctaatgtatatgacgagttgatgcatgcagcaaaccaccatggcacgtgtatacctatgtagcaaacctgcacattgtgcacatgtaccctagaacttaaagtataataataataaaaaaattgatgggtaaacacaataataactttcttttagcatttatgaaatacataaaagtcaaatatataacaatagcatagagggtagtcaaggggtaaatggaattaaatttgtcgtaaggtactagcaatgcttgaaaaacagtaaaaagttctaatttaagagaagctaatattcaaagatgaacattgtagtattcagggggccaattaaaagaccagtagaaaaagatataactaaaaagcttataaggaggtaaaatggcatgattaaaaaaagcttgaataattcaaaagaatctgagaaaagaaaagcaaaaacagaagaaacacacaaaaaataaatagcagcatggtggattaaacacactttattacattaaatatacacctttggggtagaggaagggatctgactagagttgtcagtatattatctgaaatgtcaagttttcaacaaaaattggactttacgctccaattaaaagacaaagattaggctgggcactgtgactcacacttgtaatcccagcactttgggaggctcaggtgggtggatcacctgaggtcaggagtttgagaccagcctggccaacatggtgaaaccccatctctacaaaattcaaaaatacaaaatacaaaaattaaccagacgtggtggtgggcgcctgtaatcccagctactcgggaggttgaggcacgagaatcgcttgaacccgggagacagagattgcggtgagccgagattgtgccactgcacttgagcctggacgacaaagcgagccttcgtctcaaaaaaaaaaaaaaaaaagtaatcttctgactgctcattggttgatgtccaaattatactgatccccccagggatgacttctaggaaaccatgcttaaaaatataatcaaaaacttaagagaaaaagctaacagaaaactgagtaactacacattgcaggagaaacagaaactacacaattagttcaggtaagtcactaaacaaattatcagaaagaagaaaacacaaagccagcaacataataaacctttggtgttggagggatctgatatcaaaactttacagtattttatgtaaaatgtacgattttcaagaaaaatatgtgaaacatgcaaagatacaagaaatttttgacatgtacccaaggaaaacgtaacccatagaaattatccctgaagtggattggattttagacttagtataaaacaaaactgtaacattgttttaataattataaagtaaggctacttttactcaatattggattagaggttctagccagggcaattaggtgagaaggaataaaaggaaaaagtaaaattgtatttgcagatggcatgagcttgtatatgtaaaatcctaagaaattcactgaaacctattatcaccaataagtttatcaatgtggcaggatatacaaaatcaattttatttctatatgctaacattaaggaatccaaaactcaagttacagaacgatttctgtttacagttagcattgaaaaaatctttgaaataaatttagcaaaatagtacaagacttttacaatggaaactataaaatattgttgaaattaaagaagacctaaatatattggaagacattccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttaataaaaaagaagaaaaagtacgaggactcccactttcaaattttaaaacttactaccaggctacagtaatttagtatggtactggcatagagatatttctattcaatgaaattcaatttggcagtttctcaaattttaaacatgaagttaccatatgacccagaaattctacttcttgatatatatccaagagaagtgaaaccgtaggtccacacaaaaacttgtgcataaatgtgtatagcagcattattcataatagctaaaattagaaacaacctaaatggctatcaataaatggttaaacaaaacgtggcttaaccatacagtagaatattttttgtcacaaaagtgaaatggagtagtattcatatgccatgaatgaaccttgaaaacattatgctaagttaaataaggcagtcacaaaagactacaaattgtacaaatctactcatataaaatgtctaaaatggacagatctatagatagagaaagtatattagtggttgctatggttttaatgcttgtgtacttccaaaattcacatgttgaaacctaatccccaatgagacagtattaagagatggggccttttggagatgactaagcatgaggttggagcctttgtgaatgagattagtgctcttataaaagaggcctgaggaagctagctatcctgtcagccatgtgaggatacagtgaaaaaagtaccatctgtgaggcagaaactgagccctaatcagacatcaagactgctggcaccttggtcttggacttcccagcctccaaaaactgtgagcagccaagttctattgtttacaaattgcccagactaaagtattttttttttttaggtggtatagatggaattttaatacagtgaaagaaaatagggagtactgagttaatggttttgggtcatctttataattatctggtagaagactgaatttccatcttacatattatatacacagaaatctacagattggctacaatttaggtgttcaaaatgggaattaaaagtattataaaagcatataagattcagaaagtttaaatagataaatattttctaataataaaaccattaaaagttgataacatttttttttcttttatttattattatactttaagttttagggtacatgtgcccaatgtacaggttagttacatatgtatacatgtgccatgctggtgcgctgcacccactaactcgtcatctagcattaggcatatctcccaatgctatccctcccccctccccccaccccacaacagtccccagagtgtgatgttccccttcctgtgtccatgtgttctcattgttcaattcccacctacaagtgagaatatgcagtgtttggttttttgttcttgcgatagtttactgagaatgatgatttccaatttcatccatgtccctacaaaggacatgaactcatccttttttatggctgcatagtattccatagtgtatatgtgccacattttcttcatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctcggatggccagtgatgatgagcattttttcatgtgttttttggctgcataaatgtcttcttttgagaagtgtctgttcatgtcctttgcccacttgttgatggggttgtttgtttttttcttgtaaatttgtttgagttcatcatagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttgtggttttaggtctaacgtttaagtctttaatccatcttgaattgatttttgtataaggtgtaaggaagggatccagtttcagctttgtacatatggctagcgagttttcccagcaccatattaaatagggaatcctttccccattgcttgtttttctcaggtttgtcaaagatcagatagttgtagatatgcggcgtgatttctgagggctctgttttggtaccagtaccatgctgttttggttactgtagccttgtagtatagtttgaagtcaggtagtgtgatgcctccagctttgttcttttggcttaggattggcttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccctcacgtcccttgtaagttggattcctaggtattttattctctttgaagcaattgtgaatgggagttcactcatgatttggctctgtgtttgtctgttattggtgtataagaatgcttgtgatttttgtacattgattttgtatcctgagactttgctgaagttgcttatcagcttaaggagattttgggcttttttttatagcaagttgaatgaactaagacagtggtcccttgtgactatgggtaggagcgacaggaatagagaatgactgctaatgggtctatggtttctttttgagtttatggaaatattccagaattagatagtggtgatagttgcacaactctgtggatttctaaaattcagtgaattgtacaatttaaaatagtaaattgtatggtatatgaatgatatcttaaaaggctgtttaaaaaacacgtaagcatgttctgtcaccacagtggaattagatttgaaaacatctctcaatagatctgcagaaaatcctcaaattataaataacctatgggtcaaagaagaaaaagcaatgaaaatcagaaaatattttgagctgaataataatgaaaataggacttattaaaatgtcggaagaagctaaagcagtgctttcttgggaaatttatagcaaaaaaagagaaaaattaaaaatctgttaagcttacattttaagaagctataagtttcacagcaaagtaaaccaaaagaaagaagaaaacatgacactgatacaaaaagattacactgatacaaaaatgataaaaaatctgaagagtcatatatcttctaacgaaattaaacctgtagttaaaaaccttcttacaaataaaattgtaggtccagatgactttactggtaaattcttccctatatttaacgaaaatgttgttatgaaaggttatatccaatgccttagttttctatagctgcttgctgtaaactgcatattcatatctcctcacttacaccccaattcatgtgttgaaacctaatcctcagtgtgatggtatttggagctggggcctttggaatgtgattaggtcatgtgagtggactcttcatgaatgggatgagtgccttataaaagagacctcaaagagctctctaatcccttccgccatgtgaggacacgagaagatggccgtcagtgaaccaggaagtgggccatcatcagacaccacatctgccagtgccttgatcttgcacttcccagcctccagaactgtgagaataaatttctcttatttataaaatacctagtctatggtattttgttatagcaatccaaagggactaacacactactgtatcaaattaccatatgcttagtgacttaaataacacaaatttatacttataattctggaggtcagaagtttaaaattgatctcattgggcccaaagcaaggtgtcagcagggctatgtgtcttctggaggctttagggggtaatccattttctttgcattttccagtttccagaggccttcctagagcttgcctgcctggattcctggcccatggccccattactccatcttcattgccagcaatgtcagtctgaatcctgacgctgccatctctctggctcttttatgtctgcctctctcttttacttaggcataggacttagccgtgtgtgactcctgtaatgacaagaacccttgtcattacattgagcacaactacataatccaggataatctccccatctcaaggttagctgatcagcaaccttaaggccatttgcaatttaaatatccctttgccatgcaatctaacatataggttctgtggtttaggatatggacatctttgggggtgattattctgcttaccacagccaatcttacacaactctttcactgaaaagggaaagaggaaacaccagttttttatgaggccagcataaccctaatattgaaacctgacaaggatattacaagtaaattagaggccaacatctcttgtgaatatagatacaaaaatcctaaacaaaaagttacacatataattgagtaatatattaaaatgataataccataatgttcatgttgggaagtattattacaggaatataaagtctgtttaacctttgaaaattcactgcattaatagaataaaagagaatactcatatggtcatcttaattggtacagagaaagcttttcatgtatgttcatttgataaatttgataattatgataaaaaattataagcaaattgggaatagaggggacatttttaatctgataaagtatctatcaaaaatgtttttcaaacataatacataatgaaatactgaacatttttctcctgactttggaaacaagataaagatgttcactgtaaatacttgtctccaacattatcctgtaatttctagacaatgaatgaagacaagataaagaaaaggaataaatattggaaaggaagatataaacccttttatttatttgcagattaccattttgtatacatggaaaatctagaaggctctaaaaatatagtaatagaattaataagtaaattttgcaatattttaattgtacagaaaaattaattatattactctatactatcagaaaatggttaaaatgaaatttaaaacaccatttaccacagcatcaaaagccaccaattacgtagagataaatttaataaaaaatatgcaatgctgctacactccataacttcagggaaaaatttccgtaacaagacataaaaatacttaccatatgggattagatgaataaatttgactacatgaacattaataacctctttattgaaaaaagtcatataaaggccaggcatggtggctcacgcctgtaatctcagcacttagggaggctgaggctggtggatcatttgaggtcaggagttcgaggccagcctcgtcaacatggtaagaccccatctctactaaaaacacaaaaaaattagctgggcgtggtggcgggcacctgtagtcccagctacttgggaaagctgaggcaggagaatggcatgaacccgggaggtggagcttgcagtgagctgagatctgagatcacgccactgtactccagcctgggcaactgagtgagactccatctcaaaaaaagaaaaaaaaaaaaagctaggtgtagtggcgggtgcctgtaatcccagctatttgggaggctgaggcaggagaattgcttgaacccaacagatggaggctgcagtgagcccagagtgcaccactgtactccggcctgggcgatagagtgagactccatcaaaaaaaaaagtcatataaaaagaattgaaaatagtaacaacatctgagaaggaactagaattcagctgtataaagaactttgtcagtggaagaattatggacaactattcattttctattgctgcatatcagattacaacaaatgtagcagcttttgtgcaagagtccacacacagctgagtcctctgcttgaggtgtcataagtctcaaaacaagatgttggctctaccttgttctcatctggagaatcagctgggaatgaatcggctgccaagctcattcaggttgtcctcaggttgttcttcatttccgttggttgtggattcttgatggctctgggttcttgatggctattggctgggggccacccacagttcgtagaggctgcccatagttttttgtcacatggtcttcctcagtatggctgcttacttcatggagctagcaagaagaatctctagagtgagtctctagcaagatggaattcataatgaaacataatcataggggtgacatcctgtcatctttcttttgataagaagctagtcacaggtgttttctacacaaagacatgaacaccagggggcaagggttaatgctaccttagagtgtgtccatcaccacaagccaatagaaaaattagcaaaagacttgaatgaggatttcagaaaaaaaactatacaaatagcatataaacatgaaatgtgcttaaccttattagtaatgaggaaattaaaaagtaaaggtacggtgctcttttatttatcatcagattggcaaaagataaagaacattatatttatacacacacacacacacacacacacacacacacgcagagaaagagagagaaagtttgttttaagggattggctcacacaactgtgtgggcttgcaaggcaagcaagtaggaagttttcaggacaggctggcaggctgaaaattccagcagggttaatgttgcagtcttgaacctgagacaaaattttttcctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttattttcaaataaggttataaatctgcctgcatctttccagatatacccacactgctttagtttgaggcactcagcaaaggtttctggaataaatagacagaattatagactcatcttatgtgttcctgaagcactctgttttgttcccttattaagcacttagcacttgtttgtattcttcactacactctagcttcattgaatttcagggatggtatctttttcttcattgtgaaaaccagtatattttccagcatatagtaagctctaaatatttgttgaatgaatgaatgagctggaaatactttcatgtaatttttaaagcgatctgacattgcattaacatatgatgttattctcaacttgcttaaatgctattaagaattttagttcttacttttacactgttggtgggactataaactagttcaaccattgtggaagatagtgtggcaattcctcaaggatctagaactagaaataccttttgacccagccatcccattactgggtatatacccaaaggattataagtcatgctgctgtaaagacacatgcacacctgtgtttattgcggcactattcacagtagcaaagacttggaaccaacccaaatgtccatcagtgatagactggattaagaaaatgtggcacatacacaccatggaatactgtgcagccataaaaaaggatgagttcatgtcctttgcagggacatggatgaagctggaaaccatcattctgagcaagctatcgcaaggacagaaaaccaaacaccatatgtcctcactcataggtgggaatgaacaatgagaacacttggacacagggtggggaacatcacacactggggcctatagtggggtggggggacgggggatggatagcattaggagatatacctaatgtaaatgatgagttaatgggtgcagcacaccaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagacaaaaaaagagaatttaaataaaatttaattttattgaattgaaaataattcaataaaatttggtagagatgctttgctcttgtggataatcaatctgatagggacacataggtgaaagttaaagaccaataggaattaggaaaatttctgccatacagtatgtatgttttagtcatactgttcacatttacctattataaatgtagatatttacccaacaaggggtgtttacccaacagccattgatcatgacaaatatggcaaatattgcataagtttctagaatattgtgaggccccatgcaggaatttataatttatttgtaaataatctgctttttttaaataaggaaaaaatccataaaaacacaaatatatttaataaacatacacacataaatacattcttatttatctatctcctttcttttaatttttaaaggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacaggtaagtttcccaactgtttattatttctgtttcaaaatgttgattacagttaagtcctcaacattttggataggttcttggaaactccagctttaagctaaatgaccatagtttttttcggtgttataatgaaatgacattattttaagatgtgctataagttgtttcacttaaaatgtcagttttcaaaaacttattgatgatattgaggactttactgtattttaataaagtattaccagttttctagttctatgttataactagatgatggattcagcctatattcttttccttatttatctagtagtttttattctaaataaatatcttctcattttagtggttattaattttttaaattaaatggtctccatctgagctaaaatataatggtattctacccatcctaagatcttagtaaatattaaagtattttagtatacactactttagtacctattcatagtacccagtaaatggtgtttgatcttatttctgctttactaatagtaagggtttacctcagatccaatgttgacttttcaaaaatattttgtttccttcaaggacacacagatactttctaggttaaagcctttgaactttatggagagattggaattttaggatgcgttgcagttgggatcttggttaaaaattaaacagattttctaattgtgttcaggtaaaaaacttgtacctcatttaccgtatatatttatctattttattctataagctgtggacatcaaatgctgaaatatgtttcaacatctgaatcagatggtacagattgctgcagtggaaaatcaggtgagattacaaaagtcatatgtatttgagtttaagagaaatttcttacaatgatttttagaatgggaaaatgaatgagtttaacttcagtttatccatctttaaaatgaagattattattttttacccacttcacagaggacttatttagaacaaattataagtaatagatggtgaaagtaattcaaagaataaaaatgtcccatacaaatgaatgtagtcttcttaggttatgtctattgtttataaatagtggaattatttatattaaacattgaaatttgtagtgcacaatctaaatccaaacggttttgcataaattttttatggcataaagaggggttgttttaaagtgtggttaattatatcattctgaaatattttgtatcctcatacaagacatattgtgttgatgaaattatagttgttttataaccttaaaatttgatgactcaaactaccagtagtagttaactaagtaactcagaccaacatttcccctgagggcagctagaaaaggtggatgaattatttttttaaaaaaaatctacttgaagccattgaagaactaaaaaaatcttatgaatcaccagtacaagatctgttggaagacagaactccaagaaagtgagcctggagtttggggctatcaaaagagtgtatgccaattccacagagaccaatgactgataggatgagcaattttattagcagcttcatggggctaggaagacagaggctagagttgaaggcttgccatggtttggataacttgataaactctaaagtgttgtatcctaagaaaaaagttaaaccaaaaatagataagccttttcagggattataggttcttctcaatccctttacataccataaaacttacccttttaaagtgtgcaatttaatagttttttgttttttacattttaaaggattgttaacaaataaaataaaataaaaagactaattcttcacaaactcttccaaaaaatagaagaggagggaacacttcccaactcattcttttttttttttttgtatatcattacaatggaattcagttcagcaattaaaggaataaacttctgatacatgctgcaacatagatgaacttcaaaacattattctaagtgaaagaagccaggcccaaaagatcatatattatatgattacatttatatgaaattcttgaaagacaaatttatagagacaataatcagaacagttgttgcataaagtgagaatagggattaactataaataggcatgaaggaacattttgggtgggggtgttgagaatgttctaaaattggattgtaatgattgttgataactgcaaatatactaaaattgttaaattgtacacttgtgggctggatgtttgtgttcctccaaaaattcatgtgtcgaaatcctataccctgatatgacggtattgggaggtaaggcctttgggaggtaattaggtcatgaaggtggatccttcatgaatgggattagttcccttataaaagaaccccagaaaactctctttcccaccctctttcccaccgtgtgaggatacaatgtgaaatcggtagtctgcaatactggaacttggccaggctggcaccctgatatcagacgtccagcttccctaactgtgagaaataaattcctatttttttataagccactcagtctgtagtatccaattatagcagcctgaactaaggcattttacaatgggtagattttaatggtatgtaatttatactcaataaagtttttaaaaagaacaataatttattaagtgtcatatttctttgggtggactagcctcaactgggagattctcacctgaggactttgatgagattgcagtcagtgcagtcagatattggttggggaagcagttatctgaaggattgattgggcagaatttccaagatgggttactcatgtgccttttggctattgaccagtccatctaaatatgacccctccatgggcttcttcagtttgttggcagcattccaagagagtaggaagtggaaactaccagttcagttaatggctgaactcagaacagagtgtcacttctgccatattctgttatcagagcagtcatgaggcctgttgagattccagagggttggtaaataaatgctctgtcttgatagaggagtgacaagaatacatttcagaaaagtgtttgggacaagagatagtgttgtagacatctttagaaagaaatgcttcatttacctcacctgtttttattattatctgtaagataatagttattaggagttcatatcattaaaaagtaaattatgtaatatacctcaagtgcaaacaacttttagattaacttctattttagaatatcattgtagttattgccttaccttaccaagaatactcgaatagtctaaatttaatttcttagactaatttttttcatttggaaaaaataatattttctaaacagtaatacttccagatcatcatctaatcaattaatgattggtatattcattgtattaagttgagattatactgacatttattaatcacctattatgtataacatcttgtaagatgggtattattatccaaattttacaggggagaaagcttgccattattaagtacgaaaatcaggatttgaacctagttttctgaaactcaactccaatgattactcttaagaatttttttttttttttttgagacagagtcttactctgtcatccaggctagagagtacagtggcacaatcatggctcactgcagcttccaactcctgggctcaagcaatcttccctcctcagtcttctgagtagttgggactacagcaccatgcccggctaattaaaaaaatttttttttgtagagatgagaactcgctctgttgcccaggccagtcccaaacttttggcttcaagtgatcctcccgccttggcctcccaaagcactaggattataggtatgagctgttatgcctggccaagatctctttttacaaaaaaacaaacaaaactctacatattgagcttatagcatgtaattatcatataatcagcacccagatccagaaacaaaataagaggctggccaaaatggccaactagaagcagctaatgtgcactgctgtcatggagagaaatagaaggggtgagtacatacagcaccttcaactgaaacatacatgtacacatgttgggattcatcaagaaaacaacccacagagaatgtagaaaagcaaggcaggatgactgcccacctgggagtgacacggagccaggggagcctccctcgcccagggaagcatgagtaagtgggcaaccctggggacccatgcttctcccataggtctttgcaacccttgagtcaggagaccctcctcgtaaacccactgcaccagggcttgcagtctgatatgcagagctctgtggcatcttggcagagtagctgctcaggcacatgtggagccccaggagctatagatacttgggtttctaggcaaaagcagctgcaacttggcaaagtaggaggttagacccccatacagacccctaagaagtagctgaattcaggggtctgagcagcaatggtcttcaggtcccatgtccacagcaccttgcaggataagaccactagcttggaactccagccagccactggtagcagtgttgatggagctcccagagggaggggtaggctaccatctttgctgttttgcagccttagccattgttgccttcagtgtaaccaccctacaaaaatgcagccagcttgcttttttatgtgggtccctgacctctcttctcctcactgggcaggacctcccaaccaaggtaaccagccactcttgccactgtttttcagctggcagtggttccgagcctccctgagatagtgctcccgggggagggacaggccgccatctttgctgtttcacagccttagccattgttgccttctggctctaggaagtccaaggtgactaggtactggagccgtctctcaccgcagcacagtagctctatgggaaagcagctagactgctttttcacatgggtcccagatcttatttcttttcactgggcagaatcctgtgaccaaggtctacaaccacccctgctagtgttttctgtccagcaacagtttcaaactttgctgggatggagttcccagagggaggggcaagctgccatctttgctgttttgcagccttaaccattgttgcctttgggatttggagagtccaaagtgactgggggctgcagcagaccccaaacacagcccaactgttatataaagaagtggccagactgcttttttacacaggtcctcaaccctatttctcctcactgggtgggacctcccaactagggtgtccagccatctctgctggtgttttctgaccagcagcagtttcaaacctccctgggatggagctcccagagggatagggggactgccatctttgctgttttacacccttcactgttgataccttcaggtgctagataaaccaaggtgactagggactggagtgtacccccagcatactgcagcagccctacagaaaagtaaccagattgtttgttacttgggtttccaatctcatatctcttcactgggcaggtcctcctggcctgggtctccagctcccctcacctccaggctatcaagccagtagcagctctggaactccctgggaaagaactcccagtgggaggggtgggttgctatctttgctttctcacagccttaggctttgctgtcttcaggctttggagaatctgtggggaccaggggctagctagtccatacccgagcacagagtatccacctcacagaaaagtggtcggactgttctccacgtaggtcctggtcctcacttctcctctcaacctggtactctagcacaaacacgctgtccctgtcagaccacatcaatcagaggcagcccagcagttaaaggaagagccacatgcagagataagaaagaaccaatgcaagaactccagcaacctaaatggtcagtatcttatgacctccaaacaaccacactagttcttaaccaggctgagctggctgaaatgacagaaatagaattcagaatatggataggaacaaagataatcaagatcaggagaatggcaaaacccagttcaacaaaactaagaatcacaataaaatgatacaggagctgacagatgaaatagccagtatgaaaaggaacctaactgatctgatagagctgaaaaacacactacaagaattttgtaatgcaattccaagtacagcaaaagagaccaagctgaggaaagaatcttgaaacttgaagactgactctctgaaataagaaagtaagacaaaaattattttaaaaagaatgaaaaggaatgagcaaaacctctagaaatatgggattgtgtaaagaggccaaatctacacatcattgacatccctgacaggagaaagcaaacaacctggaaaacatatttcaggatatcatccatgaaaacttccccagccttgctagagaggccaacacccaaactcaggaaatacagagaactcgtgcaagattctactcaagaagatcatccccaagatgcataatcatcagattttccaagtttgaaatcaaggaaagaatgttaaaggcagctagaaagggcaggtcacctacgaagggaacctgatcaggctaacagtggacatctcagcagaaaccctacaagccagaagagcctgggctcctatattcaacattcttaaaaaaaaaaaaaatcttcaagaatttcatatccagccaaactaagcttcctcagtgaaggagaaataagatccttttcagataagcaaatgctgaggaagtttgttactaccatttgttactacgagacccacttaaaagagatcttgaaaagagcactaaatatgaaaggaagaaccattaccaggcaatacaaaaaaacacagttaagtacacagacccagtgatgtaaagctaccacacaagctggcttaataaccaggtaacagcacaatgacaggaacaaatccacacacatctatactaaccttgagtgtaaatgggctaaatgccccatttaaaaggcatagagtggcaaactggattttaaaaaaagtaagacccaatgatacactgtcttcaagagacccatttcacaggcagcaacacccataggctcaaaacaaagggatggaggaaaatctaccaagcaagtggaaatcaggaaaaagcagaggttgcaatcctaatttcagacaaaacagactttaaaccaacaaagatcaaaaaaggcaaagaagggcattacataatggtaaagggttcaattcaataagacctaactattctaaatatgtattcacccaacacaggagtacccagatttataaagcaagttcttagagatctacaaagtgccttagactcccacacaataatagtgagagacttcaacactccactgacagtattaggtcactgaggcagaaaattaacaaagatattcaggacctgaactcaatatgggaccaaatggatctgatagacctctacagaactctccactcaaaaacaacagaatgtacatttttctcattgccacatggtacatattctaaaatccatcagacaaccctcagcaaatgtaaaagaactgaagtcatgccaaacatactcctggaccacagtgcaataaagatagaaatcaagactaaaaaaaatcactcaaaaccatgcaattacatggaaagtaaacaactggctcctgaatgacttttgggcaaatagtgaaattaaggcagaaatcaagaagttttttaatacgaatgagaacaaagatacaacctacaaaatctctgggacacagccaaggcagtgttaagagggaaatttatagcactaagcagccatatcaaaaatttagagagatcccaaattaacaacctaatatcaccactaaaataactagagaagagagagcaaaccaacccaaaagctgacagaaaacaagaaatagccaaaatcagagctgaactgaaggtgattgagacacaaaaacaccatccaaaagatgaatgaaaccaggagttgattttttgaaaaaattagtaagataaataggctgctagctagagaaatacagaagaaaagagagaagatccaaataaacacaattagaaatgacaaagggggtggtaccactgaccccacagaaatacaaccatcagagactactatgaacacctctttacacacaaactagaaaacctagaagagatggataaattcctgtacacataacccctcccaagactgaaccaggaagacatggattccctgaatagaccaataagaagctccaaaacggaatctgtaataaatagcccaccaaccaaaataaataaataaaaataaagcccaggaccagatggattcacagccacatcctaccagatgtacaaagaagagctggtactatttatactgaaagtagtattacaaaaaactgaagaggaaggactgaaagtattacaaaaaaatgaggaggaaggactcctcccccaacccatactatgaggccagcatcattctgataccaaaacgtagcagagacacaagaaaaaaacaaaacctcaagccaatatccttgatgaaaattgatgcaaaaatcctcaacaaaatacttgcaaaccaaattcagcagcacatctaaaaggcaatccaccatgatcaaataggcttcatccctaggttgcaagtttggttcaacatatgcaaatcagtcaacctgattcatcacataaacagaactaaagacaaaagccacatgattatctcaatagatgcagaaaaaggcttttgataaaattcaacatcccttcatgttaaaaactcaataaactaggtattgaaggaacatacctcaaaataataagaaccatctaggagaaacccacagccaacatcacactgaatgggcaaaagctggaagcattccccttgaaaacgggcacaagacaaggatgccctctctcaccactcctatttaacatagtattggaagtcttgaccacagtaatcaggaaagagaaagaaataaagggcatccaaataggaagagaggaggtcaaactatccctgtttgcagacatgattctatatctagaaaaccccgaagtctcggcccgaaagctccttaagctaataagtaacttcagcagagtttcaggatacaaaatcaatgaacagaaataactagcattcctatacactaacacagccaaaacaagagccaaaccaggaacacaatcccatttacaattgccacaaaaagaataaaatacctaggaatatagctaatcagggaggttaaagacctctacaatgagaattacaaaacactgctcaaagaaagcagagatgacacaaacaaatggaaaaacattctgtgctcatggataggaagaatcaatatcattaaaatggtcatactgcccaaggcaatttatagattcagtgttattcctaacaaactaccaatgaaattcatcacaaaactagaaaaagctattttaaaattcatatggaaccaaaaaagagcctgagtagccaaggcaatcctaagcaaaaagaacaaagctggaggcatcatattacctgatttcaaagtatactgcagaactgcagtaacaaaatatcatggtactggtacaaaaacagacacatagaccaatgggacagaatagagagcccagaaataagaccacatgcctacaaccatttgatctttgacaaagccaacaaaaacaagcccattaatggggaaaggactccctattcaataaatggtggtgggataactggctagccatatgtagaagattaaaactggatcccttccttacaccatatacaaaaatcaactaaagatggtttaaagacttaaatgtaaaacccaaaactataaaaactctggaagacaactgagtcaataccattctggatatagatactggcaaagatttcatgacaaagatgccaaaagcaatcataacaaaagcaaaacttgacaaatgggatgtaattatactaaagagcttctgcacagcaaaataaactatcagcagagtaaacagacaacctatggaaagggagaaaatttttgcaaactatgcatctgataaaggcctaatatccagcacctacaaggaacttaaattgacaagaaaaaacaaacataaaaaagtgggcaaaggatatgaacagacaatttgcaaaagaagacatacatatgggcaacaatcatatgaaaaacagctcagcatcactgatcattagcgaaatgcaagtcaaaaccacaatgaaacaccatctaacaccagtcagaatggctgctgttaaaaaggcaaaaaataacagatgctggcgatgttggggagaaaaagaaacacttatacactgttggtgggagtgtaaattagttcggtcattgtggtagacagtgtggtgattcctcaaagacctaaaaatagaaataccatctgacccagcaatcccattactgggtatatatccaaaggaatataagtcattctcttataaagccacatgcgtgtgtatgtttattgcagcactatttacaatagcaaagacatagaatcaacctaaatatccaccaatgatagattggataaagaaaatatggtacatatacaccatggaatactatgcagccataaaaagaatgagattgtgtcctttgcagggacatggatggaactggagaccattatccttagccacaggaacagaaaaccaaatattgttatgttctcacttataagtgggagctaactgatgagaacacatgggcacatagaggggaacaacacacactggggcctgtcagagggtggagggtgggcggagggagaggatcagaaaaacaactaatgggtactaggcttaatacctgagtaatgaaataacctgtacaacaaacccctttgttacatgcttacctatgtaacaaacctgcacttgtaccactaaacttaaaaaataaataaatgaaaaaaaatcacagctagtgaagtagtgaggctaggactcatttctataagtagtatttagatttgaatccagattctattttactatatagtttgggctctatcttatatgtccatagtggaaaagtaataaatgattatcatagtttttctaagagaaaaggcaaagaaaagaagatgtagtatatatacatcatggaatactatgcagctataaaaaagactgaggtaatgttttttgcagagacatggatggagctggagtcaaactaacataggaacagaaaaccaaatactgtcacttataagtgggagatgaatgacgagaacacatggacataaagaggagaacaacagatactggggcctacctgatggtggagggtgggagaaggaagaaaatcagaaaaaaatagtaattgggtactaggcctagtacctgggtgatgaaataatctgtacaacaaactccatgacacaaatttacctatatgacaaacctgcacatgtacccctgaacctaagataaaagttgttttttaaaaaagaaacaaaatattacccacacctcaaaattacccatcatgaccccttccaatcatatgccccaaagataatgatctttttgtctttcatacgcttttgaacttttcttaaagagaatcagagagtatatacttttatgcctggcttccttcactaaacattatatttttaagtaccatccatattgtagttcattctctttgctctgtagtgatcaattgtgtaaatataccacaagttatttattctactgtcgataggttttgggtaatttccctgtttaagatattacaaatagaatgaatatgaatgttttttaacacgtgaatgaatgctatttagctatgaatactgctcttcttttccatgtgatttgagaaaagaaattattacattggtagagatataactcaccattaataatattatggtttaaggtttacatgtgatttaatcttattgatttgtaattatgattttagaatttttatctaaaactcagagatgttggaaattgtttatatcaaattggtaagaaaatttctattgataggaactttttctttttctcacttttataaagaatatccacttagcatccatgagtagatatgaaaggtgagtccaatacaggaagtgtctttgttgcctgagcataaggtatctaggcaaaatagcacaggaagatacaacttaatggtatcgtgaaataatttagattgaactccattatgattcattttatctaaatatttttaacaattatttttcatgtaaagctgtacatatagggcacattttactcctatatattactatatatattttttgaaaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatgtaaaagataaactttcaatatgattatgttaaggtgaaatataatactgttagtactggtttcattacttttgcccagaacaagatttttaatatagtagtattttttaatttttttacttataagtcactataactgaaatattgcttgggttacaaataatacagtaacttgttctaattctatcatcctaaagcaacaaactgcattcagttttaaatgaacatattttatttagttttatataaaatatattattttctattctgatattttcttttgcgtatgtgaaggtatagagaatatgtgcatgttactaaaaacaatgaaaacaatgtatttataatggcaatatagttttgttcttaaatttcaaaatttaggcttttaaggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataacagcatcagattaactgccccaaaatattactctcattaattactttcatatcttatttatgaaatgcaaaaacgtaaggataaattttgtgaaatatataagttcatttaattgaagttcttagggataaaaatgtgataaacttagtattgttttgaattttgtttttaatacccaggactagattagaatagaattcacatgaccttcagtaaattaggaataaaaagctaaggagaagaatggaaaaattaaaaattgggacatgatatgtatggtaagccttctttaattttcagtggctttagggtgacatcttccattctgatttttttgaaagaattaattgtaggcaagttttaaataaattattaaagacgtatattaatacatggttaacattccagaatacaaatcacaaaaacattatactcagctacaaatagaaattctgatttttaaagtaaactttattttaattgacatttaggttatgtataccttatttcaagacactggtttattggaaatatttaaaattcccactcaacaatttatgaactattttcgtgcattagaaaatggctatcgagacattccttgtaagtattaacatattttattatttaagttcaaataatatgggttttgaaactctttatcatctttctcttcagatggtcccttaaacacttttaaaactgcttgtttgaaattttcttttttttttttcttgagacaagagtcttgatcttgtcgtccaggctggagtgcaatggcgcgatcttggcccactgcaacctccgccccccacgttcaagtgattctcctgtcttggccctcgcaggtagctgggattacaggtgcccgccaccacacccagctaattttttatatttttagtagagatggggtttcaccatgttggccaggctggtgctgaactcctgacctctggtgatccacctgccttggcctcccaaagtgctgcgattatagacgtcagctgccgcgcctggcctgaaaaatttttaaatggagttttaaaaagaatatttgtattatactacctagatttaactgactactgttaacattttgtctgttttttgttaacattttggtatatattctccaagagttcttacataaatttattttttgtaaaggtggtcataatattgatacatatttatgatctgctttttcacctggttgttatacagtatacatctttctatttttaaaattaattgcctgtgtactttatctttttaaaagttagtcaagagtttcagaaaatcattcacttaaaaatgcttaaaattgatcatctaatttcagtttttaactgtgttctgatttatggaataatttaatggctattatatattatgtttgaatataatttgagtttcatattagaaaaagatggactgtctttatatattgtctacagtttccctccatgtggacacatttttgagaaattaattctataaatagtgaattattcttcaattggcataactcactaataatgtttaataatttaagatgagttacatatactataatttccacttatatattgtgcattcaaaaaagtggttggattttataaatggaatatagggatactttaagatggacttcaagggaaatggaacgaaaagaaagaggtggtaaggagtcttcactgtcagcttcagttaggatacattagttaagaaaatagtctctggacctaacttttctaaactttaaaaatttgtgaatgagaataacaatagtacctactccataggtagtactaatataagataattaatgtaaagcacgtatcagaattcatgacacttagtaaattgttagtaaaaggtggtgatttattaataataattaagttcccagtgtacgccatgtcatatctataggcaaaacaatattattttatctactaatgcatacatacacattaaatatttgttgaagtgttaaatttttattggatatcgacattaactgcaatcattagattcacataggttatcttattcaatcttttttggcaaagttgtattatctaacttttataggtgagaagtaaactcagaaggatctttcccaagattataaaactagataccaaagtagtgtttcagttttaggtctatctgagttctgaagcctatactctttacactatgccacattgccttttcacatagttgaatttcaggaaatagatgttttattgatcatatatgatgtgtcagacactgtgctggatgctttcacatatttagtatttaattcctgtggcaagcctgagacatagtatttctgacctttttgtgggggacacaaatgtaagtaaccagaatttgtaactgttctgtgtacaaaactgttttgtgtgcaaacatgggtctctgtaatccagacactacatgatatttttgaaagccagaaaatagccaccttgagaacattttccaatgcctttcaatactccttggttatcctgccttttctttggcacctttactatgttttcatagtatatgggaaagtttttaaaagatattttttttaatacatcaagagactttagatgaaataaaattcaattgtggggaattagtctgtcacatcttttttatgaggatatagtatgactaggaaattattgtactttttaaatgttgtgtgttaaacctaacagaaaaacgttttggtgactttagatcacaatcgtatacatgccacagatgtgctacatgcagtttggtatctgacaacacggccagttcctggcttacagcagatccacaatggttgtggaacaggaaatgaaacaggtacttccttctacaaatctcttaattattttgatcaggaatagtaaatcaagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaaattttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggccaggagtttgaaaccagcctaggcaacaaagcaagaccccatctctacaaaaaaatttttaaaaaatttagctggatgtggtgacacacacctgtcctagctactcagaaggctgaggtgggaggatctcttgagcccaggagttcaaggctgcagtgagccatgattatgtcattgcactgacatatatcaagacagaatttgctcagttaccaatacttgagaaataacattaccatactaaccagtgtaaatgtcatagactcaaccactgatattactttttacattttggtagttgagtctaaagtatgcattatttgtttaatggatttgctttatgtcactggttcatttttgtctgccatctgtatttattctttctagtgcccttcattccttccaccagtcctgtgcttttattagagataattttcttcaacttttttgttttagctgtcattttgtcttagaagaatatatttatattttagcatgtttgaaggtattattccataatcttgtgactttcacagtttttgctgacaagtcaagacttaggtcatattgagaaatataatatataaatataatatgttcctttttctctttcctattggtttttagcattttaactatgatgtactcatgtaatttttttttgtattaatcctgcctgatgtttagtgaaccttttgaatatgttgattggtagttttttactggtttctatcatgctcttcaaaattcagcctctccattgtctaattccaaagccgctcccacatttttaggtgtttgtcacatcagtacctcacttctaggtgccaaaagtctgtattagtttcctattgctgctgtaataagttaccagaaatttagtcactgaaaaccacacaaatttattatcttacagttctggaggtcagaagtccaaaaaaggcttcactggagtaaaatcaaggcatcaacagaactatttttctcctatatactctagaggagaatttgtttccttgcctcctccaattacactccttggctcatggccctttctttctttctttctttgtttattttggagacggtgtctcactcagtcacccaggccagagtacagtggcttgatctcggctcaccgcaacctccgcctcctaggcgggttcaagcaattctcctgcctcagtctcccaagcagctgggactacagatgcacgctgccatgcctggctaatttttcgtattttagtagagatggggtttcaccatgttgcccaggctggtctggaactcctgagctcaggcaatccgcccacctcagcctctcaaagtgttaggattacaggcgtgagccactgtgtctggccggcccattctttaaagacagcagcataacatcttcaaatttctttttgaccctgaccttttgatctttccaaggaactagtgaaaatcaatccagctctgcaaccttggctttctgtgcagaacacacttaactgacagtgactctcttaattttagtctctcttgtagtctggataggctgagaatttcctgaattatcaagtccttattcctctttgcttacgagttctcccccaatctttctttttcctctcatatttactataaacagtaagaaaccagactacaccttcaatgctttgcttggaaatttcctcaactaaatgtctaagttatcatttgtaagttttgtattccacataactgcaacacctaattcagccaaattttctgttactgtgtaacacggattcccttgcctctagtttccaataacatgtttctcatttccttctgagcattcattggcaatgaccttaatgaccatttttctatctccagtctgttctcaatgacttaggtatagtattctctaagacaatatatgttttctctctcatgctgcacacttccttctgagttcttactagcagtgttatgagttctcatacatagtgttatggagccaagtatctgtagaagaaaggaaaccaagtagctttgggaaaccaaatagctattgcaatggaaaattatgatgaaaactaagacaagaaggaccatgggatgtgctgtcctattctcactgcactggagaactaatggaaaataaatgacaagtttagggctgtaattaatggttggagaaccaggtagcatctctgactgacctaaaagaaacccttattttttttttaatttattttattttattttttttttgagacggagtctcactttgtcgcccaggctggagtgcagtggcgcgatctcggctcagtgcaagcgccgcctcctgggttcatgcgattctcctgcctcagcctcccgagtagctgggaccacaggcgccctgccaccatggccggctaattttttgtatttttagtggagacgggttttcaccgtgttagccaggatggtctcgatctcccgacctcgtgatttgcccgcctcggcctcccaaagtgctgggattataggtgtgagccactgtgcccggccaagaaacccttattttttatagtaataggatcataacttctgaaaataaaacccaatgtctgatcctgaagttgcttgaaatacaatgcaaatgagtttgtggcctcagtagacttcttatgttagaattaagatatcaaatgggaaataaaggatcctgataatcaaaaagagatcatttggatagatttaaataaatgttgccttgtattccccaaatcctgctgattcttcatgctgggaagcagtcatttctccttgtgttgattgcctgaaaaccctgtaattacctcacttgagattcttgatttatagggaaataattcacttctaaatccaactccactgtcactcatttctttgagatccataattaaacttaaatcctgcagatcttaggggaataagtattaagtctgaacaccagaataatttaccaattcatattggtagaaacctgggggatatatgtctgaatagacttaagggtgttagaccagggagaaaggaagatgtacctaccagagattctggagtcagtgtattagcttgagcaactggcagtggctctaacagtttgcctcatgagttgtctaaagtataggcatcagatgaagtagaattgttgaaactccttgtatactgtagaggaaggaatccagaagctcacaatgttaagatgttgaaatggggtgatcatattcaattttatcacccatccctaattttatccccaagaagtatcctcctttatcacagtggtgagaaatatatttcagcattaattcctggagagtgaaatgctatgctggtcctacagccagagttaggggcctatggaatttaggtgataaaaggattttggcctgggttcatctcataatggtagttagcagaaccacacccattttctgaatgtatagtttgagtaaacatattcagcaactgtcagaatcccttcatcaattccttgatctttggaaagaggaccatcgttgtaggaaggatcaaatggaatctccaggaattgcctcattctggcaaaacagtgaaccaaaagcagtataccacattcctagatgagttgcagaaatcagtgctactagcaaatacttaatagatgcaggaatggtgatttccatcacattgctgttcaacttaattatatagcttttacacaggataagtagatcctggaaaatgatggtggattattctcaatgtaatcaggtggttactctagttgctacagctgttccagatgtggtctcttcttttaataagttaacctaacttgtgatatttggcacagagcaattgatctggagagttgtttttcctccataactcatagcaaaattcacaagaagacatatatttacatctggcaggcatcacaatacacttctattgtcttagttctgggctatgtcaagtctttcattctctgttataatctagtctgttcccgtaagttatcaaggtcagccattacattgatgagataatgatgaatagctccattgagcaagaagtaacagatatcctagatgccttcataagagtgccagaagatgagagatgagaaaaattgctaaaaaattcagagatctgtcatatcattgaagtatactagggatccagtggtctaggacatgttgagatatttcctccgagttgagggataactgatacatttgaaattctctacataaagggctctttggattctgaaggcaaattcatgacttctgagtactattgctccaaaatactactgtaaggctgtatgtgcaacccagagcaagagaagcatgtgaagcaatttctactcgttgtgcaaattactctgccatttttccatctgactgccaaaagaaaatgtcttttgcagatagagatcccctttggagtctctagaagaccactacaagataattacagtgtaaatacatggagttttgaaacaaaaccaggcagctttcctcaaataattattttcctttctgtaaaagcagctaaattgttgttgcactttggtagaatctgaatacttggccatgggcactagattaccatgttacctgcccataatgaatttggggccctctgatcctccagttcataaatttgtcatgtgcagtagttctcaatcatcaaggggaagaattacttacaagattagttttgagttgctcctaaaagcacagaatgtaagttcagacttccatgacatttattcctaatacaccaatacctcttccttaatccatagttacggctttgtggggaattccctatgaccagttgacttaaagagaaagaccagttgccctggtttataaatagttctgcccaatatgccagtacttcctcaaagtggatagctacagcattgtaggatcactcaaaggtatcttttgaaaggtaataaggtaaatccttccagtgagcaggtcaagcggtgaatcagttggtcaagaaagagacatggccagctgaaaggatctgtactgatttatgatcagtagctaagagcttccttggatgctttgggacttagaaggaaaaatattttaaaattggagtttttaattggacaaggtgttttagttagggggtttatggctaaccttcccagagtggaaggtggatatttgtttgcgatgtgaatgcttactatgatgcttaattttacatgtcagcttggctgggcagtagtacctacatatttggtcagacattaattttaatatttccttcagggtattttttggatgagattaacatttaaattgatggactttaagtaaagcagataaccctccataaggtcggtgggcctcatccagtcagttgaaggccttaatagaaacaaagagtgacctcctctgagcaaacaggaattccaccagtagacagccttcagacttgaactggaatatcagctcttccttgggtctttagccaatcagcccaccctgcagattttggatttgccagcctccttaatttcatgagcaagttccttaaaataaatctctctctctctccctctctctctctctctatatatatatataaaatatatatatgaattatatatattcatatatatatatgaataaccctcactaatatataatatttgccaaaggccattcactgcaaagaaggctcttgatgatcaggtggacaaaatgatctcttatcttatagcgatcagtctctttccctatgaactccagttcttattccgtgggtttatgcacacaacagctaagtgtattagtctgttctgacattgctataaggaaatacctgagactgagtaatttgtgaaggaaagaggcttaattgagtcacaattctgcggctgtacaggaggcatggctggagaggcctcaggaaacttacaatcatggctaaaggtgaagggaaagaaaacaccatgtttctcaggctggtctagaactcctgagctcaagtgatccacctgcctcggcctcccaaagtggtgggattataggcatgagccaccgtgcctggcccatgctgttttgattactatcgctttgtaatagattttgaaatcaggtagtctgatgcctccagctttgttctttttgctcaagattgctttggctacttggaatgtttttgtggtgccatatgaatttttttttctatttctctaaaaatgtcattttttttgttgctaagtatgtagaaatgcaattgatttttgcatgtttatcttgttccctgctaacttgatgaactaatttattagttctaatagtttttcagtagatttcttgggatttcctacatatacgagattaggccatctgtgaataaagatagttttgcatcttcatttccaatctggatgtcttttactgaggcgtccttttaaatgtgtcagcaaatttttaaaatcacagttttctgaaacgaagtgaataaatgggattctaagtagttatgtttcattgcccttgccaactgtgttcttttttgtactgttatttttttggaaacatatataagctaatgttttaagatcctaatatataaattccaagtaattactgaatttaaaaggaaatattttgccatgtttgatttttaaaatatattttaaaattgtagggaaagtccagaatgtgtatcacataggaaaattcaaattattgactctgtattgatatttaaagtcttattagaaatttgagtgcttacatatatcattatgcatataatttaactgcctcatgtttgctttttataattatttaaaaaatagctctaagccggtgtagtggtacataactctagtccaagctactcaggtggctgagggcaggtcaattgagatgaggaattagagggtgtagcgtactattacgattggacctatgaatagctagctgctgcactccaacctgggcatcatagcaagaccccatctctaaaaacataaattttaaaaaaatgctctagtgtgggctattccaaaacttaattttgatacaaattataaatagcatgaaaataatgagatatatttataattgtcactagtgtattaaagtcatgttaaaaaattcttgtgatggtgtattgagtcaactaaaataggattaaataattcttttggactttaacaagccagagcattatttctaggttcccccaatgaatacaaccaaggaaactttgtacctaatatctgtggttttatgtgtctactttaaatatagtttctttttccttcttatactttttaaaggtttcttttgcaaaaataatagaatgatcatctagatagataaagccaccaaaaaagaagaaatcaatggtaagatattaagacaccagaagcacagtgtggatagtgaacatattgtttctaagaagaggataaaaatagagttatgttgactgagatgttccccagttttccatgccttttcattttccactattttttattccgttatattatatggagcttcatgaaagaaaacaaaagggagataaggagttgtagttagggctacaaatgaaatgtaatctttccggatgagatttgaaaagcatctatgtagagaagcttagtttggtaagatattaaattcctaaatctttgtaatgttttcatcaaattttattctctagtattgcctttttctgttatatcatatatcctggccattgtatctatctagtcattaaacagcaaatatttagaaaatcagaggtttttaaaattattatttgcctgagtaagcatcaaacttgtgtgagaatcctatcacgtcttgtaaagtaagcaacttcagggtcagatttaacactgttcctctctactaacatgttaaattgggaataatatactcttttaagttcatagattttagttcttacttaaatcagcaaataaaataagtaagcatattacctatgagaatcccctccatagcaaaattgtgaggaatttatgtgctaatgctggtttattttgctatttattgtttctcagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggtaggaaatatttttaagaacctttaaagagtaattctgaaattttcagtcatgctgtgtatccctttataaatcattcagttgaatcatatgtccaatccatctgactttaataccctacattttaattaattggataacacatggcattaatgtgatgtgtgctaggaaattaggggaagaatcaacttcttgaactagaaaataatagacagtttttgaaacaactcattgttttgtgaaattctagagtccttgctgtcaatatttttgtctttaatcaaaccagcaaaactctgactgtatttaagatttctgttccgctggagccaagatggccgaataggaacagctctggtctacagctcccagcgtgagtgacgcagaagacgggtgatttctgcatttccatcggaggtaccaggttcatctcactagggagtgccagacagtgggcacaggacagtgggtgcagcgcaccgtgcgcgagccgaagcagggcgaggcattgcctcactcgggaagcacaaggggtcagggagttccctttcctagtcaaagaaaggggtgacagacagcacctggaaaatcaggtcactcccaccccagtactacgcttttccgacgggcttaaaaaacggcgcaccaggagattacatcccgcacctggctcggagggtcctatggccacggagtctcgctgattgctagcacagcagtctgagatcaaactgcaaggcagcagcaaggctggggaaagggcgcccgccattgcccaggcttgcttaggtaaacaaagcagctgggaagctcgaactgggtggagccaaccacagcccaaggaggcctgcctgcctctgtaggctccacctctgggggcagggcacagacaaacaaaaagacagcagtaacctctgcagacttaaatgtccccgtctgacagctttgaagagagcagtggttctcccagcacgcagctggagatctgagaacgggcagactgcctcctcaagtgggtccctgacccctgacccccgagcagcctaactgggaggcaccccctagtaggggcagactgacacctcacacggctgggtactcctccgagacaaaacttccagaggaacgatcagacagcagcgttcacggttcacgaaaatctgctgttctgcagccaccgctgctggtacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagaacgcctctcctcctccaaaggaactcagctcctcaccagcaatggaacaaagctggacggagaatgactttgacgagttgagagaagaaggcttcagacgatcaaattactctgagctacaggaggaaattcaaaccaaaggcaaagaagttgaaaactttgaaaaaaatttagaagaatgtataactagaataaccaatacagagaagtgcttaaaggagctgatggagctgaaagccaaggctcgaaaactacgtgaagaatgcagaagcctcaggagccgatgtgatcaaccggaagaaagggtttcggtgatggaagatgaaacgaatgaaatgaagcaagaagggaagtttagagaacaaagaataaaaagaaacaaacaaagcctccaagaaatatgggactatgtgaaaagaccaaatctatgtctgactggtatacctgaaagtgagggggagaatggaaccaagatggaaaacactctgtaggatattatccaggagaacttccccaatctagcaaggcaggccaacattcagattcaggaaatacagagaacgccacaaagatactcctcgagaagagcaactccaagactcataactgtcagattcaccaaagttgaaatgaaggaaaaaaatgttaagggcagccagagagaaagattgggttaccacaaagggaagcccatcagactaacagcggatctctcagcagaaactctacaagccagaagagagtgggggccaatattcaacattcttaaagaaaagaattttcaacccagaatttcatatccagccaaactaagcttcataagtaaaggagaaataaaatactttacagacaagcaaatgctgagagattttgtcaccaccaggcctgccctaaaagagctcctgaaggaagcactaaacatggaaaggaacaactggtaccagccactgcaaaatcatgccaaattgtaaagaccatcgaggctaggaagaaactgcatcaactaatgagcaaaataactagctaacatcataatgacaggatcaaattcacacataacaatattaactttaaatgtaaatggactaaatgctccaattaaaagatacagactggcaaattggataaagagtcaagacccatcagtgtgctgtattcaggaaacccatctcatgtgcagagacacacataggctcaaaataaaaggatggaggaagatctaccaagcaaatgaaaaacaaaaaaaggcaggggttgcaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtaacctacaaagagacttagactcccacacaataataatgggggactttaacaccccactgtcaacattagacagatcaatgagacagaaagttaacaaggatacccaggaattgaactcagctctgcaccaagcggacctaatagacatctacagaactctccaccccaaatcaacagaatatacatttttttcagcaccagaccactcctattccaaaattgaccatatagttggaagtaaagctctcctcagcaaatgtaaaagatcagaaattatggcaaactgtctctcagaccacagtgcaatcaaactggaactcaggattaagacactcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccagaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaagagagaagaatcaaatagacgcaataaaaaatgataaaggggatatcaccaccgatcccacagaaatacaaactgccatcagagaatagtacaaacagctctaagcaaataaactagaaaatctagaagaaatggatacattcctcgacacatacaccctcccaagactaaaccaggaagaagttgactctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggattcctccccaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttcgggccagggcaattaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctgaggacacaaaatcaatgtacagaaatcacaagcattcttatacaccaataacagacaaacacagagccaaatcatgagtgaactcccattcacaattgctacaaagaggataaaatacctagcaatccaacttacaagggatgtgaaggacctcttcaaggagaactacaaaccactgctcaatgaaataaaagaggatacaaacaaatggaagaacattccatgctcatgggtaggaagaatcagtatgaaaatggccttactgcccaaggtaatttatagattcaatgccatccccatcaagctaccaatgactttcttcccagaattggaaaaaactactttaaagttcatatggaaccaaaaaagagcctgcatcgccaagtcaatcctaagccaaaagaacaaagctggaggcatcacgctacctgacttcaaactatactacaaggctacactaaccaaaacagcatggtactggtaccaaaacagagatatagatcaatggaacagaacagagccctcagaaataacgctgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggagataggcatgggcaaggacttcatgtctaaaacaccagaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaaggattaatatccagaatctacaatgaactcaaacaaatttacaagaaaaaaacacacaaccccatcaacaagtgggcgaaggacatgaacagacacttctcaaaagaagacatttatgcagccaaaaaacacgtgaaaaaatgctcaccatcactggccatccgagaaatgcaaatcagaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgctgctataaagacacatgcacacgtatgtttattgcggcattattcacaatagcaaagacttggaaccgacccaaatgtccaacaatgatagactggatgaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcagtcataggtaggaattgaacaatgagaacacatggacacaggaaggggaacatcacactctggggactgttgtagggtgggggaaggggggagggatagctttaggagatatacctaatgctaaatgacaagttaatgggtgcagcacaccagcatggcacatgtatacatatgtaactaacctgcacattgtgcacatgtaccctaaaacttaaagtataataataataaaattaaaaaaaaaagatttctgctcctcctatttaggcccattgtatggctagaaagctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggaactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagccaccacgcctggccctaaatacgtggttttaagtagaatttagtgtggttgtggtttaagcagatttttgtgtggtagctgggtttgtttatgctggggattcctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaatggcatagtggaaaaagcactggacgagattaaaagtcctgtcttagatttctgattgcccacttattagctgtatgacctcaaataaaggtttattcctctgaacctaaaaatagttatctgatatgattaaggaggtaacatatggaaggttttatactgtttctgatggcatgagaagctcctgaatcagaaatcacataggtagaagttacttactgttctagtccactctgctgttttgttttgctttgttttgttttgagacagagtcttgctgtgttgcccaggctggagtgcagtgacgtgatcttggcccactgcaacctccatctcctggattcaagtgattctcctgcctcagcctcccaagtagctgggattacaggtgcctgccaccatgcccggctaattttttatttgtagtagagacagggtttcaccatgttgaccaggctggtctcaaactactgacctcatgtgatctgtccgcctcagcctcccaaagtgctgggattacaggcatgagctaccatgccggcctactctatgtttttattacagctttcattttcgtaaagtatatcttccctcaaggatgttagaaatgagtgaattccaatgttaactgtctcacatgaagataatttaaaacaatgttatatgaacaacttatacaagttgcatactcaattgttgtcctaatcaaaatacagttgtgaagtctgaacatgatatcaataatcacgttatttctaacttctcattgttacgaattgccattagatgaagccataggaagtgctagaatggaaaggagatggattagagagttcagctgtgaaaatgcatagcctcttacctagtctccttgcttgttgtctgctctccttcagtctgttctcaacatgtcagccagaatgtgaccctgtttcagtgtgttgcatcactctgttccagactcttttgccaggcgctgtggctcacacctgtaatctcagtgctttgggtggctgagacatgaggattgcttgagcctaggagtttgagaccaatctgggcaacatttgagaccctgtttcaaaaaaataaaaacaaaatagtaaactctccaatggcattcaccttacccctagtaaatgacaatcataaaatgttctgcaaggccctacattattggtcccattaagtctctctctcttttttttttttttttaacttactcaagtctagtctcactggcttccttgctaataccatctctgtccctttctgagagtgtttgcactttctgttctccctgcccagagggcttttcctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaaacaaaattttaagttgagatttttaaatgttttgtcttccaaaatatggattaagatgactaaacacatgaatctgttaccccttcttcctgagaatgcattaaaataatagtaagttatgaagttcattacaacagagagcagtaagaggaggatgggtattatcaccagcagataaaagttttttttataacatttctggaaaatgaaaaatggatgaatattgacagataaaacaaaagtacccagcacagctggaaccccagagactcctgttaccatttgctcctgcttgctctccctgtgcatacacacacctttatgcagagtgactaaaaccctatgtttacctccaggcagaaaactcatctcttagatattgaaggaactgcctggagagagtaacagttcctggagtgggtattagtagtctaaagtaaatttctctcattctagacatctaatagctggcacccattattctaaagcaaaacttgctaggtaacaaaccctatccacatttacatagttcccactcactcatcccaaggggagagactccacaataaaacatacataacagcagagagattacaactgaaatctagaattttttttttttttttgtgagacagggtctcactctgttgccaggctggagtgcagtggcacgatcttggctcactgcaacctctgcctccagggttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagattttgtttaaaaaaaaaaagaattcccgagaagatgaaaacaatacatctataaaagaacaaaaattcaactgtcattgtattttagcaacaatagatgctagacaatactggaatgaagtctctaaaattctaggggaatttattcatttatttatttgttcaagtatttattgggtgcatattgtgggataggcactatttaggcattgttatattaaataaaacatgggaaaaaatcttgcccctcatcgaacttacattctagtacagcaagaaaataaatacataaataatgtgtgtgagcaagagagagagagagagacagagacagagcaagagaaagagagaccaagagagacagacagagagagaaagagaagattatgacttaagagctaggaaataagtaaaatgagaggagataggaagtgctggcataagagtattattttcaagttagagttctatattcagctaagctaccattttacatgagagcaaaataatgagattctcagatatgcagtgattttaaacagtcatatcttgaccatcctcagaaagttattttaaaatgtatttcagcagaagaagggtggtaactaagataaaggaagataagggattattagaaatttttgaactgatacggtttgtctctgtgtcctcacccaaatctcatctcaaattgtaatcctcacatgtcaagggcagggccctggtgtgaggtgattagaccatgggggcaggttctcccatgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgtttgtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggctatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagcaggtaacaagatgctttagcacaaagtcaaaggatgttagtttattgcagctccaaatgagctgggaccctgtcttttttctctgcttctaagagcccgcagtaagagctgaggcttcattatctgtttgcttgaaatgtttttcttatttggtttaagcttggtctgctgctctgtgtgctaccttcaagtattcttctaaagtagcattgacatttgcttcctacttactgcttcatgattctttcttgcctcccactcatctttgagcttgtgagtctactggggatcagcagggaaccccttccacttactcttcatataggctttttccttcttatgcagtgacttggttagcttttctcaatccattctcattttcaccatgtctttgaagtttccagtatggtcattatatctagattctaatactgattcagaccttcccccctccgcccattttatatttctttggcaatttcaaagggtaatttgaatggtgaaagaattccgaacttgctcatttttttaaaaaactgatcttgctatctgtaagtttattaagtcagctagcttcacagggcattcattgtacattgtgttgtattgagcccagaatcagattacttcctcctgaacagacagagctgttctcatagttaagtccttgtcacatttgagcatgaattagtcaaatcattattaaatgtaaatgaccccttagggagttttcgaagcttactctttctgtttggtatttataatgtttagaagttgtattacaggtggtatgaaatgcctttatatggctcattgcaaagtttaaatcataccattgcttttataaaaccaaatagcttaaaaaataatcacttagtgttatgcatctgtgcttaaatctaggctatagctaattttcacaaataagtagagctattcaattaagctctcagaatatgtatcctacctgagatctcattccgtccttctttctcattacacagtaggctccatgaaaacagggatagggttttaatttttatccctggcctttaacacaacttggctgtagaagtttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatatatatgcctatatttttaaaaataaacatttttattgttatggtaacatttcctaaaatattattgcttgttatattttctttcgacacataaacttatactattgtgactttatttcacatatttttcacatagaaacaaaccagttattagaaacaaaccagttatttcaaatgagtttaaagagagatttgacaaagccatgctcagtgtcaagtaaggcattatataaaattaactttatgtgtttcttaagaatccagttaattatgtctacctcactgcacctgttataccttctttatattagtgattctttagctggctagtttagggaaaaggaagcaccctcttctacttgagaataattcattcattcaacaagtatttattgggattgcccactatgtacagacattgtactaggccaaagaactcatattcaccaggggatcaagaatcactgccccagtatgacggtggtactcatgggactatgctttatccctcagacatttgaggtgaaaaaagttgagaaccactgctttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtcttatacattggcatgcttccagggttgtgttacttctcccaattcatcctttgaggtggctgtcacatgtgcagtgacctgccagcacttgggaggggccacatacacagtgtgtttactgaaattgtactcatgctcacttgaggcatttttcccttaccagcccagtgttcatggaagaaggtcatataccaattaaactccaccattttgcctcttagtgcacatgcttgagcccactcacccacctcctgagatcttaccaggaagctgctgatcaccagtttctgttgggtgactgcctttccctggtgccagctgtgaccaattattattttagagagacagcttaacctatcacctgatggtcacctgacatttctgatggggttgggggtgggccctctcctgctctgcccatgtctgcctgactactttctataacaagtctagactacattatgattccaaggtctctttcaaccctgagattctgtaacctagaagaatttatttccagatgaagtggtttttaagttattcagggtgtgctcagaatatatttaaagaatatcaatccattttcaattctgctataaaaagactaactccctgcagtaggaacatcaactgggaagaaatccggacagagggctacaaaatggagagaatagacacttagtggttctcaaggattcaaagatataagcaggctcttttgttcttaaatctttttttgagacagaggctttctctgttgcccaggctgtagtgcagtggcgcgatctcggctcactgcaacctctgccacctgggttcaagcaattctcttgcttcagcctcctgagtagctgggattacaggtgcacgccaccatgcctggctaatttttgtatttttagtagagatggggtttcaccatgttggtcaggctggtctcgaactcctgaccttgtgatccgcccacctcggcctcccaaagtgttgggattacagacataagccactgtgcccggctgttcttaaatctttaatttttttttaaattattctttaagttctgggacacatgtgcagaaggtgcagttttgttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatggtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaatattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcatacataacagtattagccttaaatgtaaatgggctaaatgccccaattaaaaggcacagactggcaaattggataaagagttaagacccatcagtgtgctgtattcaggagacccatctcacgtgcagacacacataggctcaaaataaagggatggagaaagatttacccagcaaatggaaagcgaaaaaaaagcaggggttgcaatcctagtctctgatgaaacagactttaaaccaacacagacagaaaaagaccaagaagggcattaaataatggtaaagagatcaatgcatcaagaacagctaactatcctaaatatatatgcacccaatacaggagcacccagattcataaagcaagtttttagagacctacaaggagactcagactcccacaaaataatagtgggagattttaacaccccactgtcaatattagacagatcaagacagaaaattaacaaggatattcaggacttgaactcagctctggaccaagtggacctaatagacatctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccaggtaaataatgaaattaaggcagaaataaatagacacaatgtaccagaatctctgggacacagctaaagcagtgtttagagggaaatttatagcactaaaatgcccacaggagaaagcaggaaagatctaaaatcgacaccctaacgtcacaattaaaagaactagagaagcaagagcaaacaaattcaaaagctagcagaagacaagaaataactaagatcagagcagaactgaaggagatagagacacagaaaacccttcaaaaaaatcaatgaatccaggagctggttttttgaaaagattaacaaaatagaccactagctagactaataaagaaaagagagaagaatcaaatagacacaataaaaaatgataaaggggaaatcaccactgatcccacagaaatacaaactactatcagagaatactataaaatttttggcattaaaataatctttccactttgctgaatctgccattttttggggtcccgttttgaggcttcctacaatgtaggagtgcactgatttcctgacatgcctaacattttgttatctccaaaatagcaactacacctttttggctttggaattacattccttaggaatccttgttggccctaattatcaggaaaggtcaacatatctactaggtgagggctttcttaacatgagtggaaagtgggagtaattgagcctatataaccatgcacctggtatactttgttacttccagattgtattgaaaatgtgcaatgttttacacccaccagctaaacatcccaacacaataatgtatactctgctgtttataagttacaaaatgccgtactgtataatcatggaaagattattaatattttactattatctatttaaattatatttaatttcgggtagtaaatggctatatttacctaatttgtaagattatactatgcagtttgcatattctcattctcagtgataattgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatcccactaggcagctgaggagcacaacttccatagcagcctactaatctgctgttcacatagacttgagaagtagatcaaaacagtgggggggaggggggaaggaaaacatacattccctggctgtagagggagagccaattttgtggcattatgaatttgagttaccaaactgtaatgacatactttcctgtataagacaattagtataaatggaaaatgaaatgaaaattatcactttgtaattgtgaatgaaatcagttatttgctcattttaaagtagaatttaaattatacctacataagtattgttttgattttcaagcatgcaataaatcagaccagacaggaaaactacaaagaacctcccactgcaacacacacatgccttgtatttaggattagcatggcaaatcctattaaaatgtatttaaaattctttttttaaaaaaatggcattagcatctgaaggttgactgacttctaaaaattatactcccccatctctactaaaaatacaaaaatatgctggaaatggtggcaggcgcctgtagtcccagctactagggaggctgaggcaggagaatggagtgaacccatgaggcggaggttccagtgagctgagatcgtgccactgcactccagcctgggcgacagagcaagactccgtctcaaaaaaaaaaaaattgtactcatcaaaatgttggtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaattacttcatgatttgaa

SEQ ID NO: 278 - DNA, 14196 bp, Homo sapiens
ttggctttttgatgctgtgacttttattctaatacacacattgatttgattaaaccaagttcagggataaggcaaatatacattcttgttcccgaaaacatcccaggcagtttcagcgtctttcagcacagatgaggtagggttggggctgcaatgtcatgcctaacctgggcttcagatctggaactagttcatgtggaaaatgcaaatgaaacctctgaagcaatgctgtaaaaaacaagaacatttccatccgagccaagtgttctccaagacaatgtcttcttcctaaacagaaaaagcagatacaataattttttaaacccacaatctttaccaaaattaatgtctaatatttggatgtcattcaggaaatctggaatttaaacaaagaaagagggaactatgtttattaaaggattttcttaaatctcaaagaatagaaattgacacttcagcaagcagaacccattcatttacctccttttgttagaccacggacttttgtaagactttagttccatctcccacttccctcctatgctgcaacagagcctaagatatgccacaaaagatctaatttgaggtgagacattttgctcaagaacagtccacttcatttcaactaagtgtgtattcttctccagtgaaggggaagagtttctagtccatcttccatgggtcttgtgtaccttttcacagaagaagcaatattttcctaattgaagatgaagtacaataaccagaagccaagagagtgagattctagttttacttaagtgactatatcttttccctctctgggtctcagtttctcaagctacctgttactgaattctcattccacaagttttgaaaaacagatttagaagaagccaggggttctcaaaagttcatctatagttaataaattaaggcttatattaagccgaaacagatgttaattacttccaatttaatcattctctcctgttagaatcagttctgtgtttttagaattgggatatttaattctatagaaggatgcttcagattaagatgctgtatctaatgaattatcattatcctttattctaaagttacgccccgtgaaagttctcttacctagggaaaaaggaaccaaagcttccttcttggcaaaatatccactgctgtccagaaatcgctcaggatggaacacttctgggtctctccagtacttttcatcaaagtgtacagaataaagatttgtaattactgttgtgcctttaggaatggaataaccacgtacaactgcatcttcagaggttgcatggaaaatccctaatggaactatattacagaatcttaaaacttcatgcaaaactgcctcagtataaggcattttgcatttgtcgtcccaagaaggcttcccattagggcccataattaaatcaatctctttctgaacttgtcctgtcagagaaaaagtattcaagttattatgcagttcttagaattatacctaaagttatttccctctggaataaaataaaggataacctataacaagccaataggatatagatacatccagattcagattttttattatctgggcgttctattgaaatatatgctatatatcttgtactaacagtagccagtgctctgataacctataacaagccaataggatatagatacatccagattcagattttttattatctgggcgttctattgaaatatatgctatatatcttgttctaacagtagccagtgctctgggtagctctattgtgaaagacataagtaataagaataaacattaaacatacctagaattggagtaagaaaaatagtaaagcataaaattagtttttaaaattctatcagagttcagattccagctctgccacttgcagacacacagtgttttttctcatttataaaatgggcataataagacctctttcagagattttttttacatgaattgagataatagatttgaaaactcttttttgtaactattaaatatttctatacttggctggcatcgcaggagttcctaaagaaaatgtattgtgcatggccaagactcaaaaacatgtatgaaccctacatgtaaggatagaccctgagatcatcaagagaatcctcaccttgaatattaggataaagggccatgaaaagaatcgcccaccgtagcacattggttgtagtttcagttccagcaatgatgagttcacccactgagaaaattaggttttctttggagaaagtagatgatgggtcatttttaccttgatccatctcatctaaataagcatcaacaaaatgctgaggtagctgaggctttctgttgactgaagctttttcaatgagtctggagagaaaatcatagactacagctgcatttctaaacagctgttgatgttttccaaaaggcaggatgccaatccatggaaaggcattatacaagaagactgaggcactggcagctagttccacattttcactaaataactcaatcatgtgctgaaaatcggtgtcttcataagtgaatcgttctccaaaaatgatcagattggttatgtttgaaacagcattcgttattaactgtttaaagtcaaaaggtctacctttgtatgtttcaatagcatcattgaaaaatttggtttcttccaagattttagattcaaaagacttttggccatatccaaaatatcgaaaactgtttacagctaatcgtctgtgatcaacccatcctcggccatatctggaattgagtaagcctgaaaaaaaatattaaaatattgtataattcctacttctctgtatctaaaaaatgaaagggaacaaaatttttttaatggatggttagtcatccttctccaaattgtcctcctatataactacatggttgggtcctgttctcagcaactcattagccagagtattataacagataaagtttttctactccttatctgtggactggcagaaaaggcctataattgcaccaccacaagaagctagtcagtcctgtgtaatttaacctggtgaaataggcccaggtgactatattatccaacttttactataagcctaatttaccaaagacaaatgaccacatgttcaatggacaaagttttatcttagactaaacaaacacctaaaaaatcatccttctaggattagaaattttctgcttaaaagagaatggattttagaaaataaatttcctcccattaaagggatatggtagacaatcaagtaactatgacaggggtaagggtactctgaatgagctgtcaatatagtcgaaatgctgaagtcaaaaaaagggcaaacatgaagctcaaacttttctaatgctgatattgcctgccttaaaatttcagagtctccacaatgtatctgctgttttgatgttgctactattgaaattttctcccttaaattaattcaacatcttcagtgcacatatttatgtaacatgtactttactcaaaatttcactcattactgggacacggttgtacctctgataaatttcacattgataagtgattcccaatgttggaggtggggcatggtgggaactgattggatcataggggaagatcccttatgaatggtcttacaacatccccttggtgataagtgagttctcgctcagttaatgtgagatctggttgtttaaaagttaaggacctctccctacttgctctgttgctaccactcttgccatatgacatgctggctttcctcaatgccttctgccatgattgtgagcttcagtagaagcagatggcctcaacagaagcagatgccagcaccatgcttcctataaagtgtgcagaaccatgagccaattaaacctcttttctttataggttacccagcctcgggtatttctttatagcaatacaaaatggactaacacaacccacaatgaaaaatgtcacattctcttgtgtacatgaggtacacacaaaatttacattccaacaacttattgtgcaataatttttgaatgtagaacttattaaaaagttactgtaagggggtcattagtgctgtgtagcaatcttacattcccatagtccattcttttttctatactcccagatgactattcattcaacaaatattcatttaacatgtatttgtggaacacctactatgttccaggcaatgttctaagtgtcaggaatgtatcagggaacaaaagaagcaaaggtccctgctctcacagagcttagacactagtaggaaagacagacaaaacaacaaataaattatacagcacgtaaaaagatatagggtagtcagcaaaatgctcactgagaagatgacatctgagtaaacattcataggagatgaggaagtgagacaagcaaatacctgaggaaagaccactgcagttagaggtaacagctagtgcaatggtgccaagatgaaaccagccctagagaaatatgtgcacatgggatatatacacaagaaggtacagaggagcactgtttataaaaaccctacactggccaagctgtgtgcctgggcatgacactgggctcacccaaagggcaactttttcccattcacacagtgggctaatagtggccatgattttctacttccaaggtcagtacatagtaccttaaaacaacacatatcaacatagtgttggaagttctggccagggcaattaggcaggagaaggaaataaagggtattcaattaggaaaagaggaagtcaaattgtctctgtttgcagatgacatgattgtataacgagaaaaccccactgtctcagcccaaaatctccttaagctgataagcaacttcagcaaattctcaggatacaaaaccaatgtacaaaaatcacaagcattcttatacaccaataacagacaaacacagagccaaatcatgagtgaactcccattcacaattgcttcaaagagaataaaatacctaggaatccaacttacaagggatgtgaaggacctcttcaaggagaactacaaaccactgctcaatgaaataaaagaggaaacaaacaaatggaagaacattccatgctcatgggtaggaggaatcaatatcatgaaaatggccatactgcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacgctacctgacttcaaactatactacaaggctacactaaccaaaacagcatggtactggtaccaaaacagagatatagatcaatggaacagaacagagccctcagaaataatgccgcatatctacaactatctgatctttgacgaacctgagaaaaataagcaatggggaaaagattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggagataggcatgggcaaggacttcatgtctaaaacaccaaaagcaatggcaacaaaagacaaaattgacaaatgggatctaattaaactcaagagcttctgcacagcaaaagaaactaccatcagagtgaacaggcaacctacaaaatgggagaaaatttttgcaacctactcatctgacaaagggctaatatccagagtctacaatgaactcaaacaaatttacaagaaaaaaacaaccccatcaacaagtgggcgaaggacatgaacagacacttctcaaaagaagacatttatgcagccaaaaaacacatgaaaaaatgctcaccatcactggccatcagagaaatgcaaatcaaaaccataatgagataccatctcacaccagttagaatggcaatcattaaaaagtcaggaaacaacaggtgctggagaggatgtggagaattaggaatacttttacactgttggtgggactgtaaactagttcaaccattgtggaagtcagtgtggcgattcctcagggatctagaactagaaataccatttgaccctgccatcccattactgggtatatacccaaaggactataaatcatgctgctataaagacacatgcacacatatgtttattgcggcactattcacaatagcaaagacttggaaccaacccaaaggtccaaaaatgatagactggatgaagaaaatgtggcacatatacaccatggaatactatgcagccataaaaaataatgagttcatgtcctttgttagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattaggagatatacctaatgctaaatgacgagttaatgggtgcagcataccagcatggcacatgtatacatatgtaactaacctgcaaattgtgcacctgtaccctaaaacttaaagtataataataatttaaaaaaataaaaattaaaaaaagaaataaaaaaacacataattttctacctggtttttaaaaatcttaagttgaatgctttatgataaaaacagtctaaacaataaatttacagctttgaaaaatatatacttttctcaaatattactgtgattgcatcatctttcattttcatcatctttttaaaggtctattataattgtggctgcttctttggtctaattgtttgttttttatttatattactgctttcaagtatcattatactctggcctgagaattcagtcttttacaatttgtgctttctctgcattagttcatttcctttgtgatgtaatataggattttaatttttgccttttcaaccaatgtctttagtttttgcctatgtaagcaagatattgttaaatttttatttgaaattaaatgtgaaactcagagaatttaggacacaactttagtaaaaattcttatactattaactattaaaaccactgtatgtgatctgaacattctattttaggctgtctgttgctgctttcttcttaccgattttgtcaactttcagtctttcccccttgttgaatatggaatccccaacactgatcaatactaaaccatacagaatgctagtcctttacacaaaccatgcaactctatacttactaatcacagtgattagtagtcaaaaaagctgcttcaagttctgtaagcttataagtaaaatgatagtaaaaatgtcaccaagtactcaagactaggttcaaaagggcacttcggattcaagtggaagtatgtgtttattcctaacttgtttcacaaaacctgcagatgttattaggtgttgattctttaaaacattatttataatacttattagagctggaccacaatagaattagcaatgtactggtctaaaatatgcgtgtagtacagcctgaaaggtcctcaaatactaggttctgtaaataaatagtttcttattaatcagtataaaataatcccaactgtatgcactaaaacttaaaataaggaatgtgatttaaaatatcttagtaaatcactaaataggtgcaaataaacatacctcccatttttgtcatcttcatgaataaaggaaggcatggtctgtctgcaaaaatttcgctttgatgaacaaggcattcctttactacatcatagccatttagaaccacagttgatatgcctccaagatctaaactgaagatctttgagaagagaagaaaaacaacatttaaatgacagcatgtatggagaaatataaccatggaaatctacaagtggtaagtgcggctcttccaggatttgttacgtccctgaaaatataggcagttattactcaactgacaatgttcagagtgccctccttctataaggcatgcaaaactgtgtgatttcattatgccattcagtgcctaaagtcacagtcttaccaacagtataatgaaaagggtactggactcgggaggcctgggtctagtttaaggtttgccattaaacagataaaagactctgagcagaacacttaacctatctgggcttcagtattgccatagaaaatatatttgatatatatgctcttttatgattcattttacctcaaaatgttcaatgatatctaggaatctccttctatttccaagatgaatgaggctagtgagggagaggattgtcaaatacctgagagacaactttgaagtataaacatattgtaactaagcccatttgtatttggctctctgtattccacaaagtgaatgaagagggctctaagggaacctaaccttggaggaaaggcatttaccacataggttaggtggctgcctctcagttaaggggaaggcaaaacaggatccattccatgccttgctggagttgtctgccctgtgcctcaccccaggttcacttacaatgtcacacctcctgtagtctattctagttaacccaatataagaggccagtcagtgagagaacgatattcccttatcagtggaatgtaaagattgcttattgccatcctttcaggatagcattttacagccaaaatactgagacaagccttatccctgtgcaaacaagtcaaggagatttagccatggtacacactacttcagaagaaaacaggaggcttagcagagaacaaaagttcagcagaaagttatatcagcaaaggtcatgaggactgccaagtggtaacaactaaccagctgagtaatggggccaccagagtctttggcacacgggtgggctctgccaagtgagcactaggtatatccagaaccttgggaaaagaacatggactgcctgccataagcagtggtattagtcaaaagtgacagtagaagagttctaagtaaaagggaatggctaccagccgagcaaagtggggacaatgcagtaatgtagtcctattaaaggaaagtctcttcgcagaagggaactttagcagagacaataaaaagatgccattccacaaggatagtaaaagagccatgaacttaaagttgtgtcactatgaaggcagaacagagggcaaatgtatttcaggatagagcttcagggtagagcttcaaattgtggacaccagggatcataaaaagcaaggaggagccatggcttgagaaagttgttacacaatccacctttactcaagaatctgaaatagtcctctatttgagggtagaactggagaaatttttacttgaactagtatgtattcctgtatacagttttcaaggacttttggtaaaggtgtgtgactcaaattgtgaaaacttatccttaaactgctttgatctatggaagggtacaagattagcttatatattctttgatttattcaataattttagtgccaattatgggctaattataatgctggcagagatgtaaacaggaatacacaaaacattttccttgccttctagatcactccatgatcttcaagtctctttccctcacccaaaccagccctactcataatttttcactctcccagttaatgaccactccatacatccttcaagtggttgaggcccaggactttgcagtcacccacactgactcattatcttcttccaaactccacatccaactgctcagcagttatgctgtttctaccttcagaatataaacagaatcagacaatttattataacctgcaggtgaccggtctaagtcacctgcatttctcccttataacaacaacctcctaactggcctccctaatttcatccttgtctttttacaggtaattctcaacgtggcattctcttgctttatggcctttgttcttgctcttttcttagtctagaatgttcttccttttgatattcctatagcttgctccttcatttcctttgtctttgttcagatgctatctttgtggtgagacctgttctgattaagcaatttaaaatctgacccactaacattctccattcccttaccctaatttagtttacttcctactctgtactctttgaatatattatataatttacttgtgtttatattgtctgtcttcccccaactagaatataagctacataagggcaggaatctgttttggtcactgctatatctctagcacctaggacagtgcacagcatatgacaatagaaatatatgttgaattaatgaatagtcatagagacatacatttaaacatattattataacatcatgggctaaatgctaataacagacaaatgtgcaaagtgctgttgatgaaaaccattaagtgactgccacacttttcaacctttgcttggtttgtttcctcatttggaaggcttcctttgactgccatactaccctaaccataccaagtctttagggaccatcctccatgatgcctttcttggggcactctttttctctctgctttgaaccacacatgggagcttagaagctcccatggcacttatttaacactatcttgaaccagaaacattcatattcttgtcttctgcctgcatgctaaattacaaactccttaggagcagtgatttcatctttttcatctttgaatccttacacagaatctcattcagtgctgtgcataaagttctcaataaatgctgtaaaaataaattaatacgctgtcaattctacttgctttaatggaattattttattgtcctgaagtccattacctgaaaataatcgataaagccacttgtattggctttcctagccagggaatgcctcttgaaatctagactaagattaaagttactgcagaaatttaaacattcagaatcaatctccaaggaaatggtaattttcagtgtgatacacttctatttaagattgcctttaaaatgaatatataagtcctgaggactggctgtttaactttcaagaatcacaaagcagaattgaattcacagactaacacaaaggcgggtgtcacttgaagtgactgtcctaagcaattttaaagtccagttgtttttttttttttttctgtgagcatacatctcaaatttaaaagacagtggaaaactaagattttatttaagtcctaggtacaactttccagaactttttggaagcacaggagggaacaatattcttcaacctccaaaaaaaggtatagtattttaacaatttatgccaactttgagactttgtcagaattggaaaatatctctaagataatgggagatctttagagatgtttcataccaggataaagatcaaatgccgctgtagcctagagttaatatgtttggtggttatcaactagatctaaggcatagtgaggcaaacaatgtctactctttgatgcatacattctttttcatttttgctcctttcagtttttcctctgccccattgcagctagtaacagtttggccctatttcatttgtagtcaagagctctctctgtaaagaaccatggttccctcaaacagtggtaccagcaataaaactatgataggggacttagaaaaccccctgcccaaaagaaatattcatagtaataccgagtgtctttcagttcaaatatttatataagaaaagcttaattcctttttctgtgagaaaccatttcaaataacttgtttaaaaatactttcaaatttggaggtcgaacaaatgtgttctgtgtatagaaactaataacataggccgggcgcagtggctcacacctgtaatcccagcactttgggaggccgaggcgggcagatcacgaggtcaggagatcgagaccatcctgcctaaccgagtgaatgcccatctctactaaaaattacaaaaaattagccgggcgtggtggcgagcacctgtggtcccagctactcgggaggctgaggcaggagaatggcgtgaactcgggaggcggagctttcagtgagccgagatggcgtcactgcactccagcctgggtgacagagcaagactcgtctcaaataaaaaaagaaagaaactaataacatacacaataaccaagaacacttgagtagcacttttctgttttctgttgttattctcactaccgagaaaaaaaaaagactcagaatagaggtcaagttttgtctggcagaagacctgacctctagtcttatgctttcacattttatttctctagaatattatgatgctgtgtaccaagataccaaagagatgaaatatattacatgaaaatcatgggaataaactcaattctgggagaattgcaggttggaaaataagatctaagaattatacatacctttattatctcgtccagcttccctttaacaacgtaaactattcgtgaaccatgaaaggaacgtaaaccattagtgactttctattctagaaacctagaccaattctttttttttttttttttttttttttttgagacggagtctggctctgttgcccaggctggagtgcagtggcgcgatctcggctcactgaaagctccgcctcccgggttcacgccattctcctgcctcagcctcccgaatagctgggactacaggtgcccgccaccacgcccggctaattttttgtattcttttagtagagatggggtttcaccgtgttagccacgacggtctcgatctcctgatttcgtgatccgcccgcctcggcctcctaaagtgctgggattataggcgtgagccaccgcgcccgggcacctagaccaatccttgtaaaaattggtttaagtaaggatttaaggtcaaacctgaaataccacagttgccaaacatccctgtacttttccttcaaaacactgaccacagcctgtggccgataatgagattagttttctctctcccactcatctgccaactccttaaaaggctgtatctgccttcttcaccgctagcgtcaggcctgtagttgcatataaataagtgtaattcaaaacaaaacaggtgagctctgtcccaggacccgtggaaactcctgccccctccggacgtcgggacacccacacacaagcggtggtcgccttttccgctgccagtcacagggcatttccgtgctgctttcccctccgcagaatgaggaggagcgaagtaccgacctcaccggctggttatgagttttaaatgagtcaccaagttggcagtgacagtggcacacagaaggcgccttttaagtatctgctaaggtgccgttcccagccagtcagaacggcattaccatctgcgctgtaggacccccgcagcggattttagtcatcaattcattcacgcgttcacaatcgtttcccagggcccgcttctcagtcaggggcgttcccctgcattctccattctcacagcaaacgcctacaccagtcgttcgtcgactgcagacaccgaagaacctgctattaaccatctagaactcagaacgccttgattttccgacaagccgcgtgcagcttccacagagctgcgaggccgactcgcaagacgcccgcacctgagggcatgcgtccaccctggacctgaagtggcggcgcggctggcgagccaaacggcgcaggcgcaggagcaagagctcgagcggtagcgggaaaatcaggactggatcgcctcggagcctcggcccggagtgggtcaccggcaggggcggggctccccctgcaagggggcacggcgtcgaggacttctcccttccagacccgggaagcgggtgtccctcaaagggcagccggcacacggagaggtcccgactagtcggcccaggggcggccataagtccaaccaggaaggccctggccagcccgggccagcctggcggccctccctgcccggggcccgtcggggctgtacctctccgtacacctggctctgctttctcatgtagacatggggaagctcggatgaggctgccagggaatagatgttgccgataaatggcagccccggcggccccggggggaagcccatcggccgcctctgcttcagcagctggcggacccctagcgcgaagagcagcaggaagagcgcgccgccgagcgccgccgcgccctcttcagctctccaaagcttccacat
